United States Patent 10,760,091 (GENES AND USES FOR PLANT ENHANCEMENT) - sequence listing, part 8

SEQ ID NO: 30592 - protein, 429 aa, Pseudomonas syringae pv. tomato str. DC3000
MADKKAQLIIEGAAPVELPILTGTVGPDVIDVRGLTATGRFTFDPGFMSTASCESKITYIDGDNGILLHRGYPIEQLAEQSDYLETCYLLLNGELPTAEQKAQFVAVVKNHTMVHEQLKTFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDKIFILHADHEQNASTSTVRMAGSSGANPFACIAAGIAALWGPAHGGANEAVLTMLDEIGDVSNIDTFIAKAKDKNDPFKLMGFGHRVYKNRDPRATVMKQTCDEVLKELGIKNDPQLELAMRLEEIALTDPYFIERSLYPNVDFYSGIILKAIGIPTSMFTVIFALARTVGWISHWKEMLSSPYKIGRPRQLYTGNVQRDIIALKDRK

SEQ ID NO: 30593 - protein, 393 aa, Methylobacillus flagellatus KT
MTVINMTDLDLAGKRVFIRADLNVPVSDGKVTSDARITASIPTIRHALDAKARVMVTSHLGRPEEGVYSEENSLQPVADVLADKLGQPVRLIKDWVDGGFEVAEGEVVLLENCRFNKGEKKNAEETARKYAALCDVFVMDAFGTAHRAEASTYGVAQYAPVAAAGLLLVGELDALGKALCEPARPMVAIVGGSKVSTKLTVLESLAEKVDQLVVGGGIANTFLKAAGKPIGRSLSEDDLVPTAQCLMEKMAKRGAAVPIAVDVVCGKQFDANEPAVLKSAEDVADDDMIFDIGPESAKQLAEIILNAGTVVWNGPVGVFEFDQFGEGTKTIADAIAKTKAFTLAGGGDTIAAIQKYDIYDKVSYISTAGGAFLEFLEGKKLPAVEILEQRAKG

SEQ ID NO: 30594 - protein, 486 aa, Oryza sativa (indica cultivar-group)
MNTNYSSLPLTSIELQSNQRTSEVANGVGYNGHAKISKQDSFLVDGDAAAGGGGGENDDLPLIGDGPAGPPEGSGVPAAVFNLATSIIGAGIMALPATMKVLGVAVGLVSILVMGILSEVTIELLVRFAVYCRALSYGEVVHKALGRPASIVAQMCVIINNAGVLIVYLIIIGDVMSGSLKHIGVMDQLIGHGEWDNRRLLILVVLVIFLSPLCALEKIDSLSLSSAASVALAVVFVVVSCIIALVKVVEGKISMPRMGPDFSSRAAMLDLLVVIPIMTNAYICHFNVQPIYNELKEKTPHNMYKIGRITTVLCVVVYALTAVSGYLLFGEDTESDVLTNFDKDLGIRFSSILNFIVRIGYVIHLVLVFPVVHFSLRQTVDSLIFGELAPHSRKKMLTLTVVLLALIYLGSTMIPNIWVAFKFTGATTGLALGFIFPALIALRLDKEGKSLGKGERLLSIVMLGLAMVVSIIGVIGNVYSLRSKSA

SEQ ID NO: 30595 - protein, 582 aa, Oryza sativa (indica cultivar-group)
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNSKLNPHSPHTQGPIYFKFD

SEQ ID NO: 30596 - protein, 817 aa, Oryza sativa (indica cultivar-group)
MAATPTTSASAAATTRLFLPTRRHLHETASVPAPSRTIARRYSGGVRSLGPPRAAAGERGGGAGGTITGKGAVRIVSIVGDGSISPLKDTPWEEVMRHTANRMKWVDEGFEMLVFTDKSIGHDELRKELAQCDMLVNVAITSQETVQWLINNSEDIPNIICFQSSPTLENKLGGRYVQYTGRQDMFCKLTNIGETGGMKESAEVLKAVSNAWERHNSDDIRFCLLVVVNAYIRPVDMLQNLRAKGLSTLSCMIRNCGPQILNCLFDPNCRKALQCLNSCSPTDQVCNYRCIASYESPHLEAFSLCVLQKNNCLDLNAEIPSKPSVPPLTMFREQMLSHELAEDMFVGWLDNLEWSWRVVAGQNPAYDQFPCQYQLFYRGKAKGSFWYEPIFQVRTLEGELVWRRRKYRVRRALIPGTFYFSVLDNGVVSKEFWTIVDVSDDFSWGLFHYHGAAQAAGLAYTGAVLVSPDGSCPDLDDPRLASALDKCGIKKWELYMVDNCSCTGAPLGTPGDAKLHYQIAPGKESDPPQQFALFTVQDWSCGPVEVIEKKQRARMAGLYERPSETYTKKRPRYPDAWFSKLAALTAGHHRAWDAGCGTGQASISIAEHYDSVVATDASEGQIRHAVAHPKVRYLHTPVDLSEDDLVAMVGGEGSLDLVVVATSIHWFDIPLFYAVANRVLKRPGGVLAVWGYNYEIHPFEDKLHGQLYPAMRPYMDPRTRLAMDRYRDLPFPFEPVGVGREGEPADVDIEVDMTLDDLVGFLKTGSVVTTAREKGVDLEAVTKDVMKGVEAEWGDPAVARKLVFKAFMLAGKPKVLN

SEQ ID NO: 30597 - protein, 538 aa, Zea mays
MVSVVAALLMMAAVCGRLMPFTGGNTWVPPGVRAAVNAGAGPMATVPDPRDRLLGGLLSPDFDDSSCLSRYRAALYRRPSLHAISSYLVSALRRYESLHRRCGPGTPAYARAVERLRTPPNASSTTTNSSAGGCSYVVWNPTEGLGNRILSITSAFLYALLTDRVLLLHRGGNDLDDLLCEPFPGSTWILPADKDFPIRDIERLTDRNHHESLGSVLRRGEDPGVAPWLYLHLRHDYSGAYHDQLFFCDDVQAQLRRVPWLVFLSDNYIVPGLFLIPRYVGELARMFPRRDVVFHHLGRYLFSPSNTVWDMVMRYHGSYFAKADERVGIQVRKFPWWAPISTDELYGQILNCSQREDILPGVGVRVPADDKTTGAANSSGQPAKQKAVVVVSLHGEYSEKLRDLYQGHGGAAGGQEAVSVHQPTHLGSQRSGEQQHNQKALAEMVLLSFSDALVTSAVSTFGYVGQGLAGLRPWVLTSPVDRKGPGMPLPCRRAATIEPCFHAPPNYNCRAKANGDAGRIVRHIRHCEDFPQGVQLME

SEQ ID NO: 30598 - protein, 196 aa, Magnetospirillum magnetotacticum MS-1
  misc_feature (163)..(163): Xaa can be any naturally occurring amino acid
MKLDQVARSLLLKEFVSGFFLAMKYFFKPKATINYPFEMGHRGPRFRGEHALRRYPNGEERCIACKLCEAICPAQAITIEAGPRRNDGTRRTTRYDIDMVKCIYCGMCQEACPVDAIVEGPNFEFSVETREELLYDKEKLLANGDRWEREIARNIALDAPYRXPERLRRLCAHRRILLSIVRRRLGFEKRCEQSRG

SEQ ID NO: 30599 - protein, 336 aa, Methylococcus capsulatus str. Bath
MTIKIAINGYGRIGRNILRAIYETGRKDVEIVAINDLGDAQINAHLTRHDTVHGPFRGTVEVGEGEIIVNGDRIRVFSEKDPSKLPWGALGVDVVHECTGVFRTKAKCQPHLDAGAKKVIISAPADKNECDATIVYGVNEHTLKAAHTVISNASCTTNCLAPLVKPLLGKIGIVSGLMTTVHSYTNDQVLTDVYHKDLYRARAAALNMIPTKTGAAQAVGLVLPELDGKLSGFAIRVPTANVSVVDLTFIAARETDKDEINAILKAASESELKGILGYNDQPLVSSDFNHTTTSSNFDSTQTKVVGNLVKVLSWYDNEWGFSNRMLDTTVALMNAR

SEQ ID NO: 30600 - protein, 140 aa, Triticum aestivum
  misc_feature (91)..(91): Xaa can be any naturally occurring amino acid
  misc_feature (102)..(102): Xaa can be any naturally occurring amino acid
MAPTVMASSATSVAPFQGLKSTAGLPVSRRSSSAGLSSVSNGGRIRCMQVWPIEGIKKFETLSYLPPLSTEALLKQVDYLIRSKWVPCLEXFSKVGFVFREXNKLPRGTNDCRYWDNVGKLAMFRGGTTLQKVLNQGGRE

SEQ ID NO: 30601 - protein, 446 aa, Mycobacterium smegmatis str. MC2 155
MDRQKEFVLRTLEERDIRFVRLWFTDVLGYLKSVAIAPAELEGAFEEGIGFDGSSIEGFARVFESDTVARPDPSTFQVLPWKTSDGNHYSARMFCDITMPDGSPSWADSRHVLRRQLAKASDLGFTCYVHPEIEFFLLKPGPNDGTPPEPADNGGYFDQAVHDAAPNFRRHAIEALEQMGISVEFSHHEGAPGQQEIDLRYADALSMADNVMTFRYLVKEVALADGVRASFMPKPFAEHPGSAMHTHMSLFEGDTNAFHSPDDPLQLSDVAKSFIAGILEHANEISAVTNQWVNSYKRLVHGGEAPTAASWGAANRSALVRVPMYTPHKVSSRRVEVRSPDSACNPYLTFAVLLAAGLRGVEKGYVLGPQAEDNVWSLTQEERRAMGYRELPTSLGNALESMENSELVAEALGEHVFDYFLRNKRSEWENYRSHVTPYELKNYLSL

SEQ ID NO: 30602 - protein, 309 aa, Zea mays
MPEPIPVVDLSRLAAADEASKLRSALETWGLFLVTKHGIEASLMDDVMAASRDFFYQPLEAKQEYSNLIGGKRFQMEGYGNDMVKSKDQILDWQDRLQLRVEPQDERNLAYWPKHPDSFRDLLEKYASKTKIVRNKVLRAMGKTLELGEDYFISQIGDRASAIARFNYYPPCPRPDLVFGIKPHSDGGAVTILLVDKDVGGLQVQKDGVWYTVPSMPHTLLVNLGDSMEIMNNGIFKSPVHRVVTNAEKERLSLAMFYGVEGQRVLEPALGLLGEERPARYRKIMASDYIIGLRQGIAEGQRFIETLKI

SEQ ID NO: 30603 - protein, 238 aa, Glycine max
GRRQKGTEGRKHELLVTNAVATKGGASSAASTSKSGSGHELLLFEALREGLEEEMERGPCVCVMGEDVGHYGGSYKVTKGLAPKFGDLRVLDTPIAENSFTGMVIGAAMTGLRPVVEGMNMGFLLLAFNQISNNCGMLHYTSGGQFKIPIVIRGPGGVGRQLGAEHSQRLESYFQSIPGIQDVACSTPYNAKGLMKAAFRSENPVILLSHFCFINLRGRFQNLKMFCHPQKPEMLSPA

SEQ ID NO: 30604 - protein, 870 aa, Magnaporthe grisea 70-15
MSDQIKDEKSSANVADGGVLKEKQSAFSAARGSLDELPLPESVDASLLATDGDLIEARAIAARMTNDEVKSILLDVVKIHNDDPNFPFPVLEKIRGFIANPAVFENPEKHEELFAEMKLEAALITNNSPYSEVRAVVDNHDDPSLPVSTVRAWVIGMIFSVLLAFINQLFSIRQPSILVASNVAQILSYPLGKLWEKVMPDYGVNMFGSRISLNPGPFNKKEHMLITIMANVAYSTPYTNNIIWAQYLPTFFNQHYAGQFSYQILIGLSTNFIGYGIAGLTRRFLVYPSFCVWPSSLVTIALNTAFHDDNSTPVKAPFRKMISMSRYRFFLYAFSAMFIYFWFPDFIFQALSIFSWLSWIAPDNVNLNAVVGFNNGLGINPWPTFDWNTLLYNSLDPLMIPFFSTLNMTIGMAVSTITALGLWYTNAWNTGHLPINSNGVFDNTGSRFNVTRVIDSRGIFDSAKYTSYSMAYLAAGNICVYIFFFAIYPATVVYIGLYHRYEITMGFKSLWKSFKPKKKDENGNAIIEPLGSDVHNRLMSAYKEAPEWWYMSLLVISIALGIGGIAGYETFTTPGVIFYGLALCLIFVVPCGIVAAMTGAQVTLNVLAEFIGGSWVEGNALAMNFFKCYGYVTCAHALAFANDLKLAHYVKIPPRTTFIAQVVATLVSTFVCTGVLNFQMNMIPGVCTPDAPNRFTCPGINTFFTASVLWGTIGPKKVFGSGGQYTAALVGFPIGAALPFIFWALQRKYRGSRWLRQVHPVAMLYGSLSLSPYNLSYQWPAVPIAWLSWIYIKQRYLALWSKYNFVLSGAFSSGVAVAAIIIFFALQWGGDISLDWWGNQVVSQGCEASACVRLPLAKGETFGPPAGSWS

SEQ ID NO: 30605 - protein, 202 aa, Brassica napus
MQVVSPLSPATRFVGEESFAELYGKLNDDFSSKLKVGFTNEEEEKNRDDNKSWWNQDDDDDEREEGEEDEEFSFTSLNADNSPITADEAFEDGQIRPVYPLFNRNLLFEPEERDLRSPLKKLFVESEEAATTEREEESEPMGPYCSWSGRTVVEEASPETCRKSSSTGFSKLWRFKDLVSRSNSDGKDAFVFLNHGDKKKQS

SEQ ID NO: 30606 - protein, 382 aa, Pseudomonas aeruginosa PAO1
MIQSKLPNVGTTIFTRMSQLAAECGAINLSQGFPDFDGPPELREAVGRHIAAGHNQYAPMTGLPALREQVAKKIEQFYGRRVSADSEVTITPGATEAIFSAIQALVHPGDEVVVLDPSYDSYEPSVQLAGGRCVHVPLALPDFSIDWQRMAEAIGPRTRLVIINTPHNPSGALISREELDRLAALIRDRDIYLISDEVYEHLVFDGVAHTSVLSHDELYPRSFVVSSFGKTYHVTGWKTGYVVAPPALSAELRKVHQYVNFCGVTPLQWALADYMAGHPEHLRQLPGFYQAKRDLFCDLLLDSRFRFTRAPGTYFQCVDYSAIRPDLDDVAMAEWLTREHGVAAIPVSVFYEKAPDAMRLVRFCYAKREETLRQAAEKLCAI

SEQ ID NO: 30607 - protein, 411 aa, Zea mays
MNALAATSRNFKQAAKLVGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 30608 - protein, 382 aa, Bordetella bronchiseptica RB50
MESVERVNLLGLDGAALSELVGQWGGKPFRARQLQRWVHQRGADSFDAMTDLARDFRAQLARDCVIEALPVNTEQRSSDGTRKWLFDVGQGNAIETVFIPEDDRGTLCISSQAGCVVNCRFCSTGHQGFNRNLRASEIIGQLWWAKRVLEAAADTARLPGGKAGEDTRVISNVVMMGMGEPLLNYDQVLPALRLMLDDNAYGLSRRRVTVSTSGVVPMMDRLSQDCPVALAVSLHAPNDALRDELVPLNRKYPLNALLAACERYLAHAPRDFITFEYCMLDGINDTDQHARELIQLARQVRCKLNLIPFNPFPASGLKRSPSARVRVFAQRLMDAGIVTTVRKTRGDDIDAACGQLAGEVRDRTRITERNATRTIPIQQVHA

SEQ ID NO: 30609 - protein, 154 aa, Brassica napus
MSGALDMTLDESIKRAKAARSGGGRGSSRRGRGGGRGHGPNGFLGGGRGNGPARRGPLAVNARTSSFTINKPVRRTRSVPWQNGLFEDGLRAAGVSGVDVETRLHITNLDNGVTNDDIRELFSEMGELKRYAIHLDKNGRPSGTAEAHYLGSPM

SEQ ID NO: 30610 - protein, 578 aa, Vibrio parahaemolyticus RIMD 2210633
MTFSTENNKQIVLGEELGPLSDNERLKKQSNLLRGTIAEDLQDRITGGFTADNFQLIRFHGMYQQDDRDIRNERTKQKLEPLHNVMLRARMPGGIITPTQWLAIDKFATEHSLYGSIRLTTRQTFQFHGVLKPNIKLMHQTLNNIGIDSIATAGDVNRNVLCTTNPVESELHQEAYEWAKKISEHLLPKTRAYAEIWLDGEKVESTEEDEPILGKTYLPRKFKTTVVIPPQNDVDVHANDLNFVAIADNGKLVGFNVLVGGGLAMTHGDTSTYPRRADDFGFIPLEKTLDVAAAVVTTQRDWGNRSNRKNAKTKYTLDRVGTDVFKAEVEKRAGIQFEASRPYEFTERGDRIGWVEGIDGKFHLALFIENGRLLDYPGKPLKTGVAEIAKIHKGDFRMTANQNLIVAGVPKSEKAKIEKIAREHGLMDDNVSEQRKNSMACVAFPTCPLAMAEAERFLPQFVTDVEGILEKHGLPENDNIILRVTGCPNGCGRAMLAEIGLVGKAPGRYNLHLGGNRAGTRVPKMYKENITDKQILEEIDLLVARWSKEREEGEAFGDFTIRAGIIQEVFVSKRDFYA

SEQ ID NO: 30611 - protein, 881 aa, Phaeosphaeria nodorum
MAPTLLAAIDLVSQSNASQGLDEQALSFVGSVFVRVTDGTVDQALAHLQQSVGRYSNYLGVATLTSTDDILSLLDAGAAKVFVTRQQLDTLKSLNIDQDRIVLCLPGNSRSEVIDAISGTQVDVYSHQVHDIDLVEAWLKEYGPDRPNVFVSFSEPNLENSLKLAKLSAIPIIPAQSLTIDEKKDSSLISVAKLVMANATSDRPDGLYTTLVTDERGVALGLVYSSEESVAESLRTGRGVYQSRKRGLWYKGESSGDIQELVSMSFDCDSDCLQFVVRQKGRGFCHLATPTCFGDYRGLSKLQKTLQSRKESAPQGSYTARLFNDAQLLRAKILEEATELCDATTKEHIAFEAADLFYFALTKCVAAGVSLEDVERNLDAKSIKVKRRQGDAKPAFAAQAAAAVNGTSNAATNGASNGVSVETLKEAASVPKSKDDPAGTKDGRIAMKRYVTAQETSETIAAALQRPSQKSTEKIIGICRPIIDAVKTRGDAALLEYTHKFEKATSLTSPVLRAPFPPELMQLAPETAKAIDISFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLTAIEDELHKQANALPRVDIVRGAIEHSLTLAASTIEEALELSNQYAPEHLILQVANADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30612 - protein, 210 aa, Methylococcus capsulatus str. Bath
MKIPPVSIRYLRSILELKDAPPDQGCEVAFAGRSNAGKSSAINTLANVGGLARVSKTPGRTRMINFFSIDDGRRLVDLPGYGYAKVPGEIHRRWEAALEQYLRYRQSLRGVFLLMDVRHPFTEMDEVMIEWCAHRSIALHVALTKSDKLSRGAAMNARLMAKTRLAGYGSPDFSVQLFSSLKKSGTEEAWEVLGRWLDLPREDQEKTPGA

SEQ ID NO: 30613 - protein, 587 aa, Oryza sativa (japonica cultivar-group)
MASMDEPLYPIAILIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKESDIVDWFVPVVKRLAAGEWFTARVSSCGLFHIAYPSAPDQLKAELRTIYGQLCQDDMPMVRRAAASNLGKFAATVEQNYLKTEVMSIFDDLTQDDQDSVRLLAVEGCAALGKLLEPQDCVAHILPVIVNFSQDKSWRVRYMVANQLYELCEAVGPEHSREQLVPAYVRLLRDNEAEVRIAAAGKVTKFCRILSPQLAIQHILPCVKELSSDSSQHVRSALASVIMGMAPVLGKEATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQQLLPVVINSSKDRVPNIKFNVAKVLQALIPILDQSVVEKNVKPCLVELSEDPDVDVRYYANQALQACDQIMMSS

SEQ ID NO: 30614 - protein, 872 aa, Phaeosphaeria avenaria f. sp. avenaria
MAPTLLAAIDLVNQSNASQGLNQQALSFVGSVFARVTDETVDQALAHLQQSIGRYSNYLGVATLTSTDDILSLLDAGAAKVFVTRHQLDALKSLNIDQDRIVLCLPGNSRSEVIDAISGTQVDVYSHQVHDIDLVEAWLKEYGPDRPNVFVSFAEPNLENSLKLAKLSAIPIIPAQSLTIDEKKEPSLVSVAKLVMANATSDRPDGLYTTLVTDERGVALGLVYSSEESVGESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHIAFEAADLFYFALTKCVAAGVSLEDVERNLDAKSIKVKRRQGDAKPAFAAQAAAANGTSNGVSAETLKEAASVPKSKDDPAGTKDGRIAMKRYITAKETPETIAAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGMNEGQLRAVENELHQQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30615 - protein, 486 aa, Mycobacterium tuberculosis
MAHHHHHHGTEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 30616 - protein, 431 aa, Nicotiana tabacum
MEMEYVTEYPRPYMDRRPKKRPRLDWDPSHTPKAQSGIYYGQEVGNSSSYVHSRLLPDHDSLYVKGLAQKGSPPRRDDDKDGHYMFELGENLTTRYKILKKIGEGTFGQVLECWDREQKGFVAIKIIRSIKKYREAAMVEVDVLQLLGRYDRGGTRCVQLRNWFDYRNHICLVFEKLGPSLFDFLRKNSYRAFPVDLVREIGRQLLECVAFMHDMRLIHTDLKPENILFVSADYIKVPDYKGTPWSHRDRSFSKRLPKSSAIKVIDFGSTAYERPDHNYIVSTRHYRAPEVILGLGWSYPCDLWSVGCILIELCSGEALFQTHENLEHLAMMERVLGPLPSQMLKRVDRHAEKYVRRGRLDWPEGATSRESIKSVMKLPRLQNLVMQHVDHSAGDLIDLLQGLLRFDPSIRMTAHDALRHPFFTKDQYRRL

SEQ ID NO: 30617 - protein, 90 aa, Lactobacillus delbrueckii subsp. lactis
  misc_feature (3)..(4): Xaa can be any naturally occurring amino acid
VWXXALANYITALGYGLEDDSLFKKYWPADVHLVGKEIVRFHTIYWPIMLMALDLPLPKQVFGHGWVLIYKDKMSKSKGNAVYPESLISR

SEQ ID NO: 30618 - protein, 226 aa, Abies beshanzuensis
QAKAAGARIIVTQAAYVEKLADLQSDDVIVITIDGVPKDGCKHISVLTEADETQCPSVEIQPDDVVALPYSSGTTGLPKGVMLTHKGLVSSVAQQVDGENPNLYFHSEDVIVCVLPLFHIYSLNSVLLCALRAGAATLIMQKFNLTSFLELIQRYKVTIAPIVPPIVLDITKSPIISQYDVSSVRTIMSGAAPLGKELEDALRDLFPQAIFGQGYGMTEAGPVLAM

SEQ ID NO: 30619 - protein, 135 aa, Brassica napus
EELCTEFPNTTVLLDHAGFCKVPENGEAKDTYSQLMELSRFPQVYVKFSALFRISRTGFPYQDLAPLLSQVVSNFGANRVMWGSDFPFVVLECGYKEAKEAVTIIAKQASLSSSDMDWIMGKTVMQLFPGQWVLP

SEQ ID NO: 30620 - protein, 245 aa, Bdellovibrio bacteriovorus HD100
MYKILFACPIRWYRNPMALQERTLKKEILKMVVGFHRFQQRFFNNQDSHLYEHLSSIGQSPKTLMIACSDSRVDPAILFSSSPGEMFVVRNVANLVPPYESNMGFHGVSAAIEFAVANLKVENIVVLGHRQCGGIRSLFQPENVLKGGFVAQWMTIAETAKLKVLEKDPHGDLDTHCRDCEKESIVISLQNLRSFPFIQDAIKNRGLELFGVYFDLENGHLWNYNDATHVFDEVTLNGLRATNLP

SEQ ID NO: 30621 - protein, 1442 aa, Saccharomyces cerevisiae
  misc_feature (464)..(464): Xaa can be any naturally occurring amino acid
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLXIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 30622 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSSDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 30623 - protein, 484 aa, Burkholderia sp. 383
MTAEYTLQHRIAGEACDAAQGEWFEKFEPCTGHLLARVAAGTGADVDRAVRAARAEFDGGHWSRLPGAARAKLLHRLADLLEHDAERFVELLVREQGRPALEVRMMDLPMSIDTLRYFAGWADKLEGRQIPTGGFMGRPTVNYTVREAVGVAGLIVPWNAPLMIACWKLAPALAAGCTVVIKPSEDAPLAVGALADLAAQAGFPPGVVNLVHGIGASVGAALVNHPGVDKISFTGSTEVGRTIAREAGARFKRLTLELGGKAPQIIFDDANLEQAIAGVAMGLFVNQGQTCAAGTRVLVQRRHYDDVVGALAHAARSVKVGTPFDPDTQMGALISARHADRVKTHIAAALRDGATMVAGDEPVPSQGFFVRPTVFANVDPAMRIARDEVFGPVGTIIPFDTEDEAVALANDTVYALSASLWTRDLTTAHRTAARLRVGAVAVNAWSPLDARLPWGGFKESGVGRDLSQSGLDAYLEEKVVTIAM

SEQ ID NO: 30624 - protein, 229 aa, Abies beshanzuensis
IAKQAKAAGARIIVTQAAYVEKLADLQSDDVIVITIDGAPKDGCKHISVLTEADETQCPSVQIQPDDVVALPYSSGTTGLPKGVMLTHKGQVSSVAQQVDGENPNLYFHSEDVIMCTLPLFHIYSLNSVLLCALRAGAATLIMQKFNLMSFLELIQRYKVTVAPIVPPIVLDITKSHVVSQYDVSSVRLIISGSAPLGKELEDALRDLFPQAIFGQGYGMTEAGPVLAM

SEQ ID NO: 30625 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTALIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 30626 - protein, 143 aa, Glycine max
  misc_feature (85)..(85): Xaa can be any naturally occurring amino acid
  misc_feature (93)..(93): Xaa can be any naturally occurring amino acid
  misc_feature (122)..(122): Xaa can be any naturally occurring amino acid
MASSMISSPAVTTVNRAGAGMVAPFTGLKSMAGFPTRKTNNDITSIASNSGRVQCMHVWPPVDKKKFETLSYLPYLDNTQLAKEXEYLLKKEXIPYLEFECKHDFIYHKHNRSPGYYNKHYXTIVKLAIYNYTNTSQILRDLQ

SEQ ID NO: 30627 - protein, 440 aa, Staphylococcus aureus subsp. aureus MRSA252
MKTYDLIVIGFGKAGKTLAKYAASTGQHVAVIEQSSKMYGGTCINVGCIPSKTLVHDGLEGKSFEASYNRKNDVVNALNNKNYHLLADDSNIDVLDFKAQFKSNTEVNLLDQHGDIVDSITAPHIIINTGATSIIPNIKGLDQAKHVFDSTGLLNISYQPKHLVIVGGGYIALEFASMFANLGSKVTVLERGESFMPREDQDVVAHAITDLENKGIALHTNVETTELSSDNYHTTVHTNVGNFEADAVLLAIGRKPNTDLALENTDIELGDRGEIKVNAHLQTTVPHIYAAGDVKGGLQFTYISLDDYRIIKSSLYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTILRDNIYTHPTMAESFNDLFNF

SEQ ID NO: 30628 - protein, 2216 aa, Candida albicans SC5314
MAQLSVPITPPMESTGDVLMTLETQDGIALQGYSFGAAKPAAGEVVFQTGMVGYPESITDPSYEGQILVITYPLVGNYGVPDRELLDEDYEPALPKYFESNKIHIAGLVVAHYTEEYSHWLAKSSLGKWLQEQGIPAIYGVDTRSLTKRLREKGSTLGRLAIQNSDYKSEEIISQSKSNPQNWKKFFNVPEFDDPNVKNLVAKVSTDKPILYTPKKTNENIKLGKNGKPIRILAVDVGMKYNQIRCFVRRGVELLVVPWDYDFTTEEYDGLFISNGPGDPAVMDKTVERLQKILKEGKTPVFGICLGHQLLARATGASTLKLKFGNRGHNIPCTSTISGRCYITSQNHGYAVDTATLSNGWKELFVNANDGSNEGIYHESKPFFSVQFHPESTPGPRDTEFLFDVFIKSVVDFNQSGGVYKQVEFPGGKLAENRAAHPKVDVKKVLVLGSGGLSIGQAGEFDYSGSQAIKALKEEGIYTVLINPNIATIQTSKGLADKVYFLPVTPEFVRKVIKHERPDGIYCTFGGQTALSVGIALKDEFEGLGVKVLGTQIDTVITTEDRELFASAMAEINEKCARSEACNTVKEAVDAANAIGYPLIVRAAYALGGLGSGFADNEEELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYCVVKIPRWDLKKFTRVSALLSSSMKSVGEVMAIGRTFEEAIQKAIRSTDYHNLGFNKTAALMSIDIDQELQTPSDQRLFAIANALSDGYSVDKVWKLTNIDKWFLNKLDGLIKFGNKIASYGAKEDVPMSILRQAKQLGFEDRQIAKFLGSNEVAIRRLRKDAGIIPFVKQIDTVAAEFPAFTNYLYVTYNADSSDVKFDDNGVIVLGSGVYRIGSSVEFDWCAVRAIRTLRENNVKTVMINYNPETVSTDYDEADRLYFEPINLERVLDIYDLEQSSGVIISMGGQTSNNIALPLYRQNVKILGTSPEMIDSAENRYKFSRMLDRIGVDQPAWKELTSIDEAEDFAEKVGYPVLVRPSYVLSGAAMNTVYSKDDLASYLGQAVDVSPDYPVVITKYIENAKEIEMDAVAKDGKMIMHVVSEHVENAGVHSGDATLIVPPQDLDPETVRRIVEATAKIGKALDITGPYNIQFIAKDNDIKVIECNVRASRSFPFVSKVVGVDLIEMATKAMLDLPIVPYPGERLPEDYCAVKVPQFSFSRLAGADPVLGVEMASTGEVATFGKNKYEAYLKSLISTGFKLPKKNILFSIGSFKEKQELLPSIAKLHELGYKIFATAGTADFIKEHGIPVHYLEVLSKDEDQKSEYNLSQHLANNLIDLYVNLPSANRFRRPASYMSKGYESRRMAVDYAVPLVTNVKNAKLLVEAIARNISLEVSNRDAQTSHGTAILPGLINITSFATSFDDFEQTTKESLAAGFTFNAFLPHTQAGASVTDYRSLIDAIDAVGASAYTDYSVSIAASETNSQSVSDAADNAGSLFLPFNDFANSKVSALTAQFSSWPNNKPIITDAKTTDLASVLLLASLYNRSIHITGVSSKEDLDLIKMAKEKTLQVTCDVAVHSLFLSKDELDYPFLPNKQDQEYLWENLKDVDCFSIGVLPYLIAKASGTEIVPGMGIKEAVPLLLTAVKAGKLTIGDIVSKFHDNPAKIFNLPKQDAQVVLDLDRFATVEPVYPEFSKLRLRGAVERVSFHNETVVLDGSVLSQIALGKNEVVPRSRFGSTAGIPESPRLGNKRVSFSSDMRRPSLAPETPEPQPAIFEKLGSELVSQPIAGSLGEIAALSDYIRHNNTFLRNNIISVKDITRSDLHSLFTVAQEMRLAVERQGVLDLLQGRVLATMFYEPSTRTSTSFDAAMQRLGGRVVAVDHGSSSVKKGETLQDTIRTLSCYSDAIVLRHPSEESADIAAKYSPVPIINAGNGTKEHPTQALLDLFTIREELGTVNGITVTFMGDLKYGRPVHSLCHLLRHYQVRVQLVAPKELQIPAEIRQQLIDNNMLIAESEELTKEILARSDVLYCTRVQEERFADKEQYQRLKDTYIVDNKILSNAKQHMCVMHPLPRTNEIREEVDFDQRAAYFRQMRHGLFIRMALLAMVIGVDF

SEQ ID NO: 30629 - protein, 495 aa, Debaryomyces hansenii CBS767
MLRSSSSFRGLNNKAIKIAQFVRHASTQEFDVVVIGGGPGGYVSAIKSAQLNLKTACIEKRGSLGGTCLNVGCIPSKSLLNNSQLFHQIQHDSKHRGIEISGDVSINIDTLQAAKDKAVKGLTGGVEMLLKKNGVTYFKGEGSFIDENNVNVKPIDGSEDIQISAKNIVVATGSEPTPFPGIEIDEERIVSSTGALALKEVPKKMSIIGGGIIGLEMASVWSRLGSEVTVIEFQNAIGAGMDGEVAKQIQKLLGKQGLKFKLGTKVTKGVRDGETVKIEVEDVKSGKKEDLDADVLLVAIGRRPFTNGLNFDKIGLEADDKGRLVIDNQFRTKHEHIRVIGDVTYGPMLAHKAEEEGIAAAEYIKNGHGHVNYANIPSVMYSHPEVAWVGANEEQLKEQGIKYKIGKFPFIANSRAKTNLDTDGFVKFIADAETQRVLGVHIIGSNAGEMIAEAGLALEYGASTEDIARTCHAHPTLSEAFKEAALATFDKPINF

SEQ ID NO: 30630 - protein, 382 aa, Oryza sativa (japonica cultivar-group)
MLALASTFLYALLTDRVLLVHAPPEFDGLFCEPFPGSSWTLPADFLITDFDGVFTMWSPTSYKNMRQAGTISNATAEQSLPAYVFLDLIQSFTDAAFCDDDQQVLAKFNWMVIKSDVYFAAMLFLMPAYERELTQLFPEKEAVFHHLARYLFHPSNDVWGIVHRFYEAYLARADELVGLQVRVFPEMPIPFDNMYEQIIRCSEQEGLLPKLGQTVVVTAANGSSVVAPSTKLTSILVTSLFPDYYDRIRGVYHARPTETGEYVAVHQPSHEREQRTEARGHNQRALAEIYLLSFCDRVVTSAVSTFGYIAHGLAGVRPWVLLRPPSPVARAEPACVRSETVEPCLQALPRRMCGAAEGSDIGALVPHIRHCEDVQKGIKLFS

SEQ ID NO: 30631 - protein, 216 aa, Campylobacter upsaliensis RM3195
MKNYYLVDEKRRNPQNTWEKITRALKRSVKLELFVGLWVVMRELLKKGNSATIKYPFEKVQIDNRYRAVHRLMRFIESENERCIGCGLCEKICISNCIRMETSLDENGRKKANNYSINLGRCIYCGFCAEVCPELAIVHGKEYENAAEQRSYFGYKEDFLTPIDKLKNQVEFEGAGSLRKDADRFVKKTPQYYEILQKREQGLRDDTNCTLPKGEA

SEQ ID NO: 30632 - protein, 865 aa, Phaseolus vulgaris
MFGILGGGKGHKIKGTVVLMTKNVLDFNEVVSTAGGGVLGIAGGIFGTANKVVGGIVDGATAIFSRNIALQLVSATKTDGLGNGKVGKQTFLENHLPSLPTLGDRQDAFNISFEWDESFGIPGAFYIKNFMQAEFFLVSLTLEDIPNHGTIHFVCNSWVYNAKNYKKDRIFFVNKTYVPSETPTPLVKYRKEELENLRGDGTGQRKVSDRIYDYDVYNDLGNPDKSADLARPVLGGSSAYPYPRRGRTGRKASKRDPKSEAPASDTYIPRDENFGHLKSSDFLTYGIKSLAQSVLPQFQSAFGLNAEFDKFDDVRGFFEGGIHLPTDVISNISPLPVIKEIFRTDGEQVLKFPPPHVIQVSKSAWMTDEEFGREMLAGVNPCLIQRLQEFPPKSKLDASVYGDQTSTITKENLEINLGGLTVEEALNGNKLFILDHHDAFLPYLRKINDLPTAKSYATRTILFLKDDGTLKPLAIELSLPHPRGDEFGAVSRVILPADQGAESTIWLLAKAYVVVNDSCYHQLMSHWLNTHATIEPFVIATNRHLSVLHPIYKLLSPHYRDTMNINGLARQSLINAGGIIEQSFLPGPFSVEMSSAVYKSWVFTDQALPADLIKRGMAIEDPSSPHGLRLVIDDYPYAVDGLEIWSAIQSWVKDYVSLYYATDDAIKKDTELQTWWKEAVEKGHGDLKDKPWWPKLNTPQNLIHICSIIIWTASALHAAVNFGQYPYGGYILNRPTLTRRLIPEPGTKEYDELSSNHQKAYLRTITGKYEAIVDLSVIEILSRHASDEVYLGQRDNPNWTDDTKALQAFQKFGNKLKEIENKILGRNNNSSLRNRVGPVKMPYTVLLPTSKEGLTFRGIPNSISI

SEQ ID NO: 30633 - protein, 783 aa, Aspergillus niger
MAPPQAPVQPPKRRRIGVLTSGGDAPGMNGVVRAVVRMAIHSDCEAFAVYEGYEGLVNGGDMIRQLHWEDVRGWLSRGGTLIGSARCMTFRERPGRLRAAKNMVLRGIDALVVCGGDGSLTGADVFRSEWPGLLKELVETGELTEEQVKPYQILNIVGLVGSIDNDMSGTDATIGCYSSLTRICDAVDDVFDTAFSHQRGFVIEVMGRHCGWLALMSAISTGADWLFVPEMPPKDGWEDDMCAIITKNRKERGKRRTIVIVAEGAQDRHLNKISSSKIKDILTERLNLDTRVTVLGHTQRGGAACAYDRWLSTLQGVEAVRAVLDMKPEAPSPVITIRENKILRMPLMDAVQHTKTVTKHIQNKEFAEAMALRDSEFKEYHFSYINTSTPDHPKLLLPENKRMRIGIIHVGAPAGGMNQATRAAVAYCLTRGHTPLAIHNGFPGLCRHYDDTPICSVREVAWQESDAWVNEGGSDIGTNRGLPGDDLATTAKSFKKFGFDALFVVGGFEAFTAVSQLRQAREKYPEFKIPMTVLPATISNNVPGTEYSLGSDTCLNTLIDFCDAIRQSASSSRRRVFVIETQGGKSGYIATTAGLSVGAVAVYIPEEGIDIKMLARDIDFLRDNFARDKGANRAGKIILRNECASSTYTTQVVADMIKEEAKGRFESRAAVPGHFQQGGKPSPMDRIRALRMATKCMLHLESYAGKSADEIAADELSASVIGIKGSQVLFSPMGGETGLEATETDWARRRPKTEFWLELQDTVNILSGRASVNNATWSCYENA

SEQ ID NO: 30634 - protein, 872 aa, Phaeosphaeria avenaria f. sp. avenaria
MAPTLLAAIDLVNQSNASQGLNQQALSFVGSVFARVTDETVDQALAHLQQSIGRYSNYLGVATLTSTDDILSLLDAGAAKVFVTRHQLDALKSLNIDQDRIVLCLPGNSRSEVIDAISGTQVDVYSHQVHDIDLVEAWLKEYGPDRPNVFVSFAEPNLENSLKLAKLSAIPIIPSQSLTIDEKKEPSLVSVAKLVMANATSDRPDGLYTTLVTDERGVALGLVYSSEESVGESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHIAFEAADLFYFALTKCVAAGVSLEDVERNLDAKSIKVKRRQGDAKPAFAAQAAAANGTSNGVSAETLKEAASVPKSKDDPAGTKDGRIAMKRYITAKETPETIAAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGMNEGQLTAVENELHQQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30635 - protein, 872 aa, Phaeosphaeria avenaria f. sp. avenaria
MAPTLLAAIDLVNQSNASQGLNQQALSFVGSVFARVTDETVDQALAHLQQSIGRYSNYLGVATLTSTDDILSLLDAGAAKVFVTRHQLDALKSLNIDQDRIVLCLPGNSRSEVIDAISGTQVDVYSHQVHDIDLVEAWLKEYGPDRPNIFVSFAEPNLENSLKLAKLSAIPIIPAQSLTIDEKKEPSLVSVAKLVMANATSDRPDGLYTTLVTDERGVALGLVYSSEESVGESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHIAFEAADLFYFALTKCVAAGVSLEDVERNLDAKSIKVKRRQGDAKPAFAAQAAAANGTSNGVSAETLKEAASVPKSKDDPAGTKDGRIAMKRYITAKETPETIAAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGMNEGQLTAVEDELHQQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30636 - protein, 332 aa, Arabidopsis thaliana
MATDFKSLPVIDISRLLLKCDDPDMAEDVGVAEVVQQLDKACRDAGFFYVIGHGISEDVINKVREITREFFKLPYEEKLKIKMTPAAGYRGYQRIGENVTKGIPDIHEAIDCYKEIKQGKYGDIGKVMEGPNQWPENPQEFKELMEEYIKLCTDLSRKILRGISLALAGSPYEFEGKMAGDPFWVMRLIGYPGAEFTNGQPENDIGCGAHTDYGLLTLVNQDDDKTALQVRNLGGEWISAIPIPGSFVCNIGDMLKILSNGVYESTLHRVINNSPQYRVCVAFFYETNFDAVVEPLDICKQKYPGGRGGCQVFKRAVYGEHLVSKVQTNFAM

SEQ ID NO: 30637 - protein, 471 aa, Nocardia farcinica IFM 10152
MPLSHPSFPQDPGPSEVAVNPVFTREPVSVPRDRLPAGELDADIAYQVVHDELMLDGNARLNLATFVTTWMEPSARVLMAECFDKNMIDKDEYPRTADLEQRCVRMLADLWHAADPAHATGCSTTGSSEACMLAGLALKRRWQHRRRAAGLSTERPNLVMGANVQVCWEKFADYWDVEARLVPMAGDRFHLTAEAALPHCDENTIGVVAVLGSTFDGSYEPVAEICAALDELERQRGWDIPVHVDGASGAMVAPFCDPDLVWDFRLPRVASVNTSGHKYGLVYPGVGWVVWRDAAALPEDLIFRVNYLGGQMPTFALNFSRPGAQVVAQYYTFLRLGRSGYTRVQQYCRDVATRLADRIAALGAFRLLTDGRQLPVFAFTLAEGETGYSVFDVSAALREQGWLVPAYTFPADREDLAVLRIVVRNGFSHDLADMLLDALAAVLPRLRAQDRPQHGPDTATFAHGAQAPSGH

SEQ ID NO: 30638 - protein, 872 aa, Phaeosphaeria avenaria f. sp. avenaria
MAPTLLAAIDLVNQSNASQGLNQQALSFVGSVFARVTDETVDQALAHLQQSIGRYSNYLGVATLTSTDDILSLLDAGAAKVFVTRHQLDALKSLNIDQDRIVLCLPGNSRSEVIDAISGTQVDVYSHQVHDIDLVEAWLKEYGPDRPNVFVSFAEPNLENSLKLAKLSAIPIIPAQSLTIDEKKEPSLVSVAKLVMANATSDRPDGLYTTLVTDERGVALGLVYSSEESVGESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHIAFEAADLFYFALTKCVAAGVSLEDVERNLDAKSIKVKRRQGDAKPAFAAQAAAANGTSNGVSAETLKEAASVPKSKDDPAGTKDGRIAMKRYITAKETPETIAAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGMNEGQLTAVEDELHQQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30639 - protein, 359 aa, Glycine max
MSSTQLPFPIRMQSATRAEAERLLGIAEKLLQNRDLVGSREFAFLAQETEPLLEGSDQILAIVDVLLAADKRVNNHPDWYAVLQVDRRSDDLDLIKKQYRRLALLLHPDKSRFHFADHAFQLVADAWALLSDPIKKSVYDKELSFFSRVDLSVPGWVQQQEKLPVRRTGPGPGPGPGPTAGRNSAASAREDIHADENSRRRRSSTFWTACPYCYRGSRYPRVYEGCCLRCQNCDRSFHGVTVPSLPPLVPGQDAYYCCWGFFPMGFVVGSFGSPPQPEEEAAPSAAEAPPSPPPPPQQPASSLPNWMPVAAENGVGSVTPVAAATRLTRSGAAVPNGVGSGNGTGKKKRGRPRKYPLPS

SEQ ID NO: 30640 - protein, 913 aa, Oryza sativa (japonica cultivar-group)
MELSNQGQTPMSTNMGSQPLPSSNIQPNQAEYPSMFYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSS

SEQ ID NO: 30641 - protein, 315 aa, Clostridium perfringens ATCC 13124
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDENGERDFEFHRGSDGEYSFNNIDLSKIEKDDIIHFGSATGFLKGELKNTYFKLLEIGRKNGNFISFDPNYRDMLIKEEGIEEFKEDCKKFISSCDFLKLSDEEIKLLTEEEDLERGVEKLHSLGAKIIAVTLGGKGTLLSNGIHSEIVPSIKINQVDSTGAGDAFVGAVLKKVSELENKKNLDLNLWREIISYGNKVGALTCTNYGAIDAIPNEEDLMKYI

SEQ ID NO: 30642 - protein, 166 aa, Cryptococcus neoformans var. neoformans JEC21
MSLSNPLNLLLVPPLLFLAYRILVPPPPHTPPEYNSLPAEHPHVICHSTFTPAQLAQYDGTNGDRILLAIMRVAPDGKIDPNGERTVFDVTAGRTFYGPDGVYGNFAGRDASRGMAKQSFEPEVLTSIDEPLDDLSDLTPSEIENMRGWHQHFEGKYIVCGELVNG

SEQ ID NO: 30643 - protein, 880 aa, Phaeosphaeria nodorum
MAPTLLAAIDLVSQSNASQGLDQQALSFVGSVFVRVTDETVDQALAHLQQSVGRCSNYLGVATLTSTDDILSLLDAGAAKVFVTRQQLDALKSLNIDQDRIVLCLPGNSRSEVIDAISGTQVDVYSHQVHDVDLVEAWLKEYGPDRPNVFVSFSEPNLENSLKLAKLSAIPIIPAQSLTIDEKKGSSLISVAKLVMANATSDRPDGLYTTLVTDERGVALGLVYSSEESVAESLRTGRGVYQSRKRGLWYKGESSGDIQELVSMSFDCDSDCLQFVVRQKGRGFCHLATPTCFGDYRGLSKLQKTLQSRKESAPQGSYTARLFNDAQLLRAKILEEATELCDATTKEHIAFEAADLFYFALTKCVAAGVSLEDVERNLDAKSIKVKRRQGDAKPAFAAQAAAVNGTSNAATNGASNGVSVETIKEAASVPKSKDDPAGTKDGRIAMKRYVTAQETPETIAAALQRPSQKSPEKIIGICRPIIDAVKTRGDAALLEYTHKFEKATSLTSPVLRAPFPPELMQLAPETAKAIDVSFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGMNEAQLTAIEDELHKQANALPRVDIVRGAIEHSITLAASTIEEALELSNQYAPEHLILQVANADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30644 - protein, 167 aa, Cryptococcus neoformans var. neoformans JEC21
MSLSNPLNLLLVPPLLFLAYRILVPPPPHTPPEYNSLPAEHPHVICHSTFTPAQLAQYDGTNGDRILLAIMRVAPDGKIDPNGERTVFDVTAGRTFYGPDGVYGNFAGRDASRGMAKQSFEPGKFLTSIDEPLDDLSDLTPSEIENMRGWHQHFEGKYIVCGELVNG

SEQ ID NO: 30645 - protein, 345 aa, Cryptococcus neoformans var. neoformans JEC21
MVNLADLSNSLASQDFTSIPVIDLSDAQSPSLQKRKAVAAEIRNACLNAGFFYVKNHGVPLQVVDRTFEQSKEFFNQPDGLKKSVDISKSGGNFRGYMGLLSENNDPKNKGDMHEAFNMGLDPSVDASAFIQDVKEGELRHSENLWPDKKDWQGADVFKQANLDYYKEVLGLGQSLFPLFALALDLPEDFFSDKIEHPAAIMRILFYPALGERQVDELMPGIGAHTDFECFTILRQDDVPSALQVQNRKGQWIDAPYMPDTFVINIGDQFARWTNDIFVSTRHRVLPALSKDRYSIPFFFGCDHDVPLIPPDTCVTADRPAKYETMTAGAYVHMRLSDIYKVKET

SEQ ID NO: 30646 - protein, 1442 aa, Saccharomyces cerevisiae
  misc_feature (1227)..(1227): Xaa can be any naturally occurring amino acid
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGXVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 30647 - protein, 519 aa, Novosphingobium aromaticivorans DSM 12444
MTLPATHIRRLLGWGRTLARHGALRGIENDPNTPSPVRTLCRIARLGTIQPRDPDYAGAFRAIGPAAIKLGQTLATRPDLVGEDAAHNLLALQDNLPPVDYRLIRAEIERTFEKPLEALFAQFDPEPIGAASIAQVHRAVTTEGHKVAVKVLRPGVRDKLARDIDTYEWAAAHLEAFGGEAERLRPRLVIANFKRWTVRELDLRREAASASELADVMKAHAGYRVPAIDWDRTNGRVMTLDWIDGIKISDTAALEAAGHDRKALASRLVLAFLTQAISGGFFHADMHQGNLFVQPDGTIAAIDFGIMGRIDRRARQWLAEILYGLTTGNYRRVAEIHFEAQYVPSYHSVDEFATALRAVGEPMRGKPVSELSVGQMLDGLFAITRDFDMQTQPHLLLLQKTMVMVEGIATQLDPTINMWDVSAPFVRNWIRDELGPEAAIAERIREDTQTLLRIPDLIRRIEDRFPAKGGAPEAPPLPRIELMWQRKRRKRGSGLSGQFLAFLAGGALVIGTHALGWWG

SEQ ID NO: 30648 - protein, 137 aa, Triticum aestivum
GSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKARRRRRRERTRTSGAGAFDGP

SEQ ID NO: 30649 - protein, 226 aa, Keteleeria evelyniana
AKQAKAAGARIIVTQAAYVEKLADLQSDDVIVITIDEAPKDGCKHISVLTEADEKRCPSVDIHPDDVVALPYSSGTTGLPKGVMLTHKGLVSSVAQQVDGQNPNLYFHSEDVIMCVLPLFHIYSLNSVLLCALRAGAATLIMQKFNLTSFLELIQKYKVTVAPIVPPIVLDITKSPNFSQYDVSSVRIIMSGAAPLGKELEDALRDRFPRAIFGQGYGMTEAGPVL

SEQ ID NO: 30650 - protein, 64 aa, Aspergillus nidulans FGSC A4
MTKCIYCGYCQESCPVDAIVETANAEYATETREELLYNKEKLLANGDKWEPEIAAAARADAPYR

SEQ ID NO: 30651 - protein, 317 aa, Nothotsuga longibracteata
CLIDGATGKTYCFAEVELISRKVAAGLVNLGLQQGQVVMLLLQNCVEFAFVFMGAALRGAIVTTANPFYKPGEIAKQAKAAGARIIVTQAAYVDKLADLRSDNVIVITIDGAAKDGCQDISVLTEADETQCPSVEIQPDDVVALPYSSGTTGLPKGVMLTHKGLVSSVAQQVDGENPNLYFHSEDVIMCVLPLFHIYSLNSVLLCALRAGAATLIMQKFNMTSFLELIQKYKVTVAPIVPPVVLDITRSPAISQYDVSSVRIIMSGAAPLGKELEDALRDRFPQAIFGQGYGMTEAGPVLSMNLAFAKEPFPVKSGS

SEQ ID NO: 30652 - protein, 295 aa, Burkholderia thailandensis E264
MQSRFEGIWLPIVTPFRAGEIDHPSLARLARHYADEGIAGFVAGATTGEGALLDAGEQEAIFATLRDAAPTHPIVLGISASATHAAAKRARELAALGPNGLLVTPPVYVRPTQAGVRRHFEAIVEAADLPVLVYNIPYRTGVSVELDTLQALSRDARVVGVKECGGTIERMLRLVHETPLRILSGDDNQNFAALCAGAHGAIASAAHVLPAWHVRVQALLREGRLDDARRIAVALRPLVADLFAEPNPAPVKALLAAQGWCDNALRLPFLPVSDALAARLIAHWEALRQSETADV

SEQ ID NO: 30653 - protein, 408 aa, Campylobacter upsaliensis RM3195
MQIPSKLKPYYENIAFERDDAKMIINLGPQHPSAHGNLRLILELDGEQVTKARPCIGYMHRGMEKMAENMIYQEFIPTTDRMDYIAASANNYAYCAAVEKLCGLEIPRRAAVIRMILLELNRIASHLLWLATHALDIGAMSVFLYCFREREYVLDLIERYCGARLTHSSMRIGGVMLDLPDGFLDELLAFCAKFPNDVKDYEALLDDNRIWRLRTENVGLVTKEQAMNWGCSGVMLRGSGVCYDIRKEEPYLLYDEVDFGVPYASQGDSYARYKIYMQEFRESLKILTQCVKLYKNTPPEILANHPEYVSASKEQIMTQNYSLMQHFVLVTQGLKPPKGEVYVPTESPKGELGFFIHSDGTGRPYRLKARTPSFWHCAFFEEMLVGSYLADVVAIMGNVNIVLGEIDR

SEQ ID NO: 30654 - protein, 904 aa, Hordeum vulgare subsp. vulgare
MAVGETGASVSAAEAEAEATQAFMPDARAYWVTSDLIAWNVGELEAQSVCLYASRAAAMSLSPSNGGIQGYDSKVELQPESAGLPETVTQKFPFISSYRAFKVPSSVDVASLVKCQLVVASFGADGKHVDVTGLQLPGVLDDMFAYTGPLGAVFSEDSVSLHLWAPTAQGVSVCFFDGPAGPALETVQLKESNGVWSVTGPREWENRYYLYEVDVYHPTKAQVLKCLAGDPYARSLSANGARTWLVDINNETLKPASWDELADEKPKLDSFSDITIYELHIRDFSAHDGTVDSDSRGGFRAFAYQASAGMEHLRKLSDAGLTHVHLLPSFHFAGVDDIKSNWKFVDECELATFPPGSDMQQAAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKVDGFRFDLMGHIMKRTMVTKSALQSLTTDAHGVDGSKIYLYGEGWDFAEVARNQRGINGSQLNMSGTGIGSFNDRIRDAINGGNPFGNPLQQGFNTGLFLEPNGFYQGNEADTRRSLATYADQIQIGLAGNLRDYVLISHTGEAKKGSEIHTFDGLPVGYTASPIETINYVSAHDNETLFDVISVKTPMILSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTANDIKQRVRFHNTGPSLVPGVIVMGIEDARGESPEMAQLDTNFSYVVTVFNVCPHEVSMDIPALASMGFELHPVQVNSSDTLVRKSAYEAATGRFTVPGRTVSVFVEPRC

SEQ ID NO: 30655 - protein, 361 aa, Burkholderia sp. 383
MTDRTYKIAVIPGDGIGREVMPEGLRALDAVTARFGVRFDFVRIDWASCDYYAQHGKMMPDDWKAQLSGMDAILFGAVGWPATVPDHISLWGSLLKFRREFDQYINLRPARLFDGVPSPLAGRRAGDIDFMIVRENTEGEYSSVGGTMFEGTEREIVMQQSIFTRHGTERVLKFAFDLAQRRAKRLTVATKSNGIAISMPWWDARTAEMAERYPDIAVDKQHIDILCARFVLQPDRFDVVVASNLFGDILSDLGPACTGTIGIAPSANLNPDRKFPSLFEPVHGSAPDIAGQFIANPVAMIWSAALMLDFLGNGAGREREAHDAIVAAIEDVLRTGPHTRDLGGNAGTQEVGEAIAARIAG

SEQ ID NO: 30656 - protein, 501 aa, Glycine max
  misc_feature (202)..(202): Xaa can be any naturally occurring amino acid
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALXALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVKEAAMATYDKPIHI

SEQ ID NO: 30657 - protein, 880 aa, Phaeosphaeria nodorum
MAPTLLAAIDLVSQSNASQGLDQQALSFVGSVFVRVTDETVDQALAHLQQSVGRCSNYLGVATLTSTDDILSLLDAGAAKVFVTRQQLDALKSLNIDQDRIVLCLPGNSRSEVIDAISGTQVDVYSHQVHDIDLVEAWLKEYGPDRPNVFVSFSEPNLENSLKLAKLSAIPIIPAQSLTIDEKKDSSLISVAKLVMANATSDRPDGLYTTLVTDERGVALGLVYSSEESVAESLRTGRGVYQSRKRGLWYKGESSGDIQELVSMSFDCDSDCLQFVVRQKGRGFCHLATPTCFGDYRGLSKLQKTLQSRKESAPQGSYTARLFNDAQLLRAKILEEATELCDATTKEHIAFEAADLFYFALTKCVAAGVSLEDVERNLDAKSIKVKRRQGDAKPAFAAQAAAVNGTSNAATNGASNGVSVETIKEAASVPKSKDDPAGTKDGRIAMKRYVTAQETPETIAAALQRPSQKSPEKIIGICRPIIDAVKTRGDAALLEYTHKFEKATSLTSPVLRAPFPPELMQLAPETAKAIDVSFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLTAIEDELHKQANALPRVDIVRGAIEHSITLAASTIEEALELSNQYAPEHLILQVANADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30658 - protein, 551 aa, Prochlorococcus marinus str. MIT 9313
MSRHFDRGSFRAVSDVHQLMSFPDFSASDAHVQWQRFNNLLWHHNDLGIWLDISRMHINAEDFERLGPRFDQAFKAMQALEQGAIANTDEQRMVGHYWLRQPQLAPDQEVCDHIAKEIDLIETFGSNVINGLIKAPNGKKFTDVLWIGIGGSGLGPLLMIRALQNAEQGLRFHFFDNVDPDGMSRVLGNLGDALSTTLVVTVSKSGATPEPHLGMEQARQRLEAMGGHWAGQAVAVTMLNSQLDQLAQKESWLKRFDMFDWVGGRTSITSAVGLLPAALIGCDIRAFLAGAAQMDEATRVSDLHSNPASLMAAAWFVAGDGLGRRDMVVLPYRDRLEVFSRYLQQLVMESLGKRLDRDGNVVHQGLAVYGNKGSTDQHAYVQQLRDGVDNFFATFIEVLEDVENIPAINNEHPGDFLDGFLQGTRAALSQGGRQSLTISMRRFDPRRLGALVALFERAVGLYGELVNINAYHQPGVESGKKAAAAILNLQSRVEDLLADGVERSAGEIHQVIGDGSEEAIFWIMRHLTANKRGYVAEGDWGIPTSLRFSKG

SEQ ID NO: 30659 - protein, 880 aa, Phaeosphaeria avenaria f. sp. triticae
MAPTLLAAIDLGSQSNVSQGLDQQALSFVGSVFVRVTDETVDQALAHLQQSVGRYSNYLGVAALTSTDDILSLLDAGAAKVFVTRQQLNALKSLNIDQDRIVLCLPGNSRSEVIDAISGTQVDVYSHQVHDIDLVEAWLKEYGPDRPNVFVSFAEPNLENSLKLARLSAIPIIPAQSLTIDEKKEPSLISVAKLVMANATSDRPDGLYTTLVTDERGVALGLVYSSEESVAESLRTGRGVYQSRKRGLWYKGESSGDIQELVSMSFDCDSDCLLFVVRQKGRGFCHLATPTCFGDYRGLSKLQKTLQSRKESAPQGSYTARLFNDEQLLRAKILEEATELCDATTKEHIAFEAADLFYFALTKCVAAGVSLEDVERNLDAKSIKVKRRKGDAKPAFAAQAAATNGTSNTTTNGASNGLSVETLKEAASVPKSEQDPAGTKDGRIAMRRYVTAQETPETIAAALQRPSQKSTEKIIGICRPIIDAVKARGDAALLEYTHKFEKATSLTSPVLRAPFPPELMQLAPETAKAIDVSFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASADPAFVASDLLSQAEHGVDSQVILIAVGLNEAQLAAIEDELHKQANALPRVDIVRGAIEHSLTLAVGTIQEALELSNQYAPEHLILQVEEADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30660 - protein, 376 aa, Solanum dulcamara
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 30661 - protein, 880 aa, Phaeosphaeria avenaria f. sp. triticae
MAPTLLAAIDLGSQSNVSQGLDQQALSFVGSVFVRVTDETVDQALAHLQQSVGRYSNYLGVAALTSTDDILSLLDAGAAKVFVTRQQLNALKSLNIDQDRIVLCLPGNSRSEVIDAISGTQVDVYSHQVHDIDLVEAWLKEYGPDRPNVFVSFAEPNLENSLKLARLSAIPIIPAQSLTIDEKKEPSLISVAKLVMANATSDRPDGLYTTLVTDERGVALGLVYSSEESVAESLRTGRGVYQSRKRGLWYKGESSGDIQELVSMSFDCDSDCLLFVVRQKGRGFCHLATPTCFGDYRGLSKLQKTLQSRKESAPQESYTARLFNDEQLLRAKILEEATELCDATTKEHIAFEAADLFYFALTKCVAAGVSLEDVERNLDAKSIKVKRRKGDAKPAFAAQAAATNGTSNTTTNGASNGVSVETLKEAASVPKSKEDPAGTKDGRIAMRRYVTAQETPETIAAALQRPSQKSTEKIIGICRPIIDAVKARGDAALLEYTHKFEKATSLTSPVLRAPFPPELMQLAPETAKAIDVSFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLAVIEDELHKQANALPRVDIVRGAIEHSLTLAVGTIQEALELSNQYAPEHLILQVEEADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30662 - protein, 225 aa, Solanum dulcamara
LSFQYSDEEGSSHIVEDYFQRTMGEKFSHLGKVYQDYCNAMSTLSLRIMELLGLSLGVSRNHFKEFFQENESIMRLNYYPTCQKPELTLGTGPHCDPTSLTILHQDSVGGLQVFVDNEWHSITPNFNAFVVNIGDTFMALSNGRYKSCLHRAVVNNKIPRKSLAFFLCPKKDKVVTPPIELVDSNNPRIYPDFTWPDLLEFTQKQYRADMNTLQTFSIWLQKTQV

SEQ ID NO: 30663 - protein, 880 aa, Phaeosphaeria nodorum
MAPTLLAAIDLVSQSNASQGLNEQALSFVGSVFVRVTDETVDQALAHLQQSVGRYSIYLGVATLTSTDDILSLLDAGAAKVFVTRQQLDALKLLNIDQDRIVLCLPGNSRSEVIDAISGTQVDVYSHQVHDIDLVEAWLKEYGPDRPNVFVSFAEPNLENSLKLAKLSAIPIITAQSLTIDEKKEPSLVSVAKLVMANATSDRPDGLYTTLVTDERGVALGLVYSSEESVGESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHIAFEAADLFYFVLTKCVAAGVSLEDVERNLDAKSIKVKRRQGDAKPAFAAQAAAANGTSNTATNGASNGVSAETLKEAASVPKSKEDPAGTKDGRITMKRYITAQETPETIAAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLMEIEDELHRQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30664 - protein, 880 aa, Phaeosphaeria avenaria f. sp. triticae
MAPTLLAAIDLVSQSNELQGLDQQALSFVGSVFVRVTDETVDQALAQLQQSVGRYSNYLGVATLTSTDDILSLLDAGAAKVFVTRHQLDALKSLNIDQDRIVLCLPGNSRSEVIDAISGTQVDIYLHEAQDIDLVEAWLKEYGPDRPNAFISFAEPNLENSLKLAKLSAIPIVPAQSLTIDEKKDSSLISVAKLVMANATSDRPDGLYTTLVTDERGVALGLVYSSEESVAESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHVAFEAADLFYFALTKCVAAGVSLEDVERNLDAKSIKVKRRQGDAKPAFAAQAAAANGTSKTATNGASNGLSAETLKEAASVPKSKDDPAGTKDGRIAMKRYVTAQETPETIAAALQRPSQKSTEKIIGICRPIIDAVKTRGDAALLEYTHKFEKATSLTSPVLRAPFPPELMQLAPETAKAIDISFENIRKFHAAQREDKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLTAIEDELHRQANALPRVDIVRGAIEHSLTLAVGTIEEALELSNQYAPEHLILQVKNADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30665 - protein, 477 aa, Mycobacterium smegmatis str. MC2 155
MGSSFIAANGLWTQHQEEAAAKLVAQLDDLNLRQVRISWGDQHGILRGETLEVDAFRSALKEGKDFQTATLIFDSTNNPVVPPFEADGFGDKRLTGLPDAVLVPDPTTFRVLPWADRTGWVLSEMYYRSGERVPFDTRGVLKTQLAKLEAEGFSFTTGAELEFYITRLVDPKLSFVDSGWPPAAPEVTALSHGYQYLTENRGDEIDHILSILRDHIVALGMPLATVEDEWGPGQVEMSFDPLVGVETADNVLLIRSAIKQICRRHGYHATFMSRPAFPNIVSSGWHLHQSLGAAGQANIFPGEDGKLLSDTAMHYMAGLLEHAKASSVLTTPTINGYKRYIANSFAPDRIAWAEENRGAMIRISGARGDNSTHLENRIGEPAANPYLYMASQLIGGRDGIARKLEPGPSADEAYTADVPLLPATLEEAVGHFESSAVMRRELGDMFVDYLTTVKKNEISRFNAYVTDWEQREYFEVF

SEQ ID NO: 30666 - protein, 427 aa, Burkholderia thailandensis E264
MSNNQTLFERAQRTIPGGVNSPVRAFRSVGGTPRFVARAQGAYFWDADGKRYIDYIGSWGPMIVGHVHPDVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADVAKHTTVLEYNNVAALEEAFAAFGDEIAAVIVEPVAGNMNLVRGTPEFLNALRALCTKHGAVLIFDEVMCGFRVALGGAQQHYGIKPDLTCLGKVIGGGMPAAAFGGRGDIMSHLAPLGGVYQAGTLSGNPVAVAAGLATLRLIQAPGFHDALADKTRRLADGLAAEARAAGVPFSADAIGGMFGLYFTEQVPASFADVTKSDIERFNRFFHLMLDAGVYFAPSAYEAGFVSSAHDDATLDATLDAARRAFAALRA

SEQ ID NO: 30667 - protein, 113 aa, Legionella pneumophila str. Paris
MNCLFCKIAQGEIPATVVFEDKNILAFRDIRPQAPTHLLIIPKKHIATINDVNDGDSELLANILIRAKKLAQAEGLSETGYRLVFNVNSGGGQEVYHIHLHLLGGRQMTWPPG

SEQ ID NO: 30668 - protein, 226 aa, Tsuga mertensiana
AKQAKAAGARIIVTQAAYVEKLADLQSDDVIVITIDSAPKDGCKDISVLTEADETQCPSVEIQPDDVVALPYSSGTTGLPKGVMLTHKGLVSSVAQQVDGENPNLYFHSEDVVMCVLPLFHIYSLNSVLLCALRAGAATLIMQKFNMTSFLELIQKYKVTVAPIVPPIVLEITRSPAISRYDVSSVRIIMSGAAPLGKELEDALRDRFPQAIFGQGYGMTEAGPVL

SEQ ID NO: 30669 - protein, 484 aa, Glycine max
IRLEAGIRNCGQDGINEIKFLIKEAHKRGIEVIMDVVFNHTAEGNENGPIISFRGVDNSMYYMLAPKGEFYNYSGCGNTFNCNHPVVRQFIVDCLRYWVTEMHVDGFRFDLASIMTRSSSLWDGANVFGAPIEGDLLTTGTPLSSPPLIDLISNDPILCGVKLIAEAWDAGGLYQVGTFPHWGIWSEWNGKYRDTVRLFIKGTDGFAGAFAECLCGSPNLYQGGGRKPWHSINFVCAHDGFTLADLVTYNNKNNLSNGEDNNDGENHNNSWNCGQEGEFVSTSVKKLRKRQMRNFFLSLMVSQGVPMIYMGDEYGHTKGGNNNTYCHDNYHNYFQWDKKEESSSDFFRFCRLMTKFRQECESLGLADFPTSERLQWHGHFPGKPDWSETSRFVACTMVDSVKGEIYIAFNMSHLPFTVTLPERPGYKWEPLVDTSKPTPYDFLTPDLPGRDIAIQQYAQFLDANMYPMLSYSSIILLRIPDENL

SEQ ID NO: 30670 - protein, 250 aa, Burkholderia thailandensis E264
MYKLVLIRHGESTWNKENRFTGWVDVDLTEQGNSEARQAGLLLKEAGYTFDIAYTSVLKRAIRTLWHVQDQMDLMYVPVVHSWRLNERHYGALSGLNKAETAAKYGDEQVLVWRRSYDTPPPALEPTDERAPYGDPRYAKVPREQLPLTECLKDTVARVLPLWNESIAPAVKAGKQVLIAAHGNSIRALVKYLDGISDADIVGLNIPNGVPLVYELDANLTPIRHYYLGDPEAIAKAQAAVAQQGKASAA

SEQ ID NO: 30671 - protein, 514 aa, Arabidopsis thaliana
MSIKAFALIQLLSVTILYNHVHATSPIKTIVVVVMENRSFDHMLGWMKKLNPEINGVDGSESNPVSVSDPSSRKIKFGSGSHYVDPDPGHSFQAIREQVFGSNDTSMDPPPMNGFVQQAYSEDPSGNMSASVMNGFEPDKVPVYKSLVSEFAVFDRWFASVPSSTQPNRMFVHSGTSAGATSNNPISLAKGYPQRTIFDNLDDEEFSFGIYYQNIPAVLFYQSLRKLKYVFKFHSYGNSFKDHAKQGKLPAYTVIEQRYMDTLLEPASDDHPSHDVYQGQKFIKEVYETLRASPQWNETLLIITYDEHGGYFDHVPTPVRNVPSPDGIVGPDPFLFQFNRLGIRVPTIAVSPWIEKGTVVHGPNGSPFPSSEYEHSSIPATVKKLFNLSSPFLTKRDEWAGTFENILQIRKEPRTDCPETLPEPVKIRMGEANEKALLTEFQQELVQLAAVLKGDNMLTTFPKEISKGMTVIEGKRYMEDAMKRFLEAGRMALSMGANKEELVHMKTSLTGRRP

SEQ ID NO: 30672 - protein, 427 aa, Methylococcus capsulatus str. Bath
MSKIVDILAREILDSRGNPTVQAEVILDSGAEGSAMVPSGASTGAREAIELRDGDASRYGGKGVLKAVENVRGPIKAALTGMDAADQAAIDRRLIELDGSDNKGVLGANAILAVSLATAHAAAADAKKPLYAYLNRSGEFLLPVPMMNIINGGAHADNSIDMQEFMILPVGAPSFREALRYGAEVFHALKKVLSDRGLATGVGDEGGFAPNLPSNEAAIGIILEAIEKAGYRPGEDICLGLDVASSEFYSDGIYTLASEGRRFTSEEFSDHLAAWVDKYPIVSIEDGMAENDWHGWGIHTDRLGRRIQLVGDDLFVTNPAILKQGIEARIANSILIKVNQIGTLTETLEAIHIARKAGYTSVVSHRSGETEGTTIADIAVATCTGQIKTGSLSRSDRIAKYNRLLKIEEELGDKARYGGRGAVKNLA

SEQ ID NO: 30673 - protein, 389 aa, Arabidopsis thaliana
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDIVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTSFINPTLCGEKKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 30674 - protein, 880 aa, Phaeosphaeria avenaria f. sp. triticae
MAPTLLAAIDLVSQSNASQGLNQQALSFVGSVFVRVTDETVDQALAHLQQSVGRYSNYLGVATLTSTDDILSLLDAGAAKVFVTRHQLDALKSLNIDQDRIVLCLPGNSRSEVIDAISGTQVDVYSHQVHDIDLVEAWLKEYGPNRPNVFVSFAEPNLENSLKLSKLSAIPIIPALSLTIDEKKEPSLVSVARLVMANATSDRPDGLYTTLVTDERGVALGLVYSSEESVGESLRTGRGVYQSRKRGLWYKGESSGDIQELVSMSFDCDSDCLQFVVRQKGRGFCHLATPTCFGDYRGLSKLQKTLQSRKDSAPQGSYTARLFNDEQLLRAKILEEATELCDATTKEHIAFEAADLFYFALTKCVAAGVSLEDVERNLDAKSIKVKRRQGDAKPAFAAQAAAANGTSNAATNGPSNGVSAETLKEAASVPKSKDDPAGTKDGRIAMKRYVTAKETPETITAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGMNEGQLTAVENELHQQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30675 - protein, 880 aa, Phaeosphaeria sp. S-93-48
MAPTLLAAIDLVNLSNALQGLNEQALSFVGSVFVRVTDETVNQALAHLQQSVGRYSNYLGVATLTSTDDIVSLLDAGAAKVFVTRHQLDALKLLNIDQDRIVLCLPGNSRSEVIDAISGTQVDVYSHQVHDIDLVEAWLKEYGPDRPNVFVSFAEPNLENSLKLSKLSAIPIIPAQSLTIDEKKEPDLVSVAKLVMANATSDRPDGLYTTLVTDERGVALGLVYSSEESVGESLRTGRGVYQSRKRGLWYKGESSGDIQELVSMSFDCDSDCLQFVVRQRGRGFCHLATPTCFGDYRGLSKLQKTLQSRKDSAPQGSYTARLFNDEQLLRAKILEEATELCDATTKEHIAFEAADLFYFALTKCVAAGVSLEDVERNLDAKSIKVKRRQGDAKPAFAAQAAAANGTSNAATTGASNRVSTETLKEAASVPKSRDDPAGTKDGRIAMKRYVTAQETSETIAAALQRPSQKSTEKIIGICRPIIDAVKTRGDAALLEYTHKFEKATSLTSPVLRAPFPPELMQLAPETAKAIDVSFENIRKFHAAQREDKPLIVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADATANPAFVASDLLSQAEHGVDSQVILIAVGLNEAQLMAIEDELHRQANALPRVDIVRGAIEHSLTLAVGTIQEALELSNQYAPEHLILQVENADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 30676 - protein, 506 aa, Methylococcus capsulatus str. Bath
MSRSPFRHWPLAGLTGILLSCGGCSPGAQQARPASGADEALNRIEHIVVIYAENRSFDNLYGLFPGANGIANASEEAKRQIDHDGTPLPYLPPVWLVGDARPDPAFPARLPNGPFRLDAPPVGMALSQKTRDLVHAFYQNQEQINGGRMNRFAAVSDAGGLVMGYYDGSKLPMWDIAREFTLADNFFMGAFGGSFLNHFWLVCACTPVFPDAPPEWVARLDASGRLLRAPDSPPSALQGPARYTASRVTPDGYAVLNEQPPYQPSGIPPAAGGDRRLADPSKHPLPPQSFKTIGDTLSAKGVTWAWYAGAWNAAVEEGMRDTQPRQVIYGKGENSPNFQAHHQPFNYFARYAPGTPERAEHLKDGADFLSAIEAGTLPQVSFYKPQGRLNEHPGYADVLAGDAHIAGLVRKIQASPLWPTTAIIVTYDENGGFWDHVAPPKGDRWGPGVRIPAIVVSPFARRGYVDHTPYDTTSIIKFITRRFGLEPLPGVRPNAGDLTHAFDLGP

SEQ ID NO: 30677 - protein, 400 aa, Clostridium perfringens ATCC 13124
MNCIIAQSGGPTSVINASVYGLVKANKKLNLYENVYGGLNGIEGILNKKIINLSDLDELQLERFKNSPASGLGSCRYKLKPLSESEDEYLKLLDILNSLNIKAFFYVGGNDSMDTTAKLNAFAKAKNIDIKFFGIPKTIDNDLMHTDHTPGFGSAAKFISTAVLETYLDSKVYTNNGIFIIETMGRDTGWLAASGALATINGNKCADLVYLPERAFSVQSFLTDVARIFKEKKHVYIVASEGLKDENGKFLTETAPNDDSFGHAQLGGVGTYLKNLIIQASITHRVKSLELNTLQRCSMHASSKIDVNEAVMVGQAALEASINSEGGYMVAIRRDSSFPYKSSTFLIEADKIANNIKYFPSEWINEEGNNITEEGLLYLKPLISDFEDRDSLPLYHSFVL

SEQ ID NO: 30678 - protein, 512 aa, Arabidopsis thaliana
  misc_feature (282)..(282): Xaa can be any naturally occurring amino acid
MEISVASVTVSVAVVVVSWWVWRTLQWVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYLPTKGNRRMKAAAREIKFILRGIVNKRLRARDXGEAPSDDLLGILLESNLGQTKGNGMSTEELMEECKLFYFAGQETTTVLLVWTMVLLSQHQDWQARAREEVKQVFGDKEPDAEGLNQLKVMTMILYEVLRLYPPVVQLTRAIHKEMQLGDLTLPGGVQISLPILLIQRDRELWGNDAGEFKPDRFKDGLSKATKNQVSFFPFAWGPRICIGQNFALLEAKMAMTLILRKFSFELSPSYVHAPYTVLTTHPQFGAPLILHKL

SEQ ID NO: 30679 - protein, 211 aa, Burkholderia thailandensis E264
MNRPKSMLVANIAWARETSERSPDFFDALSRGQNPRVLWIGCADSRVPAEAITQSAPGELFVHRNIANIFEPDDDNCASVLEYAVKVLKVDHVIVCGHYGCGGVRASLLPPSPELPHVNRRIAPLCALAGRHRAVLDGVPPDEAADRLAELNVLEQVRLLRNSPIIRDAAPAPLVHGWIFSLADGRLKELASGYAAAVQAPQAERAEAAAA

SEQ ID NO: 30680 - protein, 556 aa, Cicer arietinum
MGCQGSKEKNKPTPDFTARHHGSSATAASASGVATNNHQYHSVQPSSTHVQTPPPKPDSNPKPTVTTQNVKTVHKTDTTILGKPFDDIKKHYTLGQELGRGQFGITYFCTENSTGNTYACKSILKRKLVSKSDREDIKREIQILQHLSGQPNIVEFKGAYEDRFSVHLVMELCAGGELFDRIIAQGHYSERAAASICRAVVNVVHICHFMGVLHRDLKPENFLLSSKDEGATLKATDFGLSVFIEEGKVYRDMVGSAYYVAPEVLRRSYGKEIDIWSAGIILYILLSGVPPFWAETEKGIFNAILEGELDFASEPWPSISDSAKDLVRKMLNHDPKKRITSAQVLEHPWMREGGEASDKPIDSAVLSRMKQFRAMNKLKKLALKIIAENLSEEEIKGLKAMFANMDTDNSGTITYEELKTGLARIGSRLSETEVKQLMELADVDGNGSIDYLEFISATMHRHRLERDEHLYKAFQYFDKDNSGHITREELETAMTQHGMGDEATIKDIISEVDTDHDGRINYEEFCAMMRSGMPPPGTTIINLQSEFDFICSCNSL

SEQ ID NO: 30681 - protein, 1067 aa, Clostridium perfringens ATCC 13124
MPLNKDIKKVLVIGSGPIIIGQAAEFDYSGTQACQALKEEGIEVVLVNSNPATIMTDKEIADKVYLEPLTVEFVEKVIEKERPDSLLAGMGGQTGLNLAVELYEKGILDKYNVKVIGTSIESIKEGEDRELFRDMMNRINQPVIQSEIITDLDAGIAFARKIGYPVIVRPAYTLGGTGGGIANNEEELIETLTSGLQLSTIGQVLLEKSVKGWKEIEYEVMRDSFGNCITVCNMENIDPVGIHTGDSIVVAPSQTLSDKEYQMLRSASIDIINAVGIEGGCNVQFALNPHSFEYAVIEINPRVSRSSALASKATGYPIAKVAAKIALGYGLDEIKNAVTGMTYACFEPSLDYVVVKIPKWPFDKFQGADRALGTKMMATGEIMAIGSNFEAAFLKGIRSLEIGKYSLEHKKFKDLSMYELRERVVSPDDERIFALAEMLRRGYRIDMVSKITGIDIFFLEKFRWLVEEEQKLKQSTIDDLNREWLLKLKRRGFSDKAIADMLKVSPDEIYRLRDIWHIKPAYKMVDTCGGEFEALSPYYYSTYEQYDEVVVSDNKKVVVIGSGPIRIGQGIEFDYASVHCVMALRKQEIETIVINNNPETVSTDFSISDKLYFEPLTEEDVLNIIDKEKPDGVILQFGGQTAIKLAKFLKEKNIPTLGTTSDQIDLAEDREQFDDLLERLNIARPKGKGVWSLEEGLEEARRLGFPILVRPSFVLGGQGMEITHDEEELTYYLTNAFEKDSKNPILIDKYLMGREIEVDAISDGEDVLVPGIMEHLERAGVHSGDSITMYPAQNISDKIKEDVLDYTKKLALSIGIKGMINIQFIEFEGKLYVIEVNPRASRTVPYISKVSGVPIVDIATRIMLGERLKDLGYGTGVYKEPDLVSVKVPVFSTQKLPNVEVSLGPEMRSTGEVLGVGRNVFEALYKGFVGASMYTGDKGKTILATIKKHDKKEFMELAKDLDKLGYNFIATTGTAKELREAGIDAKEVRRIGEESPNIMDLIKNKEIDLVVNTPTKANDSKRDGFHIRRAAIERNIGVMTSLDTLKALVELQKEGAHNRELEVFNLI

SEQ ID NO: 30682 - protein, 316 aa, Tsuga canadensis
LIDGATGKTYCFAEVELISRKVAAGLVNLGLQQGQVVMLLLQNCVEFAFVFMGAAPRGAIVTTANPFYKPGEIAKQAKAAGARIIVTQAAYVEKLADLQSDNVIVITIDGAPKDGCKDISVLTEADETQCPSVEIQPDDVVALPYSSGTTGLPKGVMLTHKGLVSSVAQQVDGENPNLYFHSEDVVMCVLPLFHIYSLNSVLLCALRAGAATLIMQKFNMTSFLELIQKYKVTVAPIVPPIVLEITRSPAISRYDVSSVRIIMSGAAPLGKELEDALRDRFPQAIFGQGYGMTEAGPVLSMNLAFAKEPFPVKSGS

SEQ ID NO: 30683 - protein, 325 aa, Arabidopsis thaliana
MAKAVDKKFCWEIKNFSSLNSERCHSVPVVIGDCKWRLVAFPKGYKADYLSLYLEVADFKSLPSGWRRYVKFRACIVNQLSQELSVQQETQRWFDQNAPGWGFENMLLLTELNAKDGGFLVNGQVMIVAEVEFLEVIGTLDESEEIIKSSDLINKTQEVAQQVKEIIQPNDLINKTQEVAQQVKESIDVNGFQVLPSQVESVRRIFKKHPDIAVGFQVKNQHLRKTFMNFLVNVIETMCQSLQELSNEDLVEVDIALTYLKDAGFKVDWLEKKLDHVKEKKEKEQSGLIILQGIEQQLHELMHKCEKKKSEVLSVGAPLKFDDVV

SEQ ID NO: 30684 - protein, 356 aa, Gibberella zeae PH-1
MAETNPSCLLYGPGDARFEDRPFPQIEDPHDVIVKIAYTGVCGSDVHFWTEGGFARKVSQQQPLVMGHEASGIIYKVGPAVSQLKPGDRVAIEPGFPCKSCNYCKSGRYNLCRKMKFAADPPFTHGTLSRFFKIPEDFTYKVPHSISLEEAVLVEPLGVAVHGVRLADIRPGQNVIVQGAGTVGCLTAATAKAYGAKTVVITDINPEKLSFAKGVVECYTFQPRLYATPEQEAARLKQEAGFDLGADTVLECTGVEISAHTGILALAPGGVFVQIGLGKPIQSLPLHSMCEKEMTMKTCFRYGPGDFEIALELLESCKVSVSSFISSIVPFEKAPEAWVRTMKGEGIKNLIKGVED

SEQ ID NO: 30685 - protein, 318 aa, Tsuga canadensis
PCLIDGATGKTHCFAEVELISRKVAAGLVNLGLQQGQVVMLLLQNCVEFAFVFMGAALRGAIVTTANPFYKPGEIAKQAKAAGARIIVTQAAYVEKLADLQSDDVIVITIDGAPKDGCKDISVLTEADGTQCPSVEIQPDDVVALPYSSGTTGLPKGVMLTHKGLVSSVAQQVDGENPNLYFHSEDVVMCVLPLFHIYSLNSVLLCALRAGAATLIMQKFNMTSFLELIQRYKVTVAPIVPPVVLEITKSPIVSQYDISSVRIIVSGGAPLGKELEDAIRDRLPHAIFGQGYGMTEAGPVLAMNLAFAKEPFPVKSGS

SEQ ID NO: 30686 - protein, 400 aa, Desulfovibrio desulfuricans G20
MTTFDELKQREESLLCRTYGRYPLAVASARGSVLTDFSGREYIDLLSGIAVTNLGHCHPALAEVMHAQAGRLVHLSNLFYQQEQLELAEKLLGTTHLGKAFFCNSGAEANEAAIKLARRYAQRVKERDAGTVITLTGAFHGRTLATVAATGQAKFQDGFAPIPQGFRQVEWGSLDALEAAMDDDVVAVLAEIVQGEGGIRPMTPEYAQGVQDICRRHGVLFMVDEVQSGMCRTGRFWAFQHYGLTPDVVTSAKALANGLPMGAMLATDEAAKGFEPGSHATTFGAGALVSAVAARVVDIMQQEKLAERADRVGGAFMADVRSLAARLPGTIQEVRGLGLMIGIVLTFPGREVWEELLRRGFVLNLTQERVLRLLPALTVPETYLQDFLTALEEILSERTV

SEQ ID NO: 30687 - protein, 250 aa, Glycine max
  misc_feature (191)..(191): Xaa can be any naturally occurring amino acid
  misc_feature (221)..(221): Xaa can be any naturally occurring amino acid
MVKITLGTFDDSFGVASLKAYLAEFHATLIFVFAGVGSAIAYNELTKDAALDPTGLVAVAVAHAFALFVGVSVAANISGGHLNPAVTFGLAIGGNITLITGFLYWIAQLLGSIVACLLLNFITAKSIPSHAPATGVNDFQAVVFEIVITFGLVYTVYATAADPKKGSLGIIAPIAIGFVVGANILAAGPFXGGSMNPARSFGPAVVSGDLAANWIYWVGPXLIGGGLAGLIYGDVFIGSYAPVPASETYP

SEQ ID NO: 30688 - protein, 925 aa, Methylococcus capsulatus str. Bath
MNPSDEIVFKLDGRPVGARPGEAILQAARRHGVEIPHLCYRDGLRPDGNCRACVVEIEGERVLAASCCRTPGEGMEVRSDSPRARSAQRMVVELLLADQPETSRSRDDELRQWAERLGVSGSRFPGREAPPPDRSNPAIAVQLDACIQCTRCVRACRETQVNDVIGYAYRGSHARIVFDQGDPMGLSSCVSCGECVQVCPTGALAPGNGAALLEADRRVDSGCPYCGVGCQLTYHVKDGKIVKVTGRDGPANHGRLCVKGRYGFDYPAHRQRLTQPLIRKPGIAKDPQGELDPADPLAAFRPASWEEALDFAADGLKRIIAEHGKHALAGFGSAKGSNEEAYLFQKLVRTGFGTNNVDHCTRLCHASSVVALLEGVGSGAVSNPVADVQHAEVVVVIGSNPIVNHPVAATFIKNAVKKGTTQLILMDPRRTELARHAAYHLPFRPDSDVALLNALLHVIVTEGLVDEEFVRLRTENYEALKQNVLAYSPEAMAPICGIDARTLREVARLYARSRASMILWGMGVSQHVHGTDNVRCLIALAMVTGQIGRPGTGLHPLRGQNNVQGASDVGLIPMCFPDYLRVDDEAARAKFERLWGVPLDGQPGLTVVEIIDAACAGRIKGMYIEGENPAMSDPNSNHAREGLASLEHLIVQDLFMTETAYFADVILPASAYAEKTGTFTNTDRIVQIGRQAVTPPGEARQDLWIIQEIARRLGLDWNYQGPREVFEEMRSAMPSIAGISWERLEREGHVTYPCASETDPGQPVIFTERFPTPSGRARIVPADIIPADERPDADYPLVLITGRQLEHWHTGSMTRRASVLDAIEPAPTVSVHPLDLEGIGAEAGDVLTVESRRGRIALFARADDGIPRGSVFIPFCYYEAAANRLTNQALDPYAKIAELKYCAVRVRKGGTVGREFGYQLRGRVA

SEQ ID NO: 30689 - protein, 446 aa, Bordetella bronchiseptica RB50
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQRRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMGKGSGFFQHGHTYLGHATACAASLAVQEVIRRDGLLARVRQQGDGLRQRLMQALGAHPHVGDIRGRGLFLGVELVRDRATKATFDPELALHARVKREAMARGLMVYPMGGTIDGRHGDHVLVAPPFIIADDELDQLVERLAGAIDAAIAQTRA

SEQ ID NO: 30690 - protein, 713 aa, Nocardia farcinica IFM 10152
MSVTDDIRALTQPNYPDDWTDLDTKAVDTVRVLAADAVQRAGNGHPGTAMSLAPLAYTLYQRVLRHDPSHPSWVGRDRFVLSCGHSSLTQYIQLYLAGFGLELDDLKNLRKWGSLTPGHPEFRHTDGVEITTGPLGQGLASAVGMAMAARRERGLFDPHAAPGTSPFDHHIYVIASDGDLQEGVTAEASSIAGTQQLGNLIVFYDDNKISIEDDTTIAFTEDVAARYEAYGWHVQTVQGGEDVVAIEAAIEAAKAVLDKPSIIVLRTIIGYPAPNKMNTGSAHGAALGADEVAATKKVLGFDPEQTFQVADEVIAHTRKAVERGRAAHRAWQEQFDAWAAANPEHKALFDRLAERRLPEGWTANLPVHEPDPKGMATRKASGKVLAALAPVLPELWGGSADLAESNNTTMPGQPSFGPESISTGMWKAEPYGRTLHFGVREHAMGAILNGIALHGPTRPYGGTFLVFSDYMRPAVRLAALMRVPAVYVWTHDSIGLGEDGPTHQPIEHLAALRAIPGLNVVRPGDANETTYAWRTILERDSAEHTSHFRVSEPPHQDGPSALALTRQDLPILEGTSYEGVAKGGYVLADSSTETPQVILIATGSELQMAVAARTTLEAQGIGTRVVSMPCVEWFDAQDKAYRDEVLPPAVRARVVVEAGIAMPWHRFVGDAGEIVSIEHFGASADYQTLFREFGFTEEAVVAAAQRTLENVKG

SEQ ID NO: 30691 - protein, 317 aa, Magnaporthe grisea 70-15
MSVILCTAGYDHTIRFWEALSGICSRTIQHPDSQVNRLCISPDKRFLAAAGHHTVKLYDIKSTNPNALLTFEGHTGNVTGVAFHCEGKWMVTSSEDGTVKIWETRTGTIQRSYNHQSPVNDVVIHPNQGEIISCDRAGTIRLWDLADNKCTSEMVPEEDVSVSSLTVATDGSLLCAANNRGNVFVWTLSQGLERTIATAMTQFSAHDQYITRVLLSPDVKKLATCSADHTAKIWEVDVEPTLQAGKAVPFELEATLANHQRWVWDCAFSADSAYLVTACSDHYARLWELQSQAIIRTYNGHHRGAVCVALNDYSEAR

SEQ ID NO: 30692 - protein, 374 aa, Medicago truncatula
MENKNPESEKANSKGTLIHDGKYIQYNVLGNLFEVYSNYIPPLQPVGRGAYGIVCCATNSDTNEGVAIKKIGDAFDNRIDAKRTLREIKLLCHMDHDNVIKIKDIIKPADKEKFNDVYIVYELMDTDLHQIIQSNQALTDEHCQYFLYQLLRGLKYIHSANVLHRDLKPSNLLLNANCDLKICDFGLARTTSETDFMTEYVVTRWYRAPELLLNCSEYTAAIDVWSVGCILMEIIRREPLFPGKDYVQQLALITELLGSPNEEDLGFLRSDNAKKYVKQLPHVDKQPFAERFPDMSPLALDLAEKMLVFDPSKRITVEEALNHPYMSSLHEINEEPVCPSPFVFDFEQATLNEDDIKELIWRESLNFCKEQILE

SEQ ID NO: 30693 - protein, 731 aa, Nocardia farcinica IFM 10152
MSAADTAAAVLDAQFRAGVAQAAPAALPPGISADDLWELFEAQATSRQLDLAARRLGAQGRGFYSIGSAGHEGNAALAAATRPSDPALLHYRSGAFFVHRLRRVGGSDPVRDVLLGVVAAAADPISGGRHKVFGSKAAHIVPQTSTIASQLPRAVGLAFALERAARLGLPTEWPADAIVLCSFGDASANHSTATGAINAALHTAFQGVPMPILFVCEDNGLGISVPTPPGWIAHAYGARPGLHYLHADGCDPADALTTCARAVDWVRTHRGPAFLHLSTVRLLGHAGSDAESAYRRPAELAADLRRDPLLGTAGLLVAAGADPGTVLARYDSIADRVAATAESVCAEPKLDTAEAVLAPLARSRPAAVRADVLRDTPTSPTRAHPGVRAGRDPGADVPVTLAQAVNTTLAALLARDPDVLVFGEDVGRKGGVYGVTKGLRARFGPRRVFDTLLDEQSVLGTALGAALAGFVPIPEIQYLAYLHNAADQVRGEAATLRFFSAGRYRNPMVVRIAGLAYQRGFGGHFHNDNSVAALRDIPGVVLAVPARADDAAALLRTCVSAARVDGRVCVFLEPIALYHTRDLHPDDGAWAVPAAAPEHVPIGRARAYGDGTDLTIVTFGNGVPMSLRVAARLARQGVATRVLDLRWLAPLPVDDLVHHARATGRVLVADETRRSGGVSEAVCTALVDAGFRGRLTRVTSADSFVPLGPAAAAVLLSEAAIESAALALVRD

SEQ ID NO: 30694 - protein, 206 aa, Glycine max
SAFGVPEPVMDSVNTTLSNLQQLRTHFNEFLSLSDPQTLSQMPPLQRAHSLFILAKVTSTLLALNLRCTGVHPDDHPIKSELDRVSLYEDKLERLLDLSKAPLRPSTTLNYQAATRFIEHSLPDLTTEQRENMRNISRGERPKTNRLGQAGQKRKYQSSEKPSVQAAAKEFLQKAARELLGDNSGGIKGPLQVDILDNDDDELPLP

SEQ ID NO: 30695 - protein, 404 aa, Triticum aestivum
  misc_feature (341)..(341): Xaa can be any naturally occurring amino acid
MAISAKERKLSRLGSGKAVNGGGGGSLGARGGHRPPTAGGRRRLFAVFFAFLCAGAVVFGGVHAIGASFRPVLLTAWPSATLNALSSERRVQQAGGNGAGTVSASAQIRHAVALPGHLLVILGDGSLLPAPGQFECLYSTANSTQLCRRPLSVAALPDGPSLVHCPAGPSEMAVSLSLSQSPPVTPFQWDQLVYTALLDSRDHFHVVFAKGMNLRSRPSSVCHHGNELCLWARTWRSRSFVVTSPVVSAAQGDIPVCDTLSAIRRDLRMTADGNINRNSDGKPMLVSIRTKGRGSSSPPSIAQPEPLPRYNRHRHTRHRQQKVHSMCVCTMLRNQAQFLRXEWIMYHSHIGVQRWFIYDNNSDDGIEEVLGSMDPSTYNVTRHLWPWMKSQEAGFAHCALRARE

SEQ ID NO: 30696 - protein, 166 aa, Legionella pneumophila str. Paris
MKKVYHYIIHYVRTYLLLELLAGLWLTVKYFFRKKITVQFPEEQTPLSPRFRGLLALRRYPNGEERCIACKLCEAVCPALAITIESEQREDGSRRTTRYDIDMFKCINCGLCEESCPVDSIVVTPIHHYHISERGQNIMTKEKLLAVGDLMETQLAADRAADEKYR

SEQ ID NO: 30697 - protein, 125 aa, Zea mays
MAGGSSTDELAGERATEMEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLA

SEQ ID NO: 30698 - protein, 228 aa, Pseudolarix amabilis
EIAKQAKAAGARIIVTQAAYVEKLADLQSDDVIVITIDAAPKDGCQHISVLSEADETQCPSVEIQPDDVVALPYSSGTTGLPKGVMLTHKGMLSNVAQQVDGENPNLYFHSDDVIICLLPLFHIYSLNSVLLCALRVGAATLIMQKFNMASFLELIQRYKVTVAPIVPPIVLEIRKSIIISQYDVSSVRFIMSGAAPLGKELEDALIDRFPQAISGQGYGMTEAGPVL

SEQ ID NO: 30699 - protein, 417 aa, Legionella pneumophila str. Paris
MIELKNYTLNFGPQHPAAHGVLRLVLELEGETIVRADPHIGLLHRATEKLAETKPYIQSIGYMDRLDYVSMMCNEHAYVMAIEKLLGIEPPLRAKYIRTMFDEVTRILNHLLWLGATALDIGAMTVFLYCFREREDLFDCYEAVSGARMHATYYRPGGVARDLPDTMPQYKPSRWHNEREIEKKNHNRQGSLLDFLWAFTERFPRCVDEYETLLTDNRIWKQRTVDIGIVSPENALQWGFTGPMLRGSGIAWDLRKKQSYAAYDRVDFDIPVGKTGDCYDRYLVRVEELRQSNRIIRQCIEWLRKHPGPVKVDDYKVTPPRRVVMKHDMEALIHHFKLFTEGFCLPRGEVYSSVEAPKGEFGIYMVSDGANKPYRLKIRAPGFAHLSSFDDMVRGHMLADGVAILASQDIVFGEIDR

SEQ ID NO: 30700 - protein, 553 aa, Burkholderia thailandensis E264
MFGSGLSPGAGGAEASYVGTKRAARAARFVLGRGGRVVAACRRIPAHASAYPHASAAARGPRAFPYPFLAFAPRAPPARRVFLRAACQRDSRFVHSRVIFTLTRRRARLNPDNQENPAMADSYFPRWRAQPRDDAARVVAPDERLPWPQTFAMGVQHVVAMFGSTVLAPLLMGFDPNLCILMSGIGTLLFFVLVGGRVPSYLGSSFAFIGLVIAVTGYAGGGANPNIPVALGGIVACGVVYALIGLVVSAVGTRWIETLMPPVVTGAIVAVIGLNLAPIAVKSVSASTFDSTLALVTVLCVGGVAVFARGMLQRLLILVGVVIAYAIYAALTNGMGLGKPIDFAIVAHAAWFGVPTFHRPVFDPHAMLLIAPVAVILVAENLGHIKAVSAMTGRNLDRYVGRAFIGDGLATIVSGSMGGTGVTTYAENIGVMAVTRIYSTLVFVAAALIAILLGFSPKFGAVIQTIPGPVLGGVSIVVFGLIAVTGARIWVVNRVDFSDNRNLIVAAVTLVLGAGDFSLKLGGFALGGIGTATFGAIILYALLRKEKEPGPMV

SEQ ID NO: 30701 - protein, 321 aa, Legionella pneumophila subsp. pneumophila str. Philadelphia 1
MDLSKRIEPKTWSFVEKIQNAGGKPIYDIPVTEGRAIFDQLQALPTEKPDVDVEDKTLPVGPGGKVDIRIVRPKGAKEALPVIMFFHGAGWVFGDYQTHGRLVREIAVGTHAAVVFVKYTLAPEAQYPTQIEESYAAMKYIAEHGKQFNLDTSRFVAAGDSVGGNMTSVMTLLAKERGGPKIDYQVLIYPVTDANFDNASYKEFAEGPWLTKKAMEWFWDKYLPNKEKRKEITASPLQASLEQLKGLPPALVITGECDVLRDEGEAYAHKLNAAGVTVTAVRHLGTIHDFLMLNDLSETPACRNAVETIIGHLTHIFGKKK

SEQ ID NO: 30702 - protein, 188 aa, Burkholderia thailandensis E264
MMSTSSDAQLDPVEFIHSRIRTVPNWPQPGVMFRDITPLLQSAKAMRVLVDLFVERYVDAKLDYIAGLDARGFIIAPIVAYELSVGFVPIRKVGKLPYKTQRESYALEYGTATVEIHEDACKPGDRVVIVDDLIATGGTMMAGKNLLDRLGAVVVEGAAIVDLPDLGGSALLRGAGLSLYTVTEFAGH

SEQ ID NO: 30703 - protein, 232 aa, Pseudolarix amabilis
YKPGEIAKQAKAAGARIIVTQAAYVEKLADLQNDDVIVITIDAAPKDGCQHISVLTEADETQCPSVEIQPDDVVALPYSSGTTGLPKGVMLTHKGLVSSVAQQVDGENPNLYFHSDDVIICVLPLFHIYSLNSVLLCALRAGAATLIMQKFNMASFLELIQRYKVTVAPIVPPIVLDITKSPIISQYDVSSVRIIMSGAAPLGKELEDALRDRFPQAIFGQGYGMTEAGPVL

SEQ ID NO: 30704 - protein, 139 aa, Desulfovibrio desulfuricans G20
MAERTFAIIKPDATRRNLEGPILSVIQQNGLRVVAMKKMRLTREQAEGFYHVHKERPFFASLTDFMTSGPIVAMVLEGDNAVARWRELMGATNPENAAEGTIRRQFAEGLEANSVHGSDAAETAAFEMGYFFNAMEITG

SEQ ID NO: 30705 - protein, 563 aa, Physcomitrella patens
  misc_feature (265)..(265): Xaa can be any naturally occurring amino acid
MMAVALPGQLNLDETPTWGSRSVDVYEKIEHIGEGTYGQVYMAKDKSTGEVVALKKVRMDNEKEGFPITAIREIKILKKLQHANVIKLKEIVTSKGPEKEDNIKPGDASKFKGSIYMVFEYMDHDLTGLADRPGMRFSIPQIKCYMKQLLTGLHYCHVNQVLHRDIKGSNLLIDNNGILKLADFGLARSFSNDQNGQPLTNRVITLWYRPPELLLGSTKYTPAVDMWSVGCIFAELLNGKPILPGRNESEQFQKICELCGSPDEXNWPRVSQLPYYNQFKPERLMKRRVKDVFKHFDRHALELLERMLTLDPDHRISAKDALDAEYFWVEPFPCQPSSLPKYEASHEYQTKKKRQQQRQQQEEQAKRMKVLHHPAPHTRLPPIQQQPLRPGPHQPGHNLGPPIHANGMANQHNNYNRGQGASNQGRAPGGGRPPHGGPNQNGGYGGPNRGGPGGAYGGPAQPGGFAAPNMGHQGGRGGAYGGPAGGVYPAGPYGGGRGPPVGGRGQQFGGMPGGPQPPAYGGQHYMQQPTAQYVDIDGAYARASHSGFQPPSPHRPDYRQQQR

SEQ ID NO: 30706 - protein, 227 aa, Legionella pneumophila str. Paris
MTKNEYLIEKLQANLANHITELTSAYGEVTIECEVHNLLPVMIELRDREEFSFDQLIDLCGVDYLHYGDYDWETESATEHGFSRGVERQEAKAYAVNKPRFAVVYHLLSTKKNHRLRVKLFVEESHLIVPSVHHLWKSANWFEREAYDLYGILFDGHPDLRRLLTDYGFIGHPFRKDFPLSGEVEMRYDAKLQKVIYAPVDIVPRIVVPKVIRNDNRYIGNEGSKND

SEQ ID NO: 30707 - protein, 335 aa, Ehrlichia chaffeensis str. Arkansas
MKIGINGLGRIGRCLIRAIYENELLYKHKIELSALNGSTSPETHAHLIQYDSVHGKFPHNVTSEEGYIIINDKKIPLSTEKEPKSIPWEKHNVDIVLECTGKFNKKSLAEQHINSTVKKVLVSAPMQDSDATIVYGVNNEMLKKEHNIISAGSCTTNCIAPILKIMNDTIGINNGFMTTIHSYTNDQNLVDNNHKDVRRARACMMSIIPTTTGATKTIDLIIPELKGKLNGTAVRVPTANVSMVDLVFNSIKSTTANEINDIIKNSSQNSKVINITDKKLVSIDFCHSTYSSIVDADETYVTNNNLCRIAAWYDNEWAFAMRMLDIVLLLSENHI

SEQ ID NO: 30708 - protein, 261 aa, Nocardia farcinica IFM 10152
MARKPLIAGNWKMNLNHLEAIALVQKIAFALPEKYFEKVDVAVIPPFVDIRSVQTLVEGDKLLLTYGAQDVSVHESGAYTGEISASMLAKLGCTFVVVGHSERRQYHHEDDATVLGKAKKALEHGLTPIVCIGEGLNVREAGTHVEYNLEQLRGSLKGLSAEQIAKVVIAYEPVWAIGTGKVASAADAQEVCGAIRAELAELAGPEVAAQVRVLYGGSVNAKNVGELVAQPDVDGALVGGASLKGDEFATLSAIAAGGPLP

SEQ ID NO: 30709 - protein, 410 aa, Nocardia farcinica IFM 10152
MAVKTLQDLLNEGVEGRGVLVRSDLNVPLDDNGQITDPGRIIASIPTLKALVEAGAKVVVTAHLGRPKGEPDPKFSLAPVAAKLAELLGRNVQLAGDVVGYDALSRSEGLTDGDVLLLENVRFDPRETSKDEAERGKLAAALVELVGEDGAFVSDGFGVVHRKQASVYDVAKLLPHYAGTLVAAEVDVLAKLTDNTERPYAVVLGGSKVSDKLAVIEALAPKVDTLVIGGGMCFTFLAAQGLSVGSSLLQEEMIDTCKGLLERYADVIHLPRDVVVADSFSADAESKCVPANEIPDGWMGLDIGAESVDRFAALLTEAKTVFWNGPMGVFEFEKFAAGTRGVAEAIVAATGKGAFTVVGGGDSAAAVRALGLPEDGFSHISTGGGASLEYLEGKELPGISVLEDTAPEGS

SEQ ID NO: 30710 - protein, 249 aa, Legionella pneumophila str. Paris
MRQKIVAGNWKMNGQIQQVTELVSQIEELIGFDCAAQVAVMPPSIYIPKVRDCLKTGKVVVGAQNVYPKDYGAYTGELSAPMLKDFDCRYVLVGHSERRQFFHEDENFVAQKFHHVKDHGMIPILCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 30711 - protein, 339 aa, Nocardia farcinica IFM 10152
MTVRVGINGFGRIGRNFFRAVEAQKALGTTDIEIVAVNDLTDNATLATLLKYDSILGRLPKDVSLDGDDTIVVGDQRIKALAIKEGPAALPWGDLGVDVVVESTGIFTDATKAKGHLAAGAKKVIISAPAKGEDITIVMGVNDDKYDGSQNIISNASCTTNCLGPLAKVLNDEFGIVKGLMTTIHAYTQDQNLQDGPHKDLRRARAAAVNIVPTSTGAAKAIGLVLPELNGKLDGYSLRVPIPTGSITDLTADLAKKATVEEINAAFKAAAEGPLKGILKYSVDPIVSSDIVTDPHSSIFDAPLTKVIDDQVKVYSWYDNEWGYSNRLADLIGLVGKSL

SEQ ID NO: 30712 - protein, 209 aa, Arabidopsis thaliana
  misc_feature (79)..(79): Xaa can be any naturally occurring amino acid
  misc_feature (122)..(122): Xaa can be any naturally occurring amino acid
MEAYDICKFWKLDMLEEFSQIVLKGKKKIILDIPSPSQQNKSDIVSLCPADSPETCNSSIPDWLVKVMRKENGYDPKLXIKRRVLCTTDLRKNQGCLSMHLSKLEKSDFLTEDETRFLDEDXLKAKRDGLKVFLVDPESDKHVVYLKKWNGNTVWKYVLSHGWNNVIDKKIFKVNDVIEIWSFRDGSGKLCFALSSPTRCGRSSSGHSS

SEQ ID NO: 30713 - protein, 307 aa, Cedrus atlantica
TGKNYSFAETELISRKVAAGLANLGLQQGRVVMLLLQNCIEFALVFMGASVRGAIVTTANPFYKPGEIAKQAKAADARIIVTQAAYVEKLADLQNDNVIVITVDDAPKEGCRHISVLTEADETKCPSVEIQPDDVVALPYSSGTTGLPKGVMLTHKGLVSSVAQQVDGENPNLYFHSEDVILCVLPLFHIYSLNSVLLCDLRVGAATLIMQKFNLTSFLELIQRYKVTVAPIVPPVVLDITKSPIVSQYDVSSVRIIMSGAAPLGKELEDALRDRFPQATFGQGYGMTEAGPVLAMNLAFAKEPFPV

SEQ ID NO: 30714 - protein, 457 aa, Schizosaccharomyces pombe 972h-
MSLATLQGQSLDFAVKHSLDDLLKNPVRFRPAVVSSPSVPEGTYTVLNNPKQSTVSRKSFSAPTSPTRNKRSGSSSQEYKKSSGTRGDGANDFVDEDPAFIPPARILFPEEKLSMEWDNIMPNAPGLVNLGNTCFMNSVLQLMTQTPPLVQYLLSGQHSLSCRMNACVLCRMEQHVARAYPNKGTKRASAFKPSGIQSMLKVISSHFRPYRQEDAHEFMRYLVDAWQKSCLQNHKNLDHPSRETSVVHRIFGGYLRQQILCSVCKKPSNTYQALLDLSVDAKGSSLADSLKHFVHAEKLTKQNKYRCENCKQLVDASKQMTIYRAPNILTIHFKRFTFNGFQSSKISKQISYPESFNLGPYMSDPNCSCWYELIGVLVHAGGSTRSGHYYSFCKSSNGVWLKFDDDFVSNSSIDRVLNQQAYILQYKRKSTSSSKHKLNTENTVTKTSNKKRRKISF

SEQ ID NO: 30715 - protein, 212 aa, Triticum aestivum
  misc_feature (45)..(45): Xaa can be any naturally occurring amino acid
STAAANWCYATVVAPRARSSSFRPKLIRNTPVQAAPVAPALMDAXPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 30716 - protein, 557 aa, Oryza sativa (japonica cultivar-group)
MDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKISWLSLHNYYSLTDMIMLQNCTKMFKQVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 30717 - protein, 581 aa, Penicillium chrysogenum
MEEKKFEAVQTGAEAPPAYGDSSPTRGGIGQRIFDSFKRDPNHTVTGHVGADGSGFDAETAAHNTAHSPLQRRLKGRHLQMIAIGGSIGTGLFVGSGSVLATGGPASVLIAYILIGCMLYCTVHALGEMAVLFPVAGSFAHYSTRFVDPAWGFAMGWNYALQWLIVLPLEIVAASITVDYWNPGVSNAAWVTIFWVMIVSINLFGVRGYGEAEFVFSLIKVIAVIGFIILGIILNCGGGPQGGYIGARYWYDPGAFRNGFKGLCSVFVNAAFAFAGTELVGLAAAETTNPRKSLPTAVKQVFWRIALFYIVSLTLVGLLVRYDDERLISGSSSADAKASPFVIAIENAGIKALPSIMNVVIMIAVLSVGNSSVYGSSRTLAALAEQGQAPKFLAYIDRKGRPLPAIIIASILGLLSYLAASDVQTTAFEWMMAISGLSSIFTGVPCVRAHILFRRAWKKQGHSLDELAFRSQPGVIGSWVGFIFNCLVLVAQFWVGFAPIGYADMTSQEIAYKFFSVYLAAPVVLICYIGYKIMYKTKFVRTSEVDLVTGRRDLDIQHLIEQEMAEQREWPKWKKVYKFFC

SEQ ID NO: 30718 - protein, 1184 aa, Magnaporthe grisea 70-15
MPNEGRTNQQGDARSKDEQRAFSTDTSKAMSSSRRSPSPLSSFAPPRRPDSRPRPPREQQQPHPPLPRDNLGRGRSIERPLEPFESRSQRPEPSNNSTAQGSAEGPRQGPRQNRRSRHRSRDRPRRPSRHRSPPRPPQEPRRGFAPDSIFDRPARSGHLDQPDTAKEKERDLPHRNTAAREPSRLASSPASTSKRQRSPGPPVADQDHSAKRPRRGPSPQADEPYHFDSRAAPDKTGPGREERPQRPFSPGRPRSRSPGYGRDFDRREKRKKKKKKNKNRRDRSRSPNRDRDEFGGPAPSGRKPLPQPGRESGGRRRSRSPLAPDRPRSFSRGGSPHSQPHGAEHPPFSPSQQVPPRGRGHNPSRDFDIPPERRHYDGRATPPPPEASRSRKKGRGREERHSRKSQAPRVSGANSVEVNMSARGSGYRGGYGPGGGYQMQAPYSQGPPTGPRRFSHSSGHATPSSFHGTPPPQSPYGGSQGWGGQQQYQSPSYAHQYPPNGGYTPNGPHNPGNFTPTGPHGQYHQSPSYAPPSGPNSQYSYPQGPARGGHRGGFRGGNAFNQVGRAGYHGNSFKSTSHNGSVHGGSVHGGSVHGGSVHGGSGHASPAATSNNGDSGIQQAHGHPNEQAKDDENPFRPSKDLQVEDNTQSGHGEDNSQPQQDQPQITVPQTERQPPSGPSNPKIKFQFKSSSKVPATIPKPEISSKFNALPPTQPKAQQQQQRQEAINKERNLPQDVPTGPASTRSRHDRGPRPPHDAPRQPSGQQPLPQPRFRMVKKTMRRPIRKEGLPTEMANSDSVYYRKPGNESVVGAGTYGKVFKAINVYTNNLVALKRIRMEGERDGFPVTAVREVKLLQSLRHINIVKLQEVMVEKNDCFMVFEYMSHDLTGLLNHPSFKLEAPQKKDLARQLFDSLDYLHRRGVLHRDIKAANILVSNDGILKLADFGLARFYAKHHQLDYTNRVITIWYRSPELLLGETRYGPAVDIWSAACVMVEILTQYAIFPGEGGEISQLDKIWAVLGTPSRSEWPGLLEMPWFELLRPAFKRPNNFAKLYQHRVTPAAFDLLEAMFRFDPAKRPSAAEILEHPYFTEEEPAPRQAVELATIEGDWHEFESKQLRRKNEAKEKEARRAARAEKEKEAAGAGGSEKKRSHDQTAVASEQSQPDAKRQNVDGRPPAQEKASDAG

SEQ ID NO: 30719 - protein, 442 aa, Arabidopsis thaliana
MSELKERLLPPRPASAMNLRDASVTRPSASGRPPLLGVDVLGLKKRGQGLRSWIRVDTSGNTQVMEVDKFTMMRRCDLPARDLRLLDPLFVYPSTILGREKAIVVNLEQIRCIITADEVLLLNSLDNYVLRYVVELQQRLKTSSVGEMWQQENSQLSRRRSRSFDNAFENSSPDYLPFEFRALEIALEAACTFLDSQASELEIEAYPLLDELTSKISTLNLERVRRLKSRLVALTRRVQKVRDEIEQLMDDDGDMAEMYLTEKKRRMEGSMYGDQSLLGYRSNDGLSVSAPVSPVSSPPDSRRLDKSLSIARSRHDSARSSEGAENIEELEMLLEAYFVVIDSTLNKLTSLKEYIDDTEDFINIQLDNVRNQLIEFELLLTTATFVVAIFGVVAGIFGMNFEIDFFNQPGAFRWVLIITGVCGFVIFSAFVWFFKYRRLMPL

SEQ ID NO: 30720 - protein, 427 aa, Oryza sativa (indica cultivar-group)
MPATDSSSAAAPLTSFGRSFLSHRRDQIPPPPPDHHVPRPTPNTPLPPTSRSTPSTATPPTSSPTVLSDVQRPTPSAPDLLSLAWTRRLLDSFLIWLEEFRAILFALADSQPLSRPPLDRLLLDFLDRAVKALDLCNALRDGLDLIRQWRKHLAIAAAALAPAPAAQRGEAQIRRARKALTDLTILMLDDKDAGGVVGQRNRSFGRAGTTRDSLPHGHGHHRRSSSGGSSGSGSGSHLRSLSWSVSRTWSAARQLQAIGGGLTVPRANDIAATGGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAG

SEQ ID NO: 30721 - protein, 309 aa, Prunus spinosa
CTCKSWSYLIGSSSFVSTHLHRNVTKHAHACLLCLHHPNVRRQFNPDDPFVKQECQWSLFSSETFEECSKLTHPLRSTEHYGVYGSSNGLICISDEILNFDSPIYIWNPSVRKFRTPPMSPNSNIKFSYVDLQFGFHPGFNDYKAIRMMRTNKTAFTVEVYSLRTDSWKMIEAIPPWLKCTWQHHTGTFFNGVAYHIIEKGPIFSIMSFDSGSEEFQEFIAPDAICAPWGLCIDVYKGQICLLFMCFGCEEEGMDKVDLWVLQGKRWKQLCPFVFPFGYCDLLLGISIDNELIMGTKDFDKGVGNLYLC

SEQ ID NO: 30722 - protein, 428 aa, Rhodococcus sp. RHA1
MSIIEQVGAREILDSRGNPTVEVEVLLDDGSFARAAVPSGASTGEHEAVELRDGGDRYGGKGVEKAVEAVLSEIAPAIIGIDATEQRTVDQALLDADGTPDKSRLGANALLGASLAVARAAAESSGLDLFRYVGGPNAHVLPVPMMNILNGGAHADTGVDVQEFMVAPIGAATFKESLRWGAEVYHALKSVLKEKGLATGLGDEGGFAPDVAGTKEALDLISVAIGKTGLVLGTDVALALDVAATEFYTDGTGYKFEGSNRTAAEMSAFYAELVDAYPIVSIEDPLDEDDWDGWVALTDQIGNKVQLVGDDLFVTNPERLEEGIVKGAANALLVKVNQIGTLTETLDAVDLAHRNGYKTMMSHRSGETEDTTIADLAVAVGSGQIKTGAPARSERVAKYNQLLRIEENLGDAARYAGEVAFPRFAFEG

SEQ ID NO: 30723 - protein, 376 aa, Glycine max
IGVFPSFHSSPCCPTLSIQPTMADVTTYLRHHPDSDPNPNPNPNPNPNPDDDQTLIPFPYWDLDFDFDPEFPSNTLSFTDRENQVNFIMDLFHQSVEQSQLTDPLSNDAVFGAIDGIDLGFPAADDFFVGQRFSVGSDESHTHPHTLAANDDGVLGFCAHSNENDDVASIPLCWDALQLEENNNNNNTYEDFEWEEVMDERDVISMLDDTVSVSLGIEEETEAAAAEEDAESEVSILEWQVLLNSTNLEGPNSEPYFGDSEDFVYTAEYEMMFGQFNDNAFNGKPPASASIVRSLPSVVVTEADVANDNNVVVVCAVCKDEFGVGEGVKVLPCSHRYHGECIVPWLGIRNTCPVCRYEFPTDDADYERRKAQRSVM

SEQ ID NO: 30724 - protein, 514 aa, Broussonetia papyrifera
MDTKSITLLQEALKPLPMAIFLVIPLLFLLGHILRSRGRLPYPPGPKGLPIIGSMSMMDQLTHRGLAALAKQYGGIFHLKMGYLHMVAISSPETARQVLQLQDNIFSNRPANIAIRYLTYDRADMAFAHYGPFWRQMRKLCVMKLFSRKRAASWESVRGEVEKTVLSVAGSTGTAVNVGELVFKTTMDIIYRAAFGASNKEGQDEFISILQEFSKLFGAFNMADFIPWLTWVDPQGLNGRLKRARKALDAFIDKIIDEHVVKKNEAAETDMVDDLLAFYSNEEAKVNDAEDLHNAIRLTRDNIKAIIMDVMFGGTETVASAIEWAMTEMMRCPEDLKKVQQELADVVGLDRRLEESDFEKLTYLRCAIKETLRLHPPIPLLLHETAEDAAVAGYHIPKGSRVMINAWAIGRDKNSWADPDSFKPARFLRDGVPDFKGSNFEFIPFGSGRRSCPGMQLGLYALELTVGHLLHCFTWNLPDGMKPSELDMNDVFGLTAPRATRLVAIPTKRVVCTI

SEQ ID NO: 30725 - protein, 306 aa, Prunus spinosa
CTCKSWSDLIGSSSFVSTHLHRNVTKHAHVYLLCLHHPNVERLDDPDDPYVKQEFQWSLFSNQTFEECSKLIHPLGSTEHYGIYGSSNGLVCISDEILNFDSPIHIWNPSVRKLRTPPMSNNIKFSYIALQFGFHPGVNDYKAVRMMRTNKNALAVEVYSLRTDSWKMIAAIPPWLKCTWQHYKGTFFDGVAYHVIQKGPIFSVMSFDSGSEEFEEFIAPDAISGTFGLCIDIYKEQICLLFRCYGCEEGMNKVDLWVLQKKRWKQLCPFIFPLDEDSVAVGISIDDELLMEITDFDKGVADLYLC

SEQ ID NO: 30726 - protein, 853 aa, Mycobacterium tuberculosis CDC1551
MPTAGSSRAPAAAREIVVVGHGMVGHRLVEAVRARDADGSLRITVLAEEGDAAYDRVGLTSYTESWDRALLALPGNDYAGDQRVRLLLNTRVTQIDRATKSVVTAAGQRHRYDTLVLATGSYAFVPPVPGHDLPACHVYRTFDDLDAIRAGAQRTLDGGHTDGGVVIGGGLLGLEAANALRQFGLQTHVVEMMPRLMAQQIDEAGGALLARMIADLGIAVHVGTGTESIESVKHSDGSVWARVRLSDGEVIDAGVVIFAAGIRPRDELARAAGLAIGDRGGVLTDLSCRTSDPDIYAVGEVAAIDGRCYGLVGPGYTSAEVVADRLLDGSAEFPEADLSTKLKLLGVDVASFGDAMGATENCLEVVINDAVKRTYAKLVLSDDATTLLGGVLVGDASSYGVLRPMVGAELPGDPLALIAPAGSGAGAGALGVGALPDSAQICSCNNVTKGELKCAIADGCGDVPALKSCTAAGTSCGSCVPLLKQLLEAEGVEQSKALCEHFSQSRAELFEIITATEVRTFSGLLDRFGRGKGCDICKPVVASILASTGSDHILDGEQASLQDSNDHFLANIQKNGSYSVVPRVPGGDIKPEHLILIGQIAQDFVLYTKITGGQRIDLFGARVDQLPLIWQRLVDGGMESGHAYGKAVRTVKSCVGSDWCRYGQQDSVQLAIDLELRYRGLRAPHKIKLGVSGCARECAEARGKDVGVIATEKGWNLYVAGNGGMTPKHAQLLASDLDKETLIRYIDRFLIYYIRTADRLQRTAPWVESLGLDHVREVVCEDSLGLAEEFEAAMQRHVANYKCEWKGVLEDPDKLSRFVSFVNAPDAVDSTVTFTERAGRKVPVSIGIPRVRS

SEQ ID NO: 30727 - protein, 306 aa, Prunus spinosa
CTCKSWSDLIGSSSFVSTHLHRNVTKHAHVYLLCLHHPNVERLDDPDDPYVKQEFQWSLFSNQTFEECSKLIHPLGSTEHYGIYGSSNGLVCISDEILNFDSPIHIWNPSVRKLRTPPISNNIKFSYIALQFGFHPGVDDYKAVRMMRTNKNALAVEVYSLRTDSWKMIAAIPPWLKCTWQHYKGTFFDGVAYHVIQKGPIFSVMSFDSGSEEFEEFIAPDAISGTFGLCIDIYKEQICLLFRCYGCEEGMNKVDLWVLQKKRWKQLCPFIFPLDEDSVAVGISIDDELLMEITDFDKGVADLYLC

SEQ ID NO: 30728 - protein, 587 aa, Cryptococcus neoformans var. neoformans
MLSADQRQRAPFAHKSSCANLTATQPSALRSPFPPQSHWPTPPSAEGHQLQLTSDRSKWAQYPSPRKISNETCQAGFSDHPYAFGGIGATYSLDTPTSRRHSLPSLFNPNTHRRAFTFPSMSLPNPATVRFISLCFLWYACSAISNNTGKVILNHFKYPVTLTIVQFFFVAFYCAISSQKMLGWTGRLRQPTKNILKGTLPLAAFQVGGHIFGSMAISRVPVSTVHTIKALSPLFTVMAYALLFGVSYSPATYLSLLPLTLGVMLACSFDISFSNIFGLVCALGSTIVFVSQNIFFKKIMPTTSTNEVNSSSKLDKINLLYFSSSMAFILMIPLWIYSDARRLIDLWINPAASESGTSVLFYFFLNGTVHFAQSIIAFALLASTSPVTYSIASLVKRIAVICLAIIWFKQPVHTVQALGIVLTGAGLWMYNNAKRDVDRGEIKMRHVEALREGVLPSTKMDQCILEGSGIELSYKSAHNSPKPTYPNNYIDLPSSTTTAVNKTTFQVPPILDHTSHIEAPYPSPPASISSSPPADITYLGISKGRQHWLSGEGERFRPPVLNSIRSSVMEEARETGVNEGMAAVVTT

SEQ ID NO: 30729 - protein, 94 aa, Lupinus luteus
ASAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 30730 - protein, 663 aa, Gibberella zeae PH-1
MSAPPPPGNPPANAPARPNGSSRNKKANPLRPMRKKPANPMVTRRPAPRPAAPSGSGAQNGAKPNTEEIRRQNGGWSEPPPATYSDIPIMTTKKALLDGIRYHMMKLIQTKGDKSIDPTDQDDFARPVTLHRRDARQPPPGRAVKVEAPEAPQPDEQEAERMAQVKAEREAQRAIDQAKIAPVAKDANPKRPKKQKEEKTTFNRAPKTVAAKKESDLRYEEALPWHLEDADGKNVWVGNYVSALSESSVAFMIDQSVFRMVPLEKWYRFTSKPPFQPYTIEEVEAFMGKKVDVGRWVMKDEEKRAEQIDREATRRMFYGGGQMVKTESATFKAASRSEKLDHDDIDFSGDEFQDDDETPMFERNNDDEDAKDAKDRIRREQLGANLFGDGDEQEVDKELHEKDKEDELRRELGKTTKKALIKRDQENIYESDDSTENPWSSSSDDNSSDEEEDEEKKEEEKKEAGKDDKAQSGSGSKGTNTPSGKKPESSKKGKSLKRAGSPALSESSGNESSRKKLKKNAASAAASRSGTPLPQGAAARRALGAGSGSDGEATAGEMSDGAMAKRKKLKLVSHSARGTPSASRAGSPNPQGAASPGSPRGSLVEPSEILDKIPDEGIVIGELIKAFQHRLGDRPGLMPKSEWIQLVKALCDYGPDKRLRRRT

SEQ ID NO: 30731 - protein, 286 aa, Synechococcus sp. WH 8102
MQAPRGPLPARQRKLKMGTTSFMVVMHVLATVALLPRFWSWQGLVAFGVLYWVTVLGVTLGLHRLVAHRSLVVPVWVERMLVIMGTLACQSGPIEWVGLHRHHHRFSDQPIDHHDAGRGLWWSHSEWMLHDIPALKELDRYAGDLQVDPFYRWLDRWFLLLQIPLGLGLYWIGEAAQVHGGGIGLVLWAIPLRLVIVYHVTWLVNSATHAFGYRNFDCPDLSRNCWWVALLSFGEGWHNNHHAHPASARHGLRWFEFDLTWQHVRLLKRLGLASRVRTARYVPGAS

SEQ ID NO: 30732 - protein, 363 aa, Geobacter metallireducens GS-15
MKRKIGILTGGGDCPGLNAVIRGVVKSAIIGRGWEVVGIEDGFDGLLYDRTPRPLGLEDVRGILPRGGTILGTSNRGNPFSYPIEVNGKTVLTDVSDRVVERVKDLGIDAIVAVGGDGSLKIALELMKRGVPVVGVPKTIDNDLMETDVTFGYNTALETATDALDKLHSTAESHHRIMIMEVMGRYAGWIALESGISGGADVILIPEIPFELKAVCNAIEGRRRRGSKFSIVVAAEGAFPRGGTRVVQKKADETMAIERLGGIGNFVAHELTSCLDMDIRVTVLGHLQRGGSPSTFDRCLGSRFGIGAVELIEREQYGEMICLKGRAIRSVPIEKAVRKLKLVDPRGQMVTAAKELGINVGRE

SEQ ID NO: 30733 - protein, 406 aa, Xylella fastidiosa Dixon
MNGFAVIPSVTTTTTSGEPIASDVARKQNLLELDREGLERFFEDVLGEKRYRAHQVMKWIHHRYVADFEQMTDVGKALRTRLQACAEVRVPRVVFDKHSADGTHKWLLAMGTDRKNAIETVYIPDKGRGTLCVSSQIGCGLNCTFCSTATQGFNRNLTTAEIIGQVWVAARHLGNVPHQRRRLTNVVMMGMGEPLMNFDNVVRAMSVMRDDLGYGLSNKRVTLSTSGLVPMIDRLSTESDVSLAVSLHAPNDKLREQLVPLNKKYPIVELMASCERYLSVNRKRDSVTFEYTLMKGVNDKQEHAHELAKLMRQFDCAMQVKGAAKVNLIPFNPFPGTCYERSTEVDIRAFQKILLDAQILAMVRRTRGDDIDAACGQLKGQVVDRTRRQAEFRRTIEDRVGRDVAA

SEQ ID NO: 30734 - protein, 141 aa, Streptomyces griseochromogenes
MIEGIHTENAPFVRFPDGTEPPLSQAIRAGELVFTSGQGPLDPVTHEIPDDFAAQVRQVLDNLVAVCVAAGSRKDLIIKCTCYLSDRSDFTIFNRVYQEFFTGCPQLPARTTVVAQLVREGVRVEIDGVAAVAEGPGRASL

SEQ ID NO: 30735 - protein, 462 aa, Escherichia coli
MTANSPLQRIGQEKGIAMGSQELQRKLGFWAVLAIAVGTTVGSGIFVSVGEVAKAAGTAWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 30736 - protein, 423 aa, Burkholderia thailandensis E264
MTQAAFDYVDGTLHAERVCTADLAERFGTPLFVYSRAALTAAYEAYAKACAGRRASIHVAVKANSNLGVLNVFARLGAGFDIVSGGELARVLAAGGRAQNVVFSGVGKSADEMRIALEAGVKCFNVESIPELDRLNAVAASLGKRAPVSLRVNPDVDPKTHPYISTGLKANKFGIAFDDARATYRAAAALPNLEVVGIDCHIGSQITELSPYLDAIDKLLDLVEQIEADGVKIHHVDVGGGLGITYDDETPPDIGAYVRAVLERIDARGHGHREIWFEPGRSLTGNAGILLTRVEFLKQGEEKNFAIVDAAMNDLARPAMYQAFHAIEPVTPRTDVAAAVYDVVGPVCESGDWLGRDRSLAIAPGDLLAIRSAGAYGFTMSSNYNARPRAAEVIVDGASAYLVRPRETVESLFEREAVLPDGK

SEQ ID NO: 30737 - protein, 265 aa, Legionella pneumophila str. Paris
MLRRFAVIGNPIAHSLSPVIHQMFAQQTQIELIYEKILGDDVKFEQQISDFFIQYGNGLNVTLPYKKRAYELAKIRTQRCTLAGAANTLWMEENQLHADNTDGVGLIRDLSRFLELKDKKILILGAGGAARGIIFPLLEAKPLQLIVANRTLEKAKELQRQFPQINVASFAELTEFFDLIINATSASLSDQVIVLPEEVLSHKPFCYDLAYNQKTSTAFVQYTRNGGCEAVDGLGMLVEQAAEAFFIWNKVMPSTQKILEHLRSF

SEQ ID NO: 30738 - protein, 309 aa, Corynebacterium efficiens YS-314
MTDIPGSPGSIVVVGSINADLTTTVHRHPHPGETLLGGGGEISAGGKGANQAVAAAQLGAEVHMVGAVGSDTMADSALVHMRASGADMSAVHTVDGPTGLAVITVADDGENTIIVVPGANASVDADYVDRHARLIEQAGIVLLQGEIPADGFNRAVDLAQGRVVINLAPVVPVGHEQLRQADPLLVNEHEGALVLEMLGAPTTETDPSTLVAVLLGQGFPTVVMTLGADGALVGDAEGLTAIPTPTVEAVDTTGSGDAFAGALVAKLADGHSLVEAARFAARVGAFAATRRGAQASYPTLVDDLPTVTA

SEQ ID NO: 30739 - protein, 357 aa, Prochlorococcus marinus str. MIT 9301
MLTNQNFVKVLFLETHVERISNLQDIKKAELDRATGLFLYEDMTLGRRFEDKCAEMYYRGKMFGFVHLYNGQEAISTGVIGAMKKKHDWFCSTYRDHVHALSAGVPSFEVMSELFGKATGCSKGRGGSMHLFSREHHLLGGYAFIGEGIPVALGAAFSSKYKKEVAGNSDSDAVTAAFFGDGTCNNGQFFECLNMAQLWKLPIIFVVENNKWAIGMAHDRATSNPEIWRKASAFGMHGEEVDGMDVLAVRGAAQRAIERARAGEGPTLLECLTYRYRGHSLADPDELRSEKEKEFWGKRDPIKKLAKEIIDGKFATEEELKVIEKKIDAEISESVKNAIEAPEPPSEELTKYIWAED

SEQ ID NO: 30740 - protein, 309 aa, Prunus spinosa
CTCKSWSDLIGSSIFVSTHLQRNVTKHDRVYLLCLHHSNFERQADPDDPYVKQEFQWSLFSNETFEECSKLSHPLGSPEHYVIYGSSNGLVCISDEILNFDSPIHIWNPSVRKLRTTPISTNINIKFSHVALQFGFHPGVNDYKAVRMMCTNKSALAVEVYSLRADSWKMIEAIPPWLKCTWQHHKGTFLNGVAYHITEKGPIFSIMSFDLGSEEFEEFIAPEAICSPWGLGIDVYKEQICLLLKFYSCEEEGMDKIDLWVLQEKRWKQLCPCIFPLDYYYTTVGISVDDKLLMQRKDYDRGIADLHLC

SEQ ID NO: 30741 - protein, 521 aa, Prochlorococcus marinus str. MIT 9301
MNEIVWPTIDSKHLIVDSKQMLIVEKEMFSDGMPQEALMEKAGIQISRWLLKKKPLLKNGITVFIGPGHNGGDGAVIARELFLKGFYVQVWCPFPIKKTLTNDHLNYLTSIGVTKLVEPPDANGKDLWIDAVFGNNQTRKVDDRLIKLFNQKFHNKYSKVISIDIPTGLCPDKGQPFLDKAVKADYTLAIGLNKIGLTQDSALPFIGELHHIDVGVPISKLSKVDKKIFKVTYKDLKNIDLPSLPKNSNKYKRGRTLLIAGSEKYPGAAYLALKGAISSGAGYVSAVLPEVVAESIWQVAPEIVLKDIMQSNQNGNASLFGALKNIDLSAFDSVAVGPGIGIDNDDWQKSKDYLLDYGGLLILDADALNRISESKLGANFFLERKFKTWITPHSKEFRRLFPNINSSTNLGLALDAAKEFNIGILFKGANSIVADSKKVWQLFGTDSQTARAGLGDLLSGFIAGSSAIDLTFCRNITAEYFAKYVLLHSFAASKCKKGSNASAIGDELSKLMRNKKMRQIS

SEQ ID NO: 30742 - protein, 309 aa, Prunus spinosa
CTCKSWSELVGSSSFVSTHLHRNVPKHAHVYLLCLHHPNFECVVDLDDPYPEEELQWSLFSNETFEQCSKLCHPLGSTKKFVIYGSSNGLVCISDEILNFDSPIHIWNPSVRKLRTTPMSTNINIKFSCIALQFGFHPGVNDYKAVRMMRNNKGALAVEVYSLRKDSWKMIEAIPPWLKCTWQHHKGTFFNGVAYHIIEKGPIFSIMSFDLGSEEFEEFIAPDAICGPWGLCIDVYKEQICLLFKCYGFEEEGMDKIDLWVLQEKRWTQLCPFIFPLDYYYLTIGISIYNKLLMLRRDDVMGIADLHLC

SEQ ID NO: 30743 - protein, 461 aa, Parvularcula bermudensis HTCC2503
MPMPILMPALSPTMEEGTLAKWMVAEGDKISSGDVIAEIETDKATMEVEAVDDGIVGKILVESGTEAVKVNQMIGVLLEEGESADDIDLEALRSSVPTDAGEDNGAAKKDAAQSSKEATSPPKESPSESQEPSADRSAPSPTSTPSGSQSSSADAKAEGERLFASPLARRIAEQEGLSLPLIEGTGPRGRIVKRDVEKALEEGQAQPDGKGAVAGAGGGLDPRLYSPETYTAIKNDGMRKTIAKRLNQSFNQEVPHFPLNIDIDLTQLLAARERINAASPEKGSEGTYKISVNDFIVKASAQALMVVPGANASFTEEAILRHHHADIGVAVAIDGGLITPIVWRAETKGLQAISEEIRDLAGRARDKKLKPEEYQGGTFAVSNLGMFGIKSFASIVNTPHGAILSVGAGEDRPVVRNGEIVVRPIMTVTLTCDHRVVDGATGAEFLAAFKRFCEEPASMLL

SEQ ID NO: 30744 - protein, 310 aa, Prunus spinosa
CTCKSWSDLIGSSSFVRTHLHRNITKHAHAHLLCLHHPNVRRQVNPDDPYVTQEFQWSLFPNETFEECSKLSHPLGNTEYYGIYGSSNGLICISDEILNFDSPIHIWNPSVRKFRTPPMSTNINMKFSHITLQFGFHPQFNDYKAVRMMRTNKNALAVEVYSLRTDSWKMIEPIPPWLNCTWQHHKGTFFNGVAYHIIEKAPIFSIMSFDSGSEEFEEFIAPDAICSSSWGLCIDIYKEQICLLLKFYSCEEEDLEKIDLWVLQEKRWKQLCPFTYPLDSYDRTIGISIDNKLLMLRGDYMRGIADLHLC

SEQ ID NO: 30745 - protein, 454 aa, Oryza sativa (japonica cultivar-group)
MTLPGHGRGTLRGGGGVRPTSTSTKLFGVVLSSGGPPATVRCHRRPSSRTSSTARPVDGDDVIEAPAPRPVAGVKKHIGLHVYYRFACSHLTQARVYREKENHVNLYAVLLRFLRLLLHTILKHPDYRTDNSSVKFFIEKTLLEVIGELEYLKPIVQQKRQQQQRNQQEKTTEDNIGSATEPLNLTGNNAEIVRTFQHTTSSNKPQPLDASGTTSSLQKVEPIIHSDAPILKDLVPAKLNQDDLDGHSSTSQYSPTNSHDSRCSVSGHGISDCSPYRMVYVPEELISRFLNEAVENTTKSLETCGIIAGTLRVDMDVKYFIATDLIIPKQESTSYSREATNEEEILDIFEQLGSPSHLGWIHTHPTQECFMSSVDLHNHYSNQKDLREAFAIVVAPSKREQNIFHLTVPDGMDEIGDCDDRGFHPHDRTTYEECSHVKWDSTISLHNVVDLREC

SEQ ID NO: 30746 - protein, 473 aa, Parvularcula bermudensis HTCC2503
MGENTYDVVVIGGGPGGYVAAIRARQLGLSVALVEKEHLGGVCLNWGCIPTKALLRTAEIYTAMSHAAAYGLKADNIGFDLDAVVKRSRKIAGQLSSGVRYLMKKNDVTVYNGTARFVSAGDGAAVLHITDNEGGGEEIRGTHTIIATGARARTVPQAGLAPDGDKVWTAKEAMVPDQFPDRLLVVGSGAIGIEFASFYNALGAEVTVVERLDRILPVEDEEVSAFARKSFEGRGMRIHTGANVTGLEKSDAAVTVSLQTKDGDTVTETVDRVIVAIGIIGNTEDIGLEDIGVEVANGHIVVDPYLRTSVEGVYAIGDVVGPPWLAHKASHEGIICVEALAGEEEVHALDVSAIPGCTYCQPQIASIGLTEAKAREEGYDIKVGKFPFQGNGKAIALGEPEGFVKTIFDSVTGELLGAHLVGAEVTELIQGFGIAKTLEATEQELFHTVFPHPTLSEMMHESALDAFDRVIHT

SEQ ID NO: 30747 - protein, 414 aa, Legionella pneumophila subsp. pneumophila str. Philadelphia 1
MSVKNAIYAQSGGVTAVINASACGVIQTAKLFPEQIGKVYAAKNGIIGALNEELIDTSLESEEDIAKLMQTPSGAFGSCRYKLKDNGEEYQRLIAVFKAHNIGYFFYNGGGDSQDTAHKVSQLGKTMGYPITCIGIPKTVDNDLPFTDNCPGFGSVAKYIAISTKEAGFDVASMAASSTKVFILEVMGRHAGWIAAASGLAEQNPGEPPHIILLPEVPFEPTRFLKKVKDCVNSYGYCVIVVSEGIRNKEGKFLSEAGLRDAFGHAQLGGVAPVIAQLIKSELGFKYHWAVADYLQRAARHIASQTDLDQAYALGKAAVEYAVKGYNAIMPVVIREQDEPYQWSIGQVPLAEVANQEKAMPPEYIAEDGMGITDACKRYLSPLIQGEAYPNYKNGLPDYVRLKNQLVAKKINQD

SEQ ID NO: 30748 - protein, 223 aa, Prochlorococcus marinus str. MIT 9301
MQAVILTGIVAGFVHVVSGADHLIAMAPAAINNPQKALKNSFSWGLGHSSGVLLLAFLAIFIKDITPLNKFSSIAEFLVGISLLIVGVFAIKNSFQLSIHSHSHKHENGIAHRHFHFHVKEQKNKNKHSHALTGLGLLHGIAGGSHFLAVLPALALPLTSACLYLISSLIGSLISMNLFTCLISFTTFKASQKFIKRLIAVAGGLSFSLGLFWIQRSASVFLN

SEQ ID NO: 30749 - protein, 309 aa, Prunus spinosa
CTCKFWSDLISSSSFVSTQLHRNITKYAHVHLLCLHHPNVRRQVNPDDPYVKQECQWSLFSNVTFEECSKLSHPLRSTEYFGIYGSSNGLICISDEILNFNSPILIWNPSVRKFRTPPTSTNINIKFTYIALQFGFHPRYNDYKAVRMMRTNKGALAVEVYSLRADSWKILEAIPPWLKCTWQHHKGTFFNGVAYHIIQKGLMFSIMSFDSGSEEFKEFIAPDAICNPCALCIDVYKEQICLLLDFYPCEEEDMEKIDLWVLQEKRWKQLCPFTYPLDSYDRTIGISIDNKLLMLRGDYMRGIADLHLC

SEQ ID NO: 30750 - protein, 124 aa, Bacteroides thetaiotaomicron VPI-5482
MKKVICSEKAPGAIGPYSQAIEANGMVFVSGQLPIDAATGKMAEGIEEQARQSLENIKHILEETGLTMGNIVKTTVFLQDMSFFAGMNGVYATYFDGAFPARSAVAVKALPKDALVEIECIAVR

SEQ ID NO: 30751 - protein, 334 aa, Xylella fastidiosa Dixon
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLVAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILDYIEDKVVATDFRGETCTCVFDADAGIALDPTFIKLIAWYDNEWGYSNKCLEIAKVIAAK

SEQ ID NO: 30752 - protein, 190 aa, Triticum aestivum
  misc_feature (180)..(180): Xaa can be any naturally occurring amino acid
LAIASPPSNSRTPPWPPPLMASSATTVAPFQGLKSTAGLPVSRRSCSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRXPPGCEESGKA

SEQ ID NO: 30753 - protein, 501 aa, Burkholderia thailandensis E264
MNLAALSTQHQRQSGFLARRQFGNWIDGAAAEPRSGRYLPVVDPATEMTIAEVAASDARDVDAAVAAARRAFDSGDWPRMRPASREKLLHQLADRIERYADELAALETLETGKLVGLARAIDVLGGAEYVRYMAGWATKLEGSTLDTSIAVPAGTEYFAYTRREAVGVVGAIVPWNFPLAIALWKVATALACGCTVVLKPSEETPLTALRLGELAQEAGLPDGVLNVVTGTGADTGAALVAHPGVDKITFTGSVGVGKAIGHAAVDRMARFTLELGGKSPLIVFDDADPDVAARGAAQGIFFNQGQVCTAGSRVYVHKSLFERVVAGIAAAAESMKIGSGFDPNTQIGPLVSKRHFERVLGHIDAAKEEGATLVTGGTRALDGGYFVKPTVFVDAAPSMRIVREEVFGPVVTVTPFDTVDDAVRLANDSDFGLAASVWSQNLSRVHRVVPRLKAGIVWVNTHNMLDNNLPFGGVKQSGYGRELGRAALEQFTELKSVCIAH

SEQ ID NO: 30754 - protein, 550 aa, Geobacter metallireducens GS-15
MPKNRDAARASLENLYRIFTVPEAPDSTLGAIDQAIAGDVAGFLQTHIVAIERPLEEIEADFSSFSIPEEPTYVSEYTEFVKENLVAHSVHTASPAFVGHMTSALPYFMLPLARLMTALNQNVVKVETSKAFTPMERQVLAMLHHLVYGRNDDFYPQWIHNSQHALGAFCSGGTLANVTALWVARNRLFAPDGEFRGIAQEGLARALKHRGADGIAVLVSERGHYSLGKAADLLGIGRDDLIKIKTDANNRIDLKALREECRRLQDRNTLPLALVGIAGTTETGNVDPLEAMADLAQELGCHFHVDAAWGGPTLFSDRHRHLLRGIERADSVTIDGHKQLYVPMGAGMVVFKDPTALSAIEHHANYILRHGSKDLGSHTLEGSRPGKAMLVHAGFSIIGRKGYELLIDMGIERARTFADMIQRHPDFELISEPELNILTYRYCPPAIQQALTDATAQQRAAINGLLDQVCQLLQKYQREAGKTFVSRTRLHVARHDMELTVLRVVLANPLTTDEILEAVLAEQCEIVRLPEIQALLRQAEELCPGLAKAV

SEQ ID NO: 30755 - protein, 326 aa, Glycine max
MSSEKSPSSASASASSSSSYELSKGINGLDKVILRDPRGSSAEVYLYGAHVTSWKNEQAEELLFLSSKAIFKPPKPIRGGIPICFPQFSNLGPLDSHGFARNRFWTIDDSPPPFLTNTPSKAFVDLILKPSEDDIKIWPHSFEFRLRVALGSGGDLMMTSRIRNTNIDGKPFSFTFANHTYFSVSDISEVRVEGLETLDYLDNLQKRERFTEQGDALTFESEFDRIYLSTPTKIAILDHEKKRTIVLRKDGLPDAVVWNPWDKKAKAMSDFGDDEYKYMLCVEAAAIEKPITLKPGEEWKGRLELSTVPSSYCSGQLDPKKVIQGS

SEQ ID NO: 30756 - protein, 179 aa, Triticum aestivum
  misc_feature (70)..(70): Xaa can be any naturally occurring amino acid
  misc_feature (82)..(82): Xaa can be any naturally occurring amino acid
  misc_feature (89)..(89): Xaa can be any naturally occurring amino acid
  misc_feature (128)..(128): Xaa can be any naturally occurring amino acid
MAPTVMASSATSVAPFQGLKSTAGLPVSRRSNGASLGSVSNGGRIRCMQVWPIEGIKKFETLSYLPPLKXTEALLKQVDYLXIRSKWVXPCLEFSKVGFIFREHNASPGYYDGRYWTMWKLPMFGCNXDQKKLINEVDEVKKEYPDAYVRIIGFDNMRQVQCVSFIAFKPPGCDESGKA

SEQ ID NO: 30757 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKIANLFPSIVTGSVITTIGLTLIPVAIGNMGNNVPEPTGQSLLLAAITVLIILLINIFTKGFIKSISILIGLVVGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKTRLPIYYAAGFLVLLGLLPKFGALAQIIPSPVLGGAMLVMFGFVSIQGMQILARVDFANNEHNFLIAAVSIAAGVGLNNSNLFVSMPTAFQMFFSNGIVVASL

SEQ ID NO: 30758 - protein, 177 aa, Prosthecochloris aestuarii DSM 271
MPIKSRIRTIPDYPKKGIMFRDITTLLKDPVGFRLVIDQITQHYLENGINFDMIIGMEARGFIIGGALSYTLGKGFVPIRKPGKLPGETVNQEYQLEYGTDKVEMHIDALEKGTRVLLVDDLLATGGTALAGAALIEKVGGVVADMAFIVNLPDIGGQKKLEEKGYSLFSLTEFEGD

SEQ ID NO: 30759 - protein, 500 aa, Pseudomonas fluorescens
MNTLPSQVWRTNIGSAPSQLLNYIDGNFVTSASSFANINPVNGKLISDVFEADAKQVNEAVVAAQNALKGPWGKLSVQDRAALIHKIADGIQARFEEFVAAEVADTGRPVHQARTLDIPRAIANFRTFADLAKTSHTDLFEMSTSDGSGALNYTVRKPLGVIGVISPWNLPLLLFTWKVAPALACGNTVVAKPSEESPSSATLLAEVMHDAGVPPGVFNLIHGFGKDSAGEFLTQHPGISALTFTGESKTGSTIMKAVADGVKEVSFELGGKNAAVVFADADLDAAIEGVLRSSFTNSGQVCLCSERVYVHRSIFDEFVSGLKVEAERLVVGYPDQDGVNMGPLISHGHRDKVLSYYRLAVDEGATVVTGGGVPKFNDERDQGAYVQPTIWTGLSDKARCVTEEIFGPVCHISPFDDEDEVINRVNDSNYGLACAIWTTNLSRAHRVSRQIHVGLVWVNTWYLRDLRTPFGGVKLSGLGREGGRFSMDFYSDIANICIKI

SEQ ID NO: 30760 - protein, 114 aa, Oryza sativa
  misc_feature (25)..(25): Xaa can be any naturally occurring amino acid
  misc_feature (85)..(85): Xaa can be any naturally occurring amino acid
KNGAPAVIFLANNLILGFMNDLMYXGENKTLNEKFFPLKKWLFFQPNSMALNMALAQLEVVKPVFKLPNVPVLLKKRVKFVRIVXFIGRKNFLGQNKARVLINKLLCWSEGTNK

SEQ ID NO: 30761 - protein, 1110 aa, Nocardia farcinica IFM 10152
MPRREDLKHILVIGSGPIVIGQACEFDYSGTQACRVLKSEGLRVSLVNSNPATIMTDPEFADATYVEPITPEFVEKVIAKERPDAILATLGGQTALNTAVALHERGVLEKYGVELIGADFDAIQRGEDRQKFKDIVAKVGGESARSRVCFTMDEVRETVAELGFPVVVRPSFTMGGLGSGMAYNDEDLDRIAGGGLAASPTANVLIEESILGWKEYELELMRDGRDNVVVVCSIENVDPMGVHTGDSMTVAPAMTLTDREYQKLRDLGIAILREVGVDTGGCNIQFAVNPRDGRLIVIEMNPRVSRSSALASKATGFPIAKIAAKLAIGYTLDEIVNDITKETPACFEPTLDYVVVKAPRFAFEKFPGADPTLTTTMKSVGEAMSLGRNFTEALGKVLRSLETKAAGFWTQDDGPWAPADGDVAGAIEKILADLRVPTEGRIYQVERALRLGASIEDVAAASGIDPWFVAEVAGLVELRREILDAPVLDEPLLRRAKYHGLSDRQLAALRPELAGESGVRALRHRLGVRPVYKTVDTCAAEFEAKTPYHYSAYELDPAAESEVAPQREREKVIILGSGPNRIGQGIEFDYSCVHAAQTLSAAGYETVMVNCNPETVSTDYDTADRLYFEPLTFEDVLEVYHAECESGTVAGVIVQLGGQTPLGLAQRLTEAGVPVVGTSAAAIDLAEDRGEFGDVLVAAGLPAPKYGTATTVEQAKKIAAGIGYPVLVRPSYVLGGRGMEIVYDEKSLEGYISRATELNPEHPVLVDRFLEDAIEIDVDALCDGDEVYLGGVMEHIEEAGIHSGDSACALPPITLGRSDIEAVRRSTVALAKGIGVRGLLNVQYALKDDVLYVLEANPRASRTVPFVSKATAVPLAKAAARIMLGATIAELRKEGMLPETGDGGHVPLEAPVAVKEAVLPFHRFRRADGSGVDSLLSPEMKSTGEVMGIDADFGTAFAKSQTASYGSLPTEGTVFVSIANRDKRAMVFPVKRLHDLGFRILATEGTAEMLRRNGIPCERVRKHSEPGPADEPTIVEQIRDGEVDMVFNTPYGNSGPRVDGYEIRTAAVGVNIPCITTVQGAAAAVQGIEASITGGIGVRSLQELHSALRG

SEQ ID NO: 30762 - protein, 417 aa, Prochlorococcus marinus str. MIT 9301
MELVDAPHSKCGTFGYVGSSPTAPTLMNTYSRFDISFKKGKGCWLWDKTGKKYLDAVAGIATCSLGHSDRVLRRRLSTQLRKIQHISNLYNIEEQEQLSRTLTNISCAKSVFFCNSGAEANESAIKLIKKYGNTINKGKESIILAAESSFHGRTLAALSATGQPKYQKGFEPLIQGFKFFKFNNFDSVKKLFEECENNNQKISGVLVEPIQGEGGVIPGSKIFFKSLRNICDEYNSLLILDEVQSGVGRTGKMWGYENLGIEPDGFTLAKGLGGGHAIGALLVKEKANIFYPGDHASTFGGNPFACKAALTVLEEINRRNLINNVYLRGEQLSAGFEELSKKFPNIITGKRGLGLIQGLVINKDYVDAKKITLKAFDKGLLVVPAGGNVVRIVPPLVISRREINILLDKLNLIFGEL

SEQ ID NO: 30763 - protein, 478 aa, Sulfolobus solfataricus P2
MKSYQGLADKWIKGSGEEYLDINPADKDHVLAKIRLYTKDDVKEAINKAVAKFDEWSRTPAPKRGSILLKAGELMEQEAQEFALLMTLEEGKTLKDSMFEVTRSYNLLKFYGALAFKISGKTLPSADPNTRIFTVKEPLGVVALITPWNFPLSIPVWKLAPALAAGNTAVIKPATKTPLMVAKLVEVLSKAGLPEGVVNLVVGKGSEVGDTIVSDDNIAAVSFTGSTEVGKRIYKLVGNKNRMTRIQLELGGKNALYVDKSADLTLAAELAVRGGFGLTGQSCTATSRLIINKDVYTQFKQRLLERVKKWRVGPGTEDVDMGPVVDEGQFKKDLEYIEYGKNVGAKLIYGGNIIPGKGYFLEPTIFEGVTSDMRLFKEEIFGPVLSVTEAKDLDEAIRLVNAVDYGHTAGIVASDIKAINEFVSRVEAGVIKVNKPTVGLELQAPFGGFKNSGATTWKEMGEDALEFYLKEKTVYEGW

SEQ ID NO: 30764 - protein, 362 aa, Nostoc sp. PCC 7120
MTQNYRITLLPGDGIGPEIMAVAVDVLKVVGQQFDIQFDFQEALIGGAAIDATGEPLPSATLDTCRHSDAVLLAAIGGYKWDSLPPHQRPEGGLLGLRAGLELFANLRPAQILPQLIDASTLKREVVEGVDIMVVRELTGGIYFGKPRGIFTTETGEKRGVNTMVYTESEIDRIGRIAFETARKRRGKLCSVDKANVLDVSQLWRDRITNLSQEYPDVELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPQAADKIEQAVLQVLEQGDRTGDIISVGMNLLGCRGMGDSLIKALAKS

SEQ ID NO: 30765 - protein, 470 aa, Parvularcula bermudensis HTCC2503
MSQSFDVVVIGGGPGGYNAAIRAAQLGLSVACIEKRPSGRFGGTCLNVGCIPSKAMLHASEAYAHAKSHLKELGVKVSGVELDLPAMLGQKDDAVQGLTDGIAYLFKKNKVTGLKGHGRIEGPGKVILTDEDGKEEPLSASTIVIATGSSVMSLPNVEIDEDVIVSSTGALELKKVPDHMVVVGGGYIGLEMGSVWRRLGAKVTVVEYLDRITPGMDGEVSKQFMRILKKQGMEFKLGTKVTGIEKTKQGATLSLEPAAGGEKETLEADVVLIAIGRKPHTEGLGLDTVGIKTNDRGFIPVDDHYQTGVDGIYAIGDVTPGPMLAHKAEDEAVAVAEIIAGKGGHVNYDVIPGVVYTDPEVAMVGKTEEQLKDEGVAYKVGKFPFTANSRAKTNHETDGFVKVLADAETDKVLGVHMIGTGVGEMIAEACLVMEFGGSSEDIARTCHPHPTRTEALRQAAMGVEGWTMQA

SEQ ID NO: 30766 - protein, 247 aa, Geobacter metallireducens GS-15
MKKLVLLRHGESVWNRENRFTGWTDVGLSEKGIEEAISAGRTLKEEGFVFDVAYTSVLKRAIKTLWLVLEEMDLMWIPEYRHWRLNERHYGALQGLNKAETAERHGMEQVMIWRRSYDIPPPPLTPDDQRFPGSDPRYASLLPEELPLTESLKDTVARFLPYWHETIAPAVKEGKRVLVTAHGNSLRALVKYLDLVSDSEIVNLNIPTGIPLVYELTDNMTPIRSYYLGDPDDVARASRMVADQIKK

SEQ ID NO: 30767 - protein, 510 aa, Sulfolobus tokodaii str. 7
MYEFPLTIQHIFWRVEKLYPESEIVSRSEKIERMSYKEFALRVRKLSSFLKSLKLEKGDKVASIEWNTRRHLELYFATTNMGYILHTINVRFHPNEIEYVINHAGDKFVFTSPEFEISKLKTSLSGIFYLDENFDKAIDMQKPIDSFPQLDEKDEAVICYTSGTTGKPKGIMYTHRSIYIHSLTLLAKDAVGISRNDTVLVVVPMFHINGWDLPFSALMTGAKLVLPGPRPTSKDLAELIEKEKVTIAAAAPTIWIDFLNFIEKENYNISSLKTVVTGGAEPPRIIAEKFNKMGIRLYHAWGMTETEAITTVNQDQEKISSQGIPLPGIEMRLVSLDNEKELPWDGESIGELWVSGAWVAKEYYKEAEKSKETFRVIDNRIWLRTGDIVTIDKYGYIKIVDRAKDLIKSGGEWISSIDLENAIMSYYKVFEAAVVAVKDEKWGERPVALVVPKKEYEGKITESEIKEYLLSLNRFPKWWIPDKVLFINELPKTSTGKLDKKVIRELVRNM

SEQ ID NO: 30768 - protein, 468 aa, Sulfolobus tokodaii str. 7
MSEVIEIKSPSNLKVIGTVKRMSKDEVRGEIEEAYKGFETISRMPLYKRTAILRKVSEILEREQERLARLLAMEAGKPIKDSRVEVMRASRLFRQAAEEAAIVLEGKNYRVDAYEYPPGNENRIVISTREPIGVVTAILPFNFPINSFAHKVAPAIAVGNSVVVKPSISTPLSAIEMKKILVEAGLPDSAVRIVTGYSNEIGDELITHPLVGLITLTGSTQTGLAIASKAVSLGKRIIMELGGSDPIIVLEDANIDRASSIAVRARYEYAGQNCNAGKRIIVREEIYDKFVKAFKEKVKALKVGDPLDESTDIGPVINQESVEKLNKALEDAQSKGGNVEVLNKGPETGYFFPLSLVTNPSLDMLVLKTEIFGPIAPIVSVKSDEEAINIANSTEYGLQSAIFSNDVNRALKIAKELKFGAIIINDSTRLRWDSLPFGGFKKTGIGREGVRDTMLEMTENKLIAITLL

SEQ ID NO: 30769 - protein, 368 aa, Saccharomyces cerevisiae
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 30770 - protein, 354 aa, Triticum aestivum
  misc_feature (326)..(326): Xaa can be any naturally occurring amino acid
AIFWSEVHFLECVTQDGNDHIHTAKLVLIVATIVSAIAIPKFFFVLCRFLLAPLAVWIFLAYKYMKTRIIIDAVEKFLRIQQMIGPARYSYTDIVAVTSHFRDKLGQGGYGTVYKGVLLPGDVHVAVKMLEGNSNCNGEDFISEVSTIGRIHHVNVVRLVGFCSEEMRRALVYEYMPNGSLDKYIFSAEKSFSWDKLNEIARGIARGINYLHQGCEMQILHFDIKPHNILLDNNFIPKVADFGLAKLYPRDKSFVPSNALRGTVGYIAPEMISRSFGSISSKSDVYSFGMLLLEMAGGRRNADSNAANSSQSYYPSWVYDRLTAKXVDEISPVADMHDWRGCLDVHPDESNDPT

SEQ ID NO: 30771 - protein, 368 aa, Burkholderia thailandensis E264
MKTKAAIAWKAGEPLTIEEVDLEGPRAGEVLIEVKATGICHTDYYTLSGADPEGLFPAILGHEGAGVVVDVGPGVGTLKKGDHVIPLYTPECRECKFCLSRKTNLCQKIRATQGRGLMPDATSRFSIGGKPIFHYMGTSTFSNYIVVPEIAVAKVREDAPFDKICYIGCGVTTGVGAVVYSAKVEAGANVVVFGLGGIGLNVIQGARMVGADKIIGVDINPKRVELARKFGMTHFVNPNEVENVVDHIVQLTDGGADYSFECIGNVKVMRQALECTHKGWGQSFIIGVAAAGEEISTRPFQLVTGREWKGSAFGGARGRTDVPKIVDWYMEGKINIDDLITHTLPLEKINDGFDLMKKGESIRSVVLY

SEQ ID NO: 30772 - protein, 483 aa, Coccidioides immitis RS
MGSLYCRRSLSKALQARISSRILPAAPPVAGFNHRSRRRFHSTPVPWGIRSQILKDVGEGITEVQIIQWYVQEGARIEEWKPLCQYQSDKAVDDITSRYEGVIKKLHFQADDTVPTGMALCEIEVDDAKYPETNAPAPPKAESAPEPTTSASAVSQETAQEVLAENSQAQVETAPAAPKSKYATFATPAVRGLLKEHGLDITKITGTGKDGRVMKEDVFKYLAERDSQAAAPAAQPTATTPSVDTPQIETPTRLTPIQSQMFKTMTKSLSVPHFLYADDLSISALASIRQKILSHPTEPQKISFLPFIIKAVSLALQQYPLLNARVDTTTNPDKPSLVMRSSHNIGVAMDTPTGLLVPNIKNVQARSILDIAAEVTRLAAVARAGKLTPADLNGGTITVSNIGTIGGTYVAPVLVPNEVAILGVGRSRTVPVFDEQGNVVKDQKMTFNWSADHRVIDGATMARMAEKVRMYVESPETMMLALR

SEQ ID NO: 30773 - protein, 420 aa, Triticum aestivum
VQKSRLVPARNFRDIVDPRVRGRVGRGRGPHLASPSASLNHAPSPRFRHRRGSRFIVRAESDFYSVLGVSRNASKSEIKSAYRKLARSYHPDVNKEPGAEQKFKDISNAYEVLSDDEKRAIYDKYGEAGLKGSGMGTGDYSNPFDLFESLFEGFGGMGGMGGGRAARNRPMQGDDESYNLVLNFKEAVFGVEKEIEITRLEGCNTCDGSGAKPGTKPTTCKTCGGQGQVVSSTRTPLGIFQQVSTCNTCGGTGEFSTPCKTCGGDGRVRKTKRISLKVPAGVDSGSRLRVRSEGNAGRRGGPPGDLYVFIDVLSDSVLKRDGTNILYTCKVSYIDAILGTTVKVPTVDGVVDLKIPSGTQPGTTLVMSKKGVPLLGKSNARGDQLVRVQVEIPKRLSSDERKLIEELANLNKAEPANSRR

SEQ ID NO: 30774 - protein, 224 aa, Coccidioides immitis RS
MLSTEEPARRPHIMASVGARSLNRRAHHLPPKIPIAYPLDPYATMQHIWILTGPAGSGKTTVARGLAKEFGLPYIEGDDYHSTSNKDKMANNVPLTDADRWDWLIQLREAAISSLESKNSPAGVIVTCSALKHKYRDVIRVAAYDHPSVRIHFIYLRADEQILLQRVKQRKGHYMKSDMVQSQLENLEEPDSEWDAISVDCAASLPEVQRRVNVAVQNKLDEYK

SEQ ID NO: 30775 - protein, 219 aa, Arabidopsis thaliana
MADQIEIQRMNQDLQEPLAEIMPSVLTAMSYLLQRVSETNDNLSQKQKPSSFTGVTKPSISIRSYLERIFEYANCSYSCYIVAYIYLDRFVKKQPFLPINSFNVHRLIITSVLVSAKFMDDLSYNNEYYAKVGGISREEMNMLELDFLFGIGFELNVTVSTFNNYCCFLQREMAMLMKMKSLFLEPSSFKISSKTKLVMYPHEEDSLSTHHNKKQLAAA

SEQ ID NO: 30776 - protein, 263 aa, Rhodococcus sp. RHA1
MIDTERYGPWAVIAGGSEGVGASFAEELGRAAINLVLIARKPGPLEETAAKVRAHGVLVRTLALDLLDPDALDRIRTATDDVEVGLMIFNAGANSYGHEFVSGDLAGFHRVIDLNITSQLHLSQHFGARMKDRGRGGIVLVGSLAGYLGSEDQSIYAASKAFGRIFAESLWLELAPFGVHVVELVLGVTRTPAMVRAGLNFDLPGMNVAEPEDVAREGLAHIADGPVWVAGGNYDAARKRSGFPRDTLVRGAAEGMRKLLGRR

SEQ ID NO: 30777 - protein, 551 aa, Parvularcula bermudensis HTCC2503
MALNLLIPFTLIGLFGMAIALFRMRNQPKGLYVLFFAEMWERFSYYGMRALLVFYLTKHFLFTDDAAYGIYGAYTTLVYIMPVIGGVLADRYLGQRRAVTIGAILLVLGHLGMAIEGEPVQPGGTADGTILNIFYLSLALIVMGVGFLKANISTIVGELYAKTDPRRDGAFTLFYVGINLGAFLGAIWAGYLGEVHGWKYGFGLAGVGMLLGLIVFVLGKPLLKGAGEARDETLLNAKRFMGLSTKWMIYLGTLIVTLLVWLVVRDQAVVGVILALTGAIVVGYVLYRAVFTLEPHARDRIFAALILISTQVLFWALFEQAGSSLNIYADEQVDRTLFGAEIPASVFQSLNAFYIIFLGPIFAATWVFLANRNLEPTAPQKFGLGVIQLGLGFLVLVWGAGGADALTPVLFLFLIYLLHTTGELCLSPVGLSAMTRLSVPSMVGLIMGTWFLASGAGNFVAALIAQATGSGRIEGADALDPVAQKALVIDVYQTVGWVAVAVGGGLLVVAPLINRLMHLSTLTDDELPGLHAHQAEIPVDETPQGGTTRPV

SEQ ID NO: 30778 - protein, 178 aa, Novosphingobium aromaticivorans DSM 12444
MTTDDLKRLVRTVPDFPSPGILFRDITTLIAHGEGLSACIDHLAHKARAAGAQAVAGMEARGFIFGAAVAARMGLGFIPVRKPGKLPVKTIGIDYALEYGRDRLEIDPTAIREGQRVVIVDDLIATGGTALAAAELLRMAGAHVTHALFVIDLPELHGAERLRGAGLTVEALMDFPGH

SEQ ID NO: 30779 - protein, 363 aa, Burkholderia thailandensis E264
MTNRNDDTQQMTAIVCHAPEDYRVERVAKPRANARELVIRIGACGICASDCKCHSGAKMFWGGPSPWVKAPVIPGHEFFGHVEELGEGAAEHFGVALGDRVIAEQIVPCGNCRYCKSGQYWMCEVHNIFGFQREVADGGMAEYMRIPSTAIVHRIPLGISLEDAAIIEPLACAIHTVNRGDIQLDDVVVIAGAGPLGLMMTQVAKLKTPKRLVVIDPVGERLALAREYGADVTIDPTREDALAIVHELTGGYGCDVYIETTGVPAGVTQGMSLIRKLGRFVEFSVFGKDTALDWSIIGDRKELDVRGAHLGPYCYPVAIDLLARGLVTSKGIVTHGFSLEEWDEAIRVANSLGSIKVLMKPRG

SEQ ID NO: 30780 - protein, 406 aa, Streptococcus pneumoniae
  misc_feature (115)..(115): Xaa can be any naturally occurring amino acid
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGXFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30781 - protein, 327 aa, Iris x hollandica
MEGKEEDVKLGANKFSERQPIGTAAQVADESKDYKEPPPAPLFEPGELKSWSFYRAGIAEFIATFLFLYITILTVMGVSKSKSKCATVGIQGIAWSFGGMIFALVYCTAGISGGHINPAVTFGLFLARKLSLTRAVFYMVMQCLGAICGAGVVKGYGKMLYQTQGGGANVVAPGYTKGDGLGAEIVGTFVLVYTVFSATDAKRNARDSHVPILAPLPIGFAVFLVHLATIPITGTGINPARSLGAAIIYNNDHAWDDHWIFWVGPFIGAALAAMYHQIVIRAIPFKSRSLKLFVFDHHFCCNVPVFSLNICYANYYVLFQLCCLLSL

SEQ ID NO: 30782 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLSAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIFVASL

SEQ ID NO: 30783 - protein, 333 aa, Saccharomyces cerevisiae
MSEPSEKKQKVATSSLEQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSFINDEPHFRYVLNEDQMATEKLSDGIRKFSADIEALYKLVEEKM

SEQ ID NO: 30784 - protein, 303 aa, Sulfolobus tokodaii str. 7
MIDPKIKKLLESTIQLPIGKASVEEIRSLFKQFSSLTPREEVGKIEDITIPGSETNIKARVYYPKTQGPYGVLVYYHGGGFVLGDIESYDPLCRAITNSCQCVTISVDYRLAPENKFPAAVVDSFDALKWVYNNSEKFNGKYGIAVGGDSAGGNLAAVTAILSKKENIKLKYQVLIYPAVSFDLITKSLYDNGEGFFLTREHIDWFGQQYLRSFADLLDFRFSPILADLNDLPPALIITAEHDPLRDQGEAYANKLLQSGVQVTSVRFNNVIHGFVSFFPFIEQGRDAIGLIGYVLRKVFYGK

SEQ ID NO: 30785 - protein, 361 aa, Saccharomyces cerevisiae
MFSGFSSFGGGNGFVNMPQTFEEFFRCYPIAMMNDRIRKDDANFGGKIFLPPSALSKLSMLNIRYPMLFKLTANETGRVTHGGVLEFIAEEGRVYLPQWMMETLGIQPGSLLQISSTDVPLGQFVKLEPQSVDFLDISDPKAVLENVLRNFSTLTVDDVIEISYNGKTFKIKILEVKPESSSKSICVIETDLVTDFAPPVGYVEPDYKALKAQQDKEKKNSFGKGQVLDPSVLGQGSMSTRIDYAGIANSSRNKLSKFVGQGQNISGKAPKAEPKQDIKDMKITFDGEPAKLDLPEGQLFFGFPMVLPKEDEESAAGSKSSEQNFQGQGISLRKSNKRKTKSDHDSSKSKAPKSPEVIEID

SEQ ID NO: 30786 - protein, 536 aa, Sulfolobus tokodaii str. 7
MSEYYEYELTIDKILDTGVKSFPDREIVYRDVRRYTFSSFADSVRRLMSGLKKLGVKEGETVGVIDWDTDVYLHSYYAIPMLGSVLHTVNIRYPPEIILKTILQAEDKYLIVRDEFLPLLEKAKNLLPVGMKIITYSDSKEKVRSNISDADFWELIDSSEPSEIPQVSENSRATIFFTSGTTGDPKGVWFTHRKLVLHALSVSLVGARPPLNVTTNDVYLILVPMFHVHSWGYPYVFMLSGIKYVLPGKYDYGLILKLMDKERVTFSAMVPTILYFIITHPEAQNYLHVFKRWKVIIGGSALPEGLARKAKELGITIICGYGLSETCPVLTVSYYNSLVENLDENKKFLEQITAGTPIPLVQLRIVDPVSGEEKKVNEIGEIVVRSPWLTKEYYKDPEKTKALWRGGWLHTGDLGYIDEYGYVHIVDREKDAIKSGGEFIPSLLLENVISLYPKVSQVAVVGRKDEKWGERPIAFIVPKEPITEEELRNFLLEMSNQGKIQKWWIPDKFIFIQSMPLTSTNKIDKKILRDLANKSM

SEQ ID NO: 30787 - protein, 408 aa, Pyrococcus furiosus DSM 3638
MEIEEIIEKVARGEIKFHQVENYVNGDKRLATEIRRRALEKKLGIQLKHIGHYSIDPNEVIGRNIENMIGVVQIPMGIAGPLKINGEYAKGEFYIPLATTEGALVASVNRGCSALTEAGGVYTTLIDDKMTRAPLLKCPNARRAREVAEWVKNNLDYLQEKAVSKVTRHGKLRGVKPFIVGRNLYLRFEFETGDAMGMNMVTIASEEIMKVIEEEFPDVKYLALSGNLCVDKKPNALNFILGRGKTIIAEAVVPREIVKKKLKTTPELIAEVNYLKNLVGSAQAGSYGFNAHFANIVGAIFLATGQDEAQITEGAHGITLAEVTEDGDLYISITMPSLEIGTVGGGTRVPPQREALEIMGVAGGGDPPGMNAKKFAEIVAGAVLAGELSLLAAIAAKHLARAHKMLGR

SEQ ID NO: 30788 - protein, 205 aa, Glycine max
RDLNFVGYSYTIPHKQNGLRCCDEVDPIAKAIGAISCMIKRPNDGRLIGYNFDYLGAIAAIEERLHLQDSNGRSISGCSPLYGKLFVVMGAGGAGKALAYGGKEKGARVVVANRTYAKAKELATKVGGEAITLSELESFHPEQGMILANTTSVGMKPKIDLTPIPKEALKHYSLVFDAIYTPKLTRLLREAQETGAAIVYGTEMF

SEQ ID NO: 30789 - protein, 294 aa, Oryza sativa (indica cultivar-group)
MEAAGAAHIWWWCDLERAKFRKGRESTTETSVNADMVYILVMTTMAISTCWSSYWVDSLSDLWPNLLVRWKIHVDIRIQRPLPSTLAQSQPDFDYLFKLLLIGDSGVGKSSLLLRFTSDAFEDLSPTIGVDFKVKMVNTGGKKLKLAIWDTAGQERFRTLTSSYYRGAQVQIDFSVYDVTRRETFTNLSDIWAKEIDLYSTNQDCIKMLVGNKVDKESERAVTKKEGIEFAREYGCLFLECSAKTKVNVEQCFEELVLKILDTPSLLADASSGAKKNIFKQKPPEADAAASSCC

SEQ ID NO: 30790 - protein, 230 aa, Coccidioides immitis RS
MGRADQEEERETLKSIFPDEITDISEHTYRISIVLDVSHHGEDYSDPPVLILQVTYPEDYPDVAPHLEISAPPNAPKYPHLDIQEDRDRLLESLQTTIEENLGMQMIFTLVDMLKEGAELLISERREAIQALKEFEAAKAEEEENRKFQGEAVTRESFLAWRENFQKEIEEEEKRKQEEREAEEKKKKGATKEPKKLTGKQLWERGLAGKADYDEEDPLPAKLASVDLKA

SEQ ID NO: 30791 - protein, 520 aa, Ostreococcus tauri
  misc_feature (42)..(48): Xaa can be any naturally occurring amino acid
MPTVNLNRDGLFTKLGKTFTESEFDELCFEFGIELDEVTTEXXXXXXXVLRGVTFTKERYESFIDLQDKLHQNICRRRSLVAIGTHDLGKIKGPFTYEAQIPEEIEFTPLKQDRSFNARELMEFYKGDQKLKHFLHIIEDSVVFPVVRDSEGTVLSLPPIINGAKSAITLDTTDVFIECTATDLNKAKIVLNTMVTMFSEYCAEPFCVEPVEVVDCTGKETTYPDFMTRFVDADVDYINKRIGTSIDRKTMAALLCKMQLQTKLGADEKTLRVEVPPTRSDILHPCDIAEDVAIAHGYNNIARTVPKAYTIASAQPINKFSDAVRDEVARSGFSELLTWILCSHDDNFANVLREDNGNSAAIVANPSSLDVQVARSSLLPGALKALGANKDAPLPAKLFEVGDVVVLDPTADVGARNSRRLLVLYSNVHSGFEVVQGVLDRVMQVVGIAKFDGSDFGYQLEASSEPTYFPGRQAYIMREGKRIGVFGIVHPDVCAKFDIVSPTSILELDLEPLMPTLKKA

SEQ ID NO: 30792 - protein, 677 aa, Prochlorococcus marinus str. MIT 9301
MIHLNKGKPFPLGSSLTSQGVNFSLIATNAEYVEILLFEREDSIFPKSIFKLDQTHNKGPYWHAEIKNLNEGCIYAFRVKQKNNGINNNYEKKVLLDPCSRGITGWGSYKRENSLKTHENTNSCLKSVVCDRKLFNFKDYPRPKHSWEETIIYELHIKAFTESTDRDESCFKKFLKKIPYLKELGITTIELLPIFCFDPTDAPNGLKNFWGYSPINWFTPHFEYLSNESAEENREEFRRFVEECHKADIEVILDVVYNHTSEGDSKGPAISWKGIDENLYYFIGKDKNYQDVSGCGNTIAANRGLVRKLIIESLKCWASELGVDGFRFDLGIALSRGENLSPLDNPPIFEDIECEPELIDIKFISEPWDCGGLYKLGDFPSKNTFTWNGHFRDDLRRFWKGDKDTAWNMSDKIKGSPSIYKEDNIFPKSINFITSHDGFTLKDLVTFNRKHNFANREQNRDGDNHNNSWNHGEEGPTTNLLINDLRKRQQKNLILSLLISRGVPMILMGDEIGRSQGGNNNSWCQNNLLGWMNWEHGHQDLELLEYFKYVIKIRKELINIFNPPFFPKNKTNENIPTYHWHGTKLDNPDWSSWSHTVAFSINKGITNPLVWIGLNAYSKSINFPLPKCKYNWLKVIDTSMSKIFEPLTIDEKFVSIKSRSSLLIISEEVFGAKNNLF

SEQ ID NO: 30793 - protein, 307 aa, Parvularcula bermudensis HTCC2503
MGRTVFAVRLKAREYPTFEEAVGTAIEHAGVRPEWAAIAVAGPVENDRAQFTNVDWSVSADSLRSHFAFSEVHLLNDFEALGHYAATPDPSGLFVLRRGHPSSGAPRLVMGPGSGLGQSIAIPRAGPFAPSVIAAEGGHTFLPIATDDEDRLRGRLHAALGHAPTTENVLSGSGLMRLTSAMLGENAAAYPSAAALTGAALNGDEAARRVTTQFFNFLGSAVRNALYATGARGGVFLAGGIVPRLIPLIAESQFLSRVTENDPCGAYLANIPITVIVAEGAALDGAWRALAAHRSLSGANGAALGFA

SEQ ID NO: 30794 - protein, 299 aa, Yersinia pestis KIM
MFTGSPMFTGSIVALITPMDDNGDVDRASLKSLIDYHVASGTAAIVSVGTTGESATLNHDEHVDVVMQTLELADGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 30795 - protein, 642 aa, Saccharomyces cerevisiae
MSSQFFLKTSQDIELFQSYPTFEQSNTNSKDFPVISSVLSPCGRFLALSTKENVKVFTGPCLDNVLLTMKLSDVYDLHFSPAGNYLSTWERASIQDPNHKNVKVWYLNKPFKKDCVSEDIVPAYEYQAKSQSGWFLQFSKLDNYGLRLFKHDLKIVKLSSANADNFDFQSPFAVLSDDETSQHFTTYLISPAEHPTICTFTPEKGGKPAQLIIWALSEGKITKKIASKTFFKADSCQLKWNPLGNAILCLAITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTPAPSAPASTNAPTNNKETSPEEKKIRSLLKKLRAIETLKERQAVGDKLEDTQVLKIQTEEKVLKDLEKLGWKDE

SEQ ID NO: 30796 - protein, 624 aa, Triticum aestivum
MRKPHKLLPNYLLLYRRTRPYTSTAANPVAAASAVLRDLDLLDAGELAPTPRVYRSFITACAQSKNLEDARKIHAHLGSSRFAGDAFLDNSLIHMYCKCRSVLDARNVFDQMRRKDMVSWTSLIAGYAQNDMPVEAIGLLPGMLKGRFKPNGFTFASLLKAAGAYADSGTGRQIHALAVKCGWHEDVYVGSALLDMYARCGKMDMATAVFDKLDSKNGVSWNALISGFARKGDGESALMTFAEMLRNGFEATHFTYSSVFSSIARLGALEQGKWVHAHVIKSRQKLTAFVGNTLLDMYAKSGSMIDARKVFDRVDNKDLVTWNSMLTAFAQYGLGKEAVSHFEEMRKSGVYLNQITFLCILTACSHGGLVKEGKRYFEMMKEYDLEPEIDHYVTVVALLGRAGLLNYALVFIFKMPMEPTAAVWGALLAACRMHKNAKVGQFAADHVFELDPDDSGPPVLLYNIYASTGQWDAAARVRMMMKTTGVKKEPACSWVEMENSVHMFVANDDTHPQAEEIYKMWGEISKKIRKEGYVPDMDYVLLHVDDQEKEANLQYHSEKLALAFALIEMPAGATIRIMKNIRICGDCHSAFKYISKVFGREIVVRDTNRFHHFSSGSCSCGDYW

SEQ ID NO: 30797 - protein, 338 aa, Brassica napus
MAVSSSSFLSTPSLSNSKSTISFASSVSPAPIPSLRRVVFRSQRRVMTVRSKIREIFMPALSSTMTEGKIVSWLKTEGEKLAKGQSVVVVESDKADMDVETFYDGYLAAIVVGEGETAPVGAAIGLLAETEAEIEEAKNKAASKSSAAVAPSPPPPATSSPAPAIAQPAPVAAGSDGPRKTVATPYAKKLAKQHKVDIGSVAGTGPFGRITASDVEAAAGIAPSVAPPPPPPAASPTATTAKATTTSSPPLLPDSSVVPFTAMQSAVSKNMIESLSVPTFRVGYPVNTDALDALYEKVKPKGVTMTALLAKAAGMALAQHPVVNASCKDGKSFSLHSN

SEQ ID NO: 30798 - protein, 973 aa, Sulfolobus tokodaii str. 7
MIVKLNGNEISLKESNITILDLLRENNIYISHICYNEGLVPIQSCDTCLVEVNGKLVRACSTKVTDGMSIVTHSERAVNARKKAVERILKYHKLYCTVCENNNGDCPLHEAVIKLGINSQQYIEKPYPIDDSGPFYVYNPSQCILCGRCVEACQDFAVNEVIWINWDLNPPRVVWDNGNPIGNSSCVNCGTCVTVCPVNALMEKSMLGEAGYFTWLNPEVKKKIIDSIGKVEDNFNLLMQISEIEAKARSSQIKKTKTVCIYCGVGCSFEVWTKGRKILKVEPKPESPANGILTCVKGKFGWDFVNSPERLTKPLIREGDHFREASWEEAINYIARRLKEIREKYGPDSIGFIASDKMTNEEAYLLQKLARAVIGTNNVDNSARYCQAPATIGLWRTVGIGGDSGTFKDIENADLIVIVGHNTTESHPVAGSKIKRAKKIRGAKLVVIDVRKHEIADWADLFIKPKPGTDAAVLAAVAKYIIDQGWEDKEFISKRVKGFEEFKESIKGFTLDYVESVTGVPRDQIIKLAEMIHSAKSVAILWGMGVTQHLGGGDTSTIISDLLLITGNYGKPGSGAFPMRGHNNVQGVSDFGCLPNYFPGYQKFDDVTFEKFEEAWRVKLNRKPGLQIPQMIEGVLEGKIHALYIVGEDTVMVDCGTPLTKKALEEVDFLVVQDMFLTETAKLADVVLPAAASLEKEGTFVNTERRIQRIYKAFDPLGESKPDWEIIQMIANALGANWNYSSPAEIMEEIRRLCPIFAGVTYDRLEGFKSLVWPVNEDGTDTPLLYVNAFATPDGKAMLYPLEWKPPQLQDDVHKITVNTGRVLEHFHVGNMTRRVEGLRRKVPETFIEISKELAQKYSIKTGDLILVKSKFGGEIKGRALVSERVQGDEIFIPLYASDPSKGVNNLTGNVIDKVTGTPAYKDTPVVIEKISEGNETPLPKDNWRFHINERKRQFGIEVEKKWKREEFKPLTD

SEQ ID NO: 30799 - protein, 480 aa, Xylella fastidiosa Dixon
MSFLPSFLKRKSIDLITVHEEGRRLVPTLSWPHLIAFGIGAIVGTGIYTLIGVGAEKAGPAVLLSFVIAGVICACAALAYAEMATLMPVAGSTYTYSYVALGEGIAWIVGWSLILEYSLVVSTVAVGWSGYMTGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNERTGTPIATTLFTAILVATAAGLVPLGEIAALANAGTLTAFIAVALCLLVMRVREPQRVRAFRTPLAWVVGPIAIAGCLYLFWSLPKMTQSLFLLWNALGLCVYLVYGRHTSLLSKGVSIDTPR

SEQ ID NO: 30800 - protein, 799 aa, Xylella fastidiosa 9a5c
MALNGASYLNENILWLHELRLTDLARVGGKNSSLGEMIGNLTALGVSVPGGYATTAAAFKAFIAYNNLSKRIYDKLATLDVEDVKALTAAGKEIRDWIIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRTLGSKLVRMVYSDSPGERVKIEDTPTELRHCFAISDADVQELAKQALIIEEHYGRPMDIEWAKDGVSGKLFIVQARPETVKSRSHTTQIERFALQQRGEILTEGRAIGQKIGSGISRVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 30801 - protein, 309 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAENNAQKKTN

SEQ ID NO: 30802 - protein, 636 aa, Glycine max
  misc_feature (13)..(13): Xaa can be any naturally occurring amino acid
MSSSTTVRKLQVXVPVPADIDIANSVEPVHISQIAKDLNLSPNHYDLYGKYKAKVLLSVLDELQGSEDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHESTQSDKALFNRLCPPNKEGKRSFSDVMFRRLTKLGISKTNPDDLTPEEVNKFARLDIDPNSITWRRVMDINDRFLRKIAIGQGPDEKGMVRETGFDISVASEIMAVLALTTSLADMRERLGKMVIGNSKSGDPVTADDLGVGGALTVLMKDAIHPTLMQTLEGTPVLVHAGPFANIAHGNSSIVADKIALKLVGPGGFVVTEAGFGADIGAEKFMNIKCRYSGLTPQCAIIVATIRALKMHGGGPAVVAGRPLDHAYLTENVALVEAGCVNMARHISNTKSYGVNVVVAINKFSTDTEAELNAVRSAALAAGAYDAVICTHHANGGKGAVDLGIAVQKACENVTQPLKFLYLVDLSIKEKIEAIAKSYGASGVEYSEQAEKQIEMYSKQGFSGLPICMAKTQYSFSDNAAAKGAPSGFVLPIRDVRASIGAGFIYPLVGTMSTMPGLPTRPCFYDIDLDTTTGKVIGLS

SEQ ID NO: 30803 - protein, 434 aa, Enterococcus faecalis V583
MNTPQQTETPNGKAAVLGLQHLLAMYAGAVAVPLLIGTGLNFDSQQMTYLISIDIFMCGVATLLQLTVNKFFGIGLPVVLGCAIQAVAPLIMIGTNKGVGAIYGSIIASGIFVVLIAGFFSKIKRLFPPLVTGTVITVIGLTLIPVAVEKMGGGLATDKSFGDPKNLLLAFVTIALIIVVQVWGRGFIKSIAVLIGLVGGTILAAFLGLVDLSPVGQATWFHFPQPFYFGKPTFDLSSIVLMIIISIVSMVESTGVYFALGDITGKKIGEDDLRRGYHAEGLAVILGGIFNTFPYTGFSQNVGLVQLSGIKTRRPIYFSAFFLIILGLLPKIGAMAQIIPEPVLGGGMLVMFGMVAVQGMRMLSKVDYSNDKNLLIIAISIGFGLGFNIMPTLFNKVPETVSMFTGNGIVMSSITAIILNLLFNGLKETSESNE

SEQ ID NO: 30804 - protein, 586 aa, Gentiana lutea
MDVRRRPLMPKPINAAAGELLLKPPSNQKNQSTQQQQVKASDALPFPLYLANGLFFTMFFSVIYFLLLRWRGKIRDSTPLHVVTLSELVAMISLIASVIYLVGFFGIDFVQSLIYKPNHDVWDVEDEQNEQFLVQPAKTVPSFPPPLPSEFAAEKVKPAPLITHQDSQEDEEIIESVVSGKTPSYSLESKLGDCKRAAKIRREALQRITGKSLEGLPLEGFDYESILGQCCEMPVGYVQLPVGIAGPLLLDGREYMVPMATTEGCLVASTNRGCKAMVACGGATSVLLKDGMTRAPVVRFGTAKRAAELKFFVEDPLNFDTISVIFNKSSRFAKLQRIQCAIAGKNLYMRFTCSTGDAMGMNMVSKGVQNVLDFLQSDFPDMDVIGISGNFCADKKPSAVNWIEGRGKSVVCEAIIKEEIVKKVLKTEVAALVELNMLKNLTGSAMAGALGGFNAHASNIVSAIYIATGQDPAQNVESSHCITMMEAVNDGKDLHVSVTMPSIEVGTVGGGTQLASQAACLNLLGVKGASKETAGANSRLLATIVAGSVLAGELSLMSAISAGQLVKSHMKYNRSSRDVTQLCPPT

SEQ ID NO: 30805 - protein, 91 aa, Brassica napus
PSIMKMRSQYIPEEARSTIMNFFRIPLNIFVCVVLYNVNEFPVTVMFGMCSVFLFIASLLQRRLMTIADNPSANDWTPLNERNAEDAPLNV

SEQ ID NO: 30806 - protein, 534 aa, Gentiana lutea
MCCSSPCFSPSCIISFRWREKIRDSIPLHVVTFSELVAMVSLIASVIYLVGFFGIDFVQSLIYKPNHDVWDVEDEQNEQYLVQQEDSRGSATCTTLGCDAVPPPPKIIPIVPSQPSKFPLEKPSPLITPQENQEDEEIIDSVVAGKTPSYSLESKLGDCKRAAKIRREALQRITGKSLEGLPLDGFDYDSILGQCCEMPVGYVQLPVGIAGPLFLDGREYMVPMATTEGCLVASTNRGCKAILASGGATSVLLRDGITRAPVVRFGMAKRAAELKFFMEDPINFETVAVIFNKSSRFAKLQNIQCAIAGKNLYMRFRCSTGDAMGMNMVSKGVQNVLDFLLSDFPDMEVIGISGNFCADKKPAAINWIEGRGKSVVCEAIIKEETVKKVLKTEVAALVELNMLKNLTGSAMAGSLGGFNAHASNIVSAVYIATGQDPAQNVESSHCITMMEPVNDGKDLHISVTMPCIEVGTVGGGTQLASQAACLNLLGVKGASKESAGANARLLATIVAGSVLLGSCLLCLPFQLVNLSKAT

SEQ ID NO: 30807 - protein, 402 aa, Corynebacterium efficiens YS-314
MKNLATVEDTLTSWPQVLLNTYGTPPVELVTGKGSTVTDADGNVYIDLLAGIAVNALGHAHPAIIEAVTTQLSQLGHVSNLFATRPVVEVAAELVQRFALDDATIASQTQVFFCNSGAEANEAAFKLARLTGRHRILAATNGFHGRTMGSLALTGQPDKRIPFAPLPSGVEFYPYGDLDYLTTLVESDPTDTAAIILEPIQGETGVIPAPEGFLTGVRELCDKHGLLFIVDEVQTGIGRTGDFFAHQHEGVTPDVVTMAKGLGGGLPIGACLATGEAAKLFGPGKHGTTFGGNPVSAAAARAVLSVIDEEFCADVARKGELFAEQLRGVAGVADVRGRGLMLGVVLDQPVAKQAVTAGFKHGLILNAPADNIIRLTPPLVITDDEIRDAVRALAAVLAELNA

SEQ ID NO: 30808 - protein, 874 aa, Ralstonia metallidurans CH34
MTFPPPDPAVAPPAEPASRAPHGRPATSGQSASATTVGSGAPLPASSALASTPSQAGPTGRKRPGQSTVTARTGAPNLPDPLGDNVVGERAVVPPIQQGKSRTALTNELNAEPVAGTVPAAPGGDLFIDAVLAQSYRHFFGPTSQPAVPPRQQVISITRLMEKLAYLKPADQALVREAFQFSDEAHLGQYRQSGEPYITHPVAVAELCADWKLDVQSIMAALLHDVMEDQGITKSELAEKFGPKVSELVDGLTKLDKLEFQSREQAQAESFRKMLLAMARDVRVILVKLADRTHNMRTLDFVPPEKRRRIALETMEIYAPIAHRLGLNTIYRELQELSFKVGSPFRYATLEKAVKAARGNRREVVKRILEAAQSALAGAGIVAELSGREKTLYSIYRKMHDKQLSFSQVLDVYGFRVVVETQMHCYMAMGALHGLYKPMPGKFKDYIAIPKINGYQSLHTTLVGPFGTPVEFQIRTRGMHQIAEAGVAAHWMYKHQADHANDIQQQAHQWLQSLLDIQSQTGDSQEFLEHVKIDLFPDAVYVFTPKGHIRALPRGATALDFAYAVHSDLGNQCVAVKINNELLPLRTELKSGDIVEVVTAPYSKPNPSWLAFVRTGKARAAIRHYLKTTKLDEAIQLGERLLEQSTRQLGIELKAVPQSVWDRMIQWTGNKLKEDIFADLALGRRVPAVVARRMEILLQELSGDVDSALLAAVQTFAGEDAPAVPITGDEGMSMIFSACCRPIPGDSIVGYLGKGEGLQIHVQDCKVAKRLHSKDPEHWIEVMWAKKTTRAFDVSIKIMVRNVKGIVARVAADLTSADANVAHVAMEPQQGGHQEATYMQFVIQVQNRLHLANVMRALRRNPDVIRIFRDRNDG

SEQ ID NO: 30809 - protein, 386 aa, Bacteroides thetaiotaomicron VPI-5482
MKGIFPIDKFRTLQTPFYYYDTKVLRDTLSAINQEVAKYPSYSVHYAVKANANPKVLTIIRESGMGADCVSGGEIRAAVRAGFPANKIVFAGVGKADWEINLGLEYGIFCFNVESIPELEVINELAAAQNKIANVAFRINPDVGAHTHANITTGLAENKFGISMQDMDRVIDVALEMKNVKFIGLHFHIGSQILDMGDFIALCNRVNELQDKLEARRILVEHINVGGGLGIDYGHPNRQSVPDFKSYFATYAGQLKLRPYQTLHFELGRAVVGQCGSLISKVLYVKQGTKKKFAILDAGMTDLIRPALYQAYHKMENITSEEPVEAYDVVGPICESSDVFGKAIDLNKVKRGDLIALRSAGAYGEIMASGYNCRELPKGYTSDELV

SEQ ID NO: 30810 - protein, 686 aa, Neurospora crassa
MSSFTETDQLAINTIRVLAADATAHANSGHPGAPMGMAPVAHVLFNRFMNFNPKNPKWLNRDRFVLSNGHACMLQYALLHLYGYALTIDDLKAFRRIDSITPGHPEAHDTPGVEVTTGPLGQGISNAVGLAIAQAHTAAVFNKPGYDLVNNYTYCFLGDGCLMEGVSSEACSLAGHLQLGNLIAIWDDNRITIDGDTNQAFTEDVLKRYESYGWHIVTVLDGDNNLDLIADAIKKAKEVTDKPTLIQLKTTIGFGSKKQGTHDVHGSPLKADDIKQLKEKFGFNPEESFAVPQEVYDLCHKASAKGAAKEEEWNQLFAKYAEEFKAEHDDLIRRQKGELPEGWEKHLPVYTPADPAVASRKLSENVLNKIFEAVPELVGGSADLTGSNLTRWKGAIDFQPPATGLGTYAGRYFRFGVREHGMGAIMNGMAAYGTLIPYGGTFLNFVSYAAGAVRLSALSQVRAIWVATHDSIGLGEDGPTHQPIETLAHFRALPNCMVWRPADGNETSAAYYVALTSKHTPSILALSRQNLPQLEGSTIEKAIKGGYVLHEVEGADVTLISTGSEVCIAIDAVKELKEKHNIKARVVSMPCMEVFDAQPKDYRLSVLPDGIPSLSIEVMSTMGWEKYSHEQFGLNRFGASGAYLDVYKKFEFTPEGIAKRAIATIDFWKDVPNIRSPINRAFQQLI

SEQ ID NO: 30811 - protein, 536 aa, Arabidopsis thaliana
MKLLGFALAILLVVATCKPEEEITCEENVPFTCSQTDRFNKQDFESDFIFGVASSAYQIEGGRGRGLNVWDGFTHRYPEKGGADLGNGDTTCDSYRTWQKDLDVMEELGVKGYRFSFAWSRILPKGKRSRGINEDGINYYSGLIDGLIARNITPFVTLFHWDLPQSLQDEYEGFLDRTIIDDFKDYADLCFERFGDRVKHWITINQLFTVPTRGYALGTDAPGRCSQWVDKRCYGGDSSTEPYNVAHNQLLAHATVVDLYRTRYKYQGGKIGPVMITRWFLPYDDTLESKQATWRAKEFFLGWFMEPLTKGKYPYIMRKLVGNRLPKFNSTEARLLKGSYDFLGLNYYVTQYAHALDPSPPEKLTAMTDSLANLTSLDANGQPPGPPFSKGSYYHPRGMLNVMEHFKTKYGDPLIYVTENGFSTSGGPIPFTEAFHDYNRIDYLCSHLCFLRKAIKEKRVNVKGYFVWSLGDNYEFCNGYTVRFGLSYVDFNNVTADRDLKASGLWYQSFLRDTTKNQDILRSSLPFKNGDRKSLT

SEQ ID NO: 30812 - protein, 1568 aa, Gibberella zeae PH-1
MAQASGQDPTRISILGEPNIIVNHGLWLNFVVDDLLQNIATSTYVLITDTNLFNSYVPAFQSRFEHASQGKDTRLLTYTIPPGEASKSRDTKAEIEDWMLSQQCTRDTVIIALGGGVMGDMIGYVAATFMRGVRFVQVPTTLLAMVDSSIGGKTAIDTPMGKNLVGAFWQPKRIYIDLTFLETLPVREFINGMAEVIKTAAIWNETEFSVLEESAAHILECVRSKGEGRLTPIKDVLKRIVIGSAGVKAEVVSSDEREGGLRNLLNFGHSIGHAFEAILTPQLLHGEAVAIGMVKEAELARFLGVLRPGAVARLVKCIASYDLPTSLQDKRVTKLTAGKKCPVDVLLEKMGVDKKNDGKKKKIVLLSAIGKCHEPRASVVDDKTIRTILSSSVQVTPGVPKDLAVTVAPPGSKSISNRALVLAALGSGTCRIKNLLHSDDTQYMLSAIHQLGGASYSWQDAGEVLVVEGKGGNLQASKEPLYLGNAGTASRFLTTVVALASPGQDATTNVLTGNARMKVRPIGALVDALRSNGLEIEYLGKENSLPLRIDAAGGFKGGDIELAATISSQYVSSILMAAPYAKNPVTLRLVGGKPISQLYIDMTIAMMASFGIDVEVSSKEPNTYHIPKGAYKNPPEYTIESDASSATYPLAVAAITGTKCTIPNIGSKSLQGDARFAVDVLRPMGCSVEQSDYSTTVTGPAPGQLKALAHVDMEPMTDAFLTASVLAAVASGTTQITGIANQRVKECNRIAAMKDQLAKFGVQCNELEDGIEVIGKGQDGGVSTPEASIHCYDDHRVAMSFSVLAVASPGPVIVTERECVGKTWPGWWDILFQVFKVDMVGHESHADTHDEEISEKTLESSVFIIGMRGAGKTTAGNWMAKILGWKFIDLDQELERRAGCTIPEMIRGDRGWDGFRADELALLRDVMERNKTGHVFSCGGGLVETPEARELLNSYGANGGHVLLVHRDTDQVVEYLNRDKTRPAYTSEILQVYLRRKDFYNECSTHLYYSPHSESSGRQSHIPHDFRQFVHSIAGKTTHFKDVLDKDHSFFVSLTVPDVDQAVNLLPEVVVGSDAVELRVDLLQDRSIDSVIRQVSTLRASAKKPIVFTLRTESQGGKFPDSAYDEGLELYRLAVRMGMEYIDVEMTLPDEMIKTVTESRGYSRIIASHHDPKGTMSWKNASWIQYYNRALQYGDIIKLVGIARTPEDNFDLARFKSRMQEAQKTPMISMNMGKAGKLSRVLNRFLTPVSHPALPFKAAPGQMSAAEIRQALALLGDLEPHNFYLFGKPISASRSPALHNTLFKQTGLPHQYHRLETDNIEDVRDVLKSPDFGGASVTIPLKLDIMGKLDELSDAARTIGAVNTVVPFGKPDDNGCRRLLGDNTDWRGMVHALRHAGIQGQDTDNKGAAMVVGSGGTTRAAIFALHSLGFGPIYIAARNQEKADAIAADFPKEYQLEGLSRASDAEKVSENLKVVISTIPADRPIDPTLQELVGAVLSRPAPAGERRVLLEMAYKPSHTPIMQLADDAGNWTTIPGLEVLSSQGWYQFELWTGITPLYKDARAAVLGE

SEQ ID NO: 30813 - protein, 203 aa, Bacteroides thetaiotaomicron VPI-5482
MELDFDKMNGLVPAIIQDNETRKVLMLGFMNKEAYDKTVETGKVTFFSRTKNRLWTKGEESGNFLHVVSIKADCDNDTLLIQADPAGPVCHTGTDTCWGEKNEEPVMFLKALQDFIDKRHEEMPQGSYTTSLFESGINKIAQKVGEEAVETVIEATNGTNERLIYEGADLIYHMIVLLTSKGYRIEDLARELQERHSSTWKKH

SEQ ID NO: 30814 - protein, 280 aa, Synechococcus sp. WH 8102
MGGWIDEEHRGVRYGLAGDVLVEETSPFQRISVIRSERYGKGLLLDGCWMTAEQQERHYHEALVHPALCSAEAIERVLVIGGGDGGTARECLRYPEVIHLDLVEIDGRVVELSQEHLPGIGGAVWSDSRCQLTVGDGIAWAANAPDQSYDVVLVDGSDPAGPAEGLFNRAFFEHCRRILKPGGVFATQSESPEAFREVHVAMVRLLREVFGHADPLYGWVPMYPSGWWSWTFAAVDGPRYRTVQPARAALVAEGCEIWSPRWQQGALDAVPAFIARELAP

SEQ ID NO: 30815 - protein, 471 aa, Triticum aestivum
  misc_feature (157)..(157): Xaa can be any naturally occurring amino acid
  misc_feature (164)..(164): Xaa can be any naturally occurring amino acid
  misc_feature (238)..(238): Xaa can be any naturally occurring amino acid
MCREVEQKPHTPRGIPRASDLLAALHTVARARATPRETVTYHAELGSHCLSEIFTVASVVEMVGSSPMQAVLVAPGVKDKKVLAFRQDALKEKDAVAALMRTIAAGGVRSAFYVFDLARVVDLYRGWRRALPGVRACYAVKCNPEPALLGALAALGXAGFDCAXSRREIEAVLALGVQPGSIVYANPCKPEAHLEYAAEVGVNLTTYDSEEEVVKVKRCHPGCELILRIKGPDGGEAXVDLGTKYGAHEDEVLPLLRAAQREGLNVAGVSFHVGSGASNTDVYRGAIEAARGVFDAAAALGMPPMRVLDIGGGFMAGSAFDEAATVINAALERYFGELPCVEVIGEPGRYFAETAFTMAARVIGKRTRGEVREYWIDDGLYGTLSCIPMDHYVPHPRPLAVPRAGEKAYTSTVFGPTCDSLDTVVTGYQLPEMNVGDWLVFDDMGAYTTASGSNFNGFSTSDIKTYLAYSS

SEQ ID NO: 30816 - protein, 81 aa, Gibberella zeae PH-1
MRDNIQGITKPAIRRLARRGGVKRISAMIYEETRGVLKTFLEGVIRDAVTYTEHAKRKTVTSLDVVYALKRQGRTLYGFGG

SEQ ID NO: 30817 - protein, 144 aa, Gibberella zeae PH-1
MARTKQTARKSTGGKAPRKQLASKAASSLTSSSARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 30818 - protein, 192 aa, Zea mays
MESSSSSLLLSSYTGGNKRAREADLDVASSAEAEAAKRIRPEDLLDLLDDDADAAAAGDLASVMRSLEEEICAGDLAAPQPELGFLLEASDDELGLPPAAGAASSSSDDAGGWEPEEPAGVFGEQIWGFEDEIDGAYAFGGVASSPEAAAAAAAAAAEWGDDGFDAGLFGFGDESFGPSDLAVLRQETMPAV

SEQ ID NO: 30819 - protein, 475 aa, Aspergillus niger
MASTLRLGTSALRSSSIAAKPVVQSAAFNGLRCYSTGKAKSLKETFAEKLPAELEKVKKLRKEHGSKVIGEVTLDQAYGGARGVKCLVWEGSVLDSEEGIRFRGRTIPECQELLPKAPGGQEPLPEGLFWLLLTGEIPTEQQVRDLSAEWAARSDLPKFIEELIDRCPSTLHPMSQFSLAVTALEHESAFAKAYAKGINKKDYWNYTFEDSMDLIAKLPTIAAKIYRNVFKDGKVAPIQKDKDYSYNLANQLGYGDNNDFVELMRLYLTIHSDHEGGNVSAHTTHLVGSALSSPMLSLAAGLNGLAGPLHGLANQEVLNWLTKMKAAIGNDLSDEAIKNYLWSTLNAGQVVPGYGHAVLRKTDPRYVSQREFALRKLPDDPMFKLVSQVYKIAPGVLTEHGKTKNPYPNVDAHSGVLLQYYGLTEANYYTVLFGVSRALGVLPQLIIDRALGAPIERPKSYSTELSPSLLVLSCK

SEQ ID NO: 30820 - protein, 471 aa, Ralstonia metallidurans CH34
MAQSVADVMKLVNENDVKFVDFRFTDTKGKEQHVSVPVSHFDEDKFESGHAFDGSSIAGWKGIEASDMLLMPDSGTAYIDPFYEEPTLVLSCDVIEPSDGKGYDRDPRSIAKRAEAYLKSTGLGDTAFFGPEPEFFIFDGVTWNIDMQGCSVKIQSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSIWKDGQNLFAGNGYAGLSEFALYYIGGIIKHARALNAITNPGTNSYKRLVPGFEAPVKLAYSARNRSASIRIPYVSNPKGRRIETRFPDPLMNPYLGFSALMMAGLDGVMNKIHPGEAADKNLYDLPPEEDAKIPTVCSSLDQALEYLDNDREFLTRGGVFSNSMLDAYIELKMEEVTRFRMTTHPIEFDMYYSL

SEQ ID NO: 30821 - protein, 788 aa, uncultured archaeon GZfos17C7
MEETEKDRNIRILHSGVFTPLRRWATKWSLWPCHFLTSCCGVELAHTGACGYDMERLGTLNMGISRQANFIMVEGTITRKMARALRIVWEQMPDPKFVNVIGTCGQRGGIFWNSYNITRPSDIVPVDFFIPGCPITPESLLRGVRAVQEKIEGRDNTTIRFKHVELPSGDGEENRAPTTPKIFAPTPLVRVDVPRDVDWAFGKDLVKNLKAQLNGLYTSITVTDKNRIAIKTSPENLVETSRKLSDTMGVDHVKSVNVIDVPHERKFMVEYMVSGYTEELMPVILTIFTEIGREAEPEIPSLTSLWESANYSERELHDFFGVKFKGNEGMKGKFLLAPDTPDTPLRKDFKLEEEQYTIEEGVPLTPTITPPHYMPPSSSLSYSESELEDLKMPAYEDVLKEAEKNDEFVAFIGPHHSGSGHLRWVMRMKGDIIKDVIPDPGYVHRSMEKIAENRLYIQNVPLTERPNISDPINMNLGYVRAIENALGIEVPERAKYIRTIMAELSRIGAFFYDMGIFPLFMGHSTGFMYSFAIREMVLELMVRMTGSRCTPSFIVPGGIRRDIPDDVLDRTRKFTTAIHKRLKKYENIFVYNPVLISRMKEVGVLTREEAIRCGIVGPFLRASGVEYDVRKAEPYEVYDKLDWEATTGDAGDCLGRIFGRLEEMKQSVEIVRQAVDAVQEMPRGGVISEEILGDYKEASDDIRGYLYNVYGDLVLPKGEWTSVTEAARGTVLYSIISDGESNVPYRVRIITPCWMNLRGIIEASKGERVADFWTVYASFGYFPPEADR

SEQ ID NO: 30822 - protein, 378 aa, Sulfolobus tokodaii str. 7
MVTSDKYYPYDRPPLSKEYLRGKIDRNSIFFEQPNYYTKRENIRIILNTSVEKINVKEKGVELSNGTIIHFDKALIATGGRPRKLKLPGEELEGIHYLRTLDDCDSLKQENGKEAVIIGGGFIGIEVASSLTMLGVKTTVIEVKPYIWNTFVDEKISRLIQNYFEKHGVNFILNEGVKEFIGDKRVSRVITEGGKTLNVDFALIAVGIVPNIEIAQKSGIEVDNGIIANEYLETSAKDIYVAGDVANIYDPSIGKRRRIEHWNNAEYTGKLAAKNMLGKREKYNFLSTIWSDIFDLHIESGGDTTDYDEYIIRGNFSVDNPNFNVIYLKGGVIKGYVAINRDYEELSALNKLIVSKVDVSNKKNELKDEKYDLSKLSL

SEQ ID NO: 30823 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPLDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30824 - protein, 467 aa, Marinobacter sp. ELB17
MSKTIDLITQHDVKWIDLRFTDTHGKEHHVTIPATEASEDFFIDGKMFDGSSISGWKGINESDMILMPDDTSAVVDPFTEESTVNISCDIVEPTTMQGYERDPRSVARRTEEYLKSTGIADSALFGPEPEFFVFDSVKWKTDMQGSMYEIHSEEAAWSSDKDFDGNNTGHRPRVKGGYFPVPPVDSLHDLRGAMCGAMASMGLEIEVHHHEVGTAGQCEIGVGAATLTRKADEVQILKYCVHNVAHAYGKTATFMPKPVVGDNGSGMHVHMSLSKDGKNLFAGDSYAGLSEMALYYVGGIIKHAKAINAFTNPATNSYKRLVPHYEAPVMLAYSARNRSASIRIPYVNSPKARRVEVRFPDPAANPYLAFSALIMAGLDGIQNKIHPGDAMDKDLYDLPKEEALNIPKVAETLQEALQCLEADHEFLTRGGVFTEDMIRAYIDLKRADVERMNMTTHPVEFELYYSC

SEQ ID NO: 30825 - protein, 155 aa, Wolbachia endosymbiont of Drosophila ananassae
SLVLVFVELIKGFVITLKYMFKPKVTLRYPMEKGPLSPRFRGEHALRRYPNGEERCIACKLCEVICPAQAIVIEAEEREDGSRRTTRYDIDMTKCIYCGLCQEACPVDAIVEGPNFEFATETREELMYNKEKLLRNGEVWEDAIALRLKKNRPYY

SEQ ID NO: 30826 - protein, 493 aa, Coccidioides immitis RS
MPPTRSLRQRAVTNENDENAPTTRLTRAKAAAASSHENQLNAAAAKRPLQSKKSSLNSANTGAQRKRAALGDVSNVNKSEGVETMDAKELKKGTTSRVGLTSKATTQTGGVQKITRSNTSRSALGVRDANKREAEPKRPGSGSGVMGSAQLKRQQSQKFLSANENNAVTDEPPRKRIDSGKKTTAFQEEAKLEETDSVPTEEPQDADKPLNLDAEDQFDPLMASEYVIEIFDYLKEIEPQTMPNPDYIEHQEELEWEVRGVLIDWLIEVHTRFRLLPETLFLAVNIIDRFLSIDIVALDRLQLVGVAAMFIASKYEEVLSPHVANFSHVADETFTDKEILDAERHILATLNYDISYPNPMNFLRRISKADNYDVQTRTFGKYFMEISLLDHRFMRYRQSHVAAAAMYFARLILDRGPWDVTIAHYAGYSKEEIIPVFHLMIDYLYRPVAHEAFYRKYANKRFLKASLHARHWAKKYRSMYLSQESYENRQRHS

SEQ ID NO: 30827 - protein, 489 aa, Tortula ruralis
MARTKKKAQRGKTIKKKKEDVEEVEMMEEDGSGPSQPQQQQGPTKVWQPGVDEMADDEELQFDPTAYHCLHSFKLGWPCLSFDIMRDDLGVLRRDFPHSLQCVAGTQADQAGNNAIAVVRMTNITGKIPKAPSATMDEDGQDSDSESSDDEDEEEVVPEQPGAPDQPVQSKKPIFKVRLVAHQGCVNRVRAMTQQSNIVATWADTGYVQVWDMAAHLRSMATSGPDAPGQPSTVRQAPLHIFTGHKDEGYALDWSPITAGRLLSGDCKSAIHLWEPTPAGKWVVEKAPYTGHTASVEDLQWSPTEADVFASCSVDQTLRIWDTRTRSGSAIAIKAHNADINVISWNRLVSCMLASGCDDGTFRIWDLRNFKEDSFVAHFKYHTLPITSIEWSPHEQSTLSVTSADHQLTIWDLSLERDPEEEAVYQAQLKQNQAEAPEDLPPQLLFVTTGQKDLKECHWHPQIQGMLMSTAGDGFNILRPSNLDNLPAL

SEQ ID NO: 30828 - protein, 437 aa, Coprinopsis cinerea okayama7#130
MSSVLLRSIARSARTPSTASAARRSLSTTAVRAQQEKVRTPHDYHTVEAFQGMHASEILPEPGTKADSKMRHFTVNFGPQHPAAHGVLRMILELNGEEILRADPHIGLLHRGTEKLIEYKNYTQALPYFDRLDYVSMMTNELSYSLAVEKLLNVQVPERAQWIRTLFGEITRILNHLMAVLTHVMDVGGLTPFLWGFEEREKLMEFYERVSGARLHAAYVRPGGVAFDLPHGLLEDIFKWATQFGSRIDEIEEVVTGNRIWKERTIGIGVVTAQQALDYSFSGVMLRGSGVPWDIRKVAPYDKYAEVEFDIPVGKNGDCYDRYLCRVQEMRESLRIISQCLNKMPTGVVKVDDHKLTPPPRAMMKESMESLIHHFKLFSEGYSVPPGETYTAIEAPKGEMGVYLVSDGTNRPYRCSIRAPGFAHLAGSDFMMRPHVG

SEQ ID NO: 30829 - protein, 587 aa, Schizosaccharomyces pombe 972h-
MLNSRSVGSTGSNNTPLGRRRFDEKPDSLPPLPDANGMSNGYRDSYKSNSRMDHRPDGYHDGRGRRAYRKHYWGHPTPIEEMLPSQMELETAVKSCMTMEQLELYSLNVRLEEITQKLRTGDVVPHHRERSPSPPPQYDNHGRRLNTREIRYKKKLEDERHRIIERAMKMVPGFRAPSDYRRPAKTQEKVYVPVKDYPEINFIGLLIGPRGHTLKDMEAKSGAKIAIRGKGSVKEGKGRSDPSVRGNMEEDLHCLVTADSEDKINHAIKLIDNVIQTAASVPEGQNDLKRNQLRQLATLNGTLRDDENQVCQNCGNVGHRRFDCPERINHTMNIVCRHCGSIGHIARDCPVRDQQPPMADSTADREYQSLMQELGGGSAISNGNGEPQKSIEFSESGAASPQAGHPPPWAAASTSVSSSTSSPAPWAKPASSAAPSNPAPWQQPAAPQSAPALSMNPSSLPPWQQPTQQSAVQPSNLVPSQNAPFIPGTSAPLPPTTFAPPGVPLPPIPGAPGMPNLNMSQPPMVPPGMALPPGMPAPFPGYPAVPAMPGIPGATAPPGAPGSYNTSESSNLNAPPGVSMPNGYSNR

SEQ ID NO: 30830 - protein, 450 aa, Ostreococcus tauri
MAADDATDVVDDVAPEATAPSTVDAPERALNKLPPSNPNKKRKCALTFAYVGAGYAGMQRNPGVRTIEGELEGAIARAGGISDANAGDFAKVQWTRAARTDKGVSAVGQVIALKMVMEPDGMLARINEALPERFEVFGIDRVTGGYEYVIPTWAFDPNLFVEGAEKEKFTFTEETRRRVERVLGNYCGTHNFHNYTVKVKPTDAQAKRYILSFECSQPFEVDGEEFVRCEVVGQSFMLHQIRKLIGTMLAVMRGTLDEDDQKFAILSHQFVPTPMAPELGLFLCECIYKAYNDKFGSVHDNFELEKYRDKSEAFKRAHVYTHIARQEREQSTLRNWIKDVLHDGLRDSFDVSMAASLRAEEKLDPTRVGHRAPKGTKRGAEEEHATQMSVDAFQDVLTVAAERAKKRKLERRQDDWTPRAAAPTPSENKQARPSAPTETAIPDDELSDST

SEQ ID NO: 30831 - protein, 195 aa, Triticum aestivum
MAAFGGNGCCYSSGSEDEEEEGAEGYRKGGYHAARPGDRFAGGRFVAQRKLGWGNFSTVWLAYDTLLSRFVALKIQKSARDYAHAALHEIELLSAAAKGDPTSSKCVIQLLDHFKHAGPNGKHICLVTEFLGDSLLRLIRYNRNKGIGLSRVREIRRSVLTGLDYMHRELGIIHTDLKPENVLLVSTINPSKDPV

SEQ ID NO: 30832 - protein, 455 aa, Picrophilus torridus DSM 9790
MLKRFPERGIPLDEINSILDGYGKNDIKNSRGRLFTYFYDPGLKDLDDLSSILLKFYNRNGMDYHAFPSTLKIENDLISMMSDLMHGNDDTSGTFTTGGTESILLAMKAARDLFLEKKEYVPEIVAPVTAHPAFSKAAKYLGMKITRVPVNEDYIADDTINEYINDRTAAVIASAPSFPYGGIDNIKDISEIALDKNTWFHVDACVGGMILPFLKGLGLNIKDFDFKLPGVSSMSIDLHKYGFTPKGSSVVLYKNHDLRKRQIYVNADWPGYPMSNMGMQATKSAGPLAGSWATLNYLGLDGYKKLAEKTLKAYRMIRSGITDLGYKIIGRPDATIFAFTHNDKDIIDLGIKMIENGWYPQIQPGNVFIDMPDSVHLNISPVHLDVADEFLEFFNELDKNVKPRDKNSYNVNSVEKALEMIKMEKSMLFRIIRYSRPEVSEKIFLEMTDEDFTYS

SEQ ID NO: 30833 - protein, 484 aa, Oryza sativa (japonica cultivar-group)
MEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMDAVKANLGGAKVKVCGCIQYLNLLGVAIGYTIAASISMMAIQRSNCFHARGEQDPCHASSNVYMIMFGIVQVFFSQIPDFDQVWWLSILAAVMSFTYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 30834 - protein, 307 aa, Sinorhizobium meliloti 1021
MDSKTTKPMPTEAGIRAFHERCEAFYPADAVNASVEQQRQWYDALCAEFDAPSPEGLTRRDERVAGRIPVRYYRPAEVASGTRVFYIHGGGFVVGSLESHDAICAELAHGAQVELVSVDYRLAPEHLWPAAFEDCCDVLEALLADGRPLVVAGDSAGGNLSAGIVLKAKAEGLAGIVGQVLIYPGLGGDLTRGSYIEMAQAPLLSTADVDYYREVLKAPADEPFAHPLRAADLSGLPPAYVSGAYFDPLRDDARAYAARLAQAGVDVTYREEPQMVHSWLRARRMSPGAREGFVRLVQAVARLAGTA

SEQ ID NO: 30835 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLLLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30836 - protein, 111 aa, Anabaena variabilis ATCC 29413
MKKIFSLVLLGIALFTFAFSSPALAADVANGAKIFSANCASCHAGGKNLVQAQKTLKKEDLEKFGMYSAEAIIAQVTNGKNAMPAFKGRLKPDQIEDVAAYVLGQADKSWK

SEQ ID NO: 30837 - protein, 406 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVFGTAIAATMGLVDFSPVAVAPLVHVPIPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASL

SEQ ID NO: 30838 - protein, 386 aa, Acidithiobacillus ferrooxidans
MAEPNFAPGLEGVAATQSSISNIDGAAGLLSYRGFAIADLAAHSSFEEVALLLLDGVLPGAADLERFDHGLRAHRQVKYNVREIMKFMPVTGHPMDMLHCAVASLGMFYPQQELSDAERGNTLHLDAMAMRIIARMPTIVAMWEQMRFGNDPISPRPDLSHAANFLYMLSGREPDPAHTKILDSCLILHAEHTINASTFSVLVTGSTLTNPYHVIGGAIGTLAGPLHGGANQKVVEMLEEISSVQQVGAYLDRKMANKEKIWGFGHRIYKTRDPRAVILKGMMEDMASHGNLRHSSLFEIAIEVERQATERLGAQGIHANVDFYSGVLYHEMGIKADLFTPIFAMARSAGWLAHWREQLADNRIFRPTQVYTGEQDRRYVPVAQRT

SEQ ID NO: 30839 - protein, 429 aa, Anabaena variabilis ATCC 29413
MVSMPTLPLEGASPAHICPFDQACSYLEAAAKELRLDQGTLEILSHPRKVVTVSIPVRLDNGDIRVLAGHRVQHSDILGPYKGGTRYHPAVTLREVSALAMLMTWKCALLGIPYGGAKGGIAINPQHYSVGELEKITRRYTSELIKDIGPAVDIPAPDVGTSAREMAWMMDTYSVNVGHAVPGVVTGKPISIGGSRGREMATGRGVMIIVREALADMGRTLEGVKVVIQGFGNVGGAAAELLYQAGAKILAVSTGAGGLFAADGLDIPALKAYAAENHRSIVGFPQAVAISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 30840 - protein, 720 aa, Magnaporthe grisea 70-15
MQLYDCEEAKLNLLINVSPVTKGFRTKTALALGCNMQKITGMRADWCIGYQGLFDSMLPLKQGARPPSRVQQVLRSFKVHSGRDQGTPISSGETPLAPRAQNVLSTANRTTAHRDEIDVADNAMKRNNRGSSPASASLPKIAVNGPSTNMTAEPDKAGTEGERVQGGGDGIDAGLRSLGHYKRALPPWRYAVRQKMLPLIRWETPYLAWLQSKIRSPALDSYFAITANLGTHTFFMIGLPIMFWCGFMEFGKGLVHILATGVFVTGFIKDLLSLPRPLSPPLHRITMSGSAALEYGFPSTHSTNAVSVAVLGILMLHDPTNTLSSSVKLYLEVLSYFYAVSIVFGRLYCGMHGFLDVIIGSLIGIFIALGEFYCGPILDSWLHATGWRGSIVFILTIIVLVRIHPEPADDCPCFDDSVAFAGVMMGLEVGFWHYMHSSFAWPASDRFSLSQLGWPTVGARLVAGIIVIFAWREIMKPALLKILPYIFRAIEDRGLSLPRRFFVNASEYKNIPDLLRLHTDNVIPSVSDLPEIVRNIRRVGTRGRSVSIGPQSAADAYETLAYRERRRRESMGSNASLGSKPSLRNLREEVSREGGASGDAFEDGDGFAFSSSLSSAQQIRRRNQSPGTLADYESQMGRGTVVVGDEGGKGEDDVDIFIGQQDEFEEKEMFEKLIKPRVRYDVEVVTKLVVYAGIAWLSVEGIPVMFEYIGLGAEHLRQPR

SEQ ID NO: 30841 - protein, 244 aa, Ralstonia metallidurans CH34
MHEIERLLKGFERFQRRYFEARPELFDALRTGQKPQTLLIGCSDSRVDPGLLLDCDPGELFTVRNVANLVPPCGDGASGRLHGVSAAIQFAVEQLHVVRIIVMGHAGCGGIRALLAHPQNDDTNAPQDFIGPWVRIAGPARRMVEQTLPNASPAERQRACEQAAILVSLRNLESFPFVREACERGALTLHGWYFDLQAGALLAYSERADDFLPLVCPLTPEARPHRQPSNRPSIDSGQAEMLGS

SEQ ID NO: 30842 - protein, 339 aa, Triticum aestivum
  misc_feature (49)..(49): Xaa can be any naturally occurring amino acid
  misc_feature (196)..(196): Xaa can be any naturally occurring amino acid
  misc_feature (262)..(262): Xaa can be any naturally occurring amino acid
  misc_feature (277)..(277): Xaa can be any naturally occurring amino acid
  misc_feature (313)..(313): Xaa can be any naturally occurring amino acid
MAPLGDAVAPAAAAAAPGLVVSFGEMLIDFVPDVAGVSLAESGGFVKAXPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSTGILCSYDPNVRLPLWPSAQARXDGIMSIWKEADFIKVSDDEVAFLTQGDATDEKNVLSLWFEGLKLLIVTDGEKGCRYFTKDFKGSVXPGYSVNTVDTTGAGXAFVGSLLVSVSKDDSIFYNEAKLREVLQFSNACGAXCTTKKGAIPALPTTATALELISKGSN

SEQ ID NO: 30843 - protein, 657 aa, Escherichia coli
  misc_feature (76)..(76): Xaa can be any naturally occurring amino acid
  misc_feature (85)..(85): Xaa can be any naturally occurring amino acid
MTQLAIGKPAPLGAHYDGQGVNFTLFSAHAERVELCVFDANGQEHRYDLPGHSGDIWHGYLPDARPGLRYGYRVHXPWQPAEGHXFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 30844 - protein, 377 aa, Triticum aestivum
  misc_feature (201)..(201): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYXFTTTAEREIVRDIKEKLAYVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 30845 - protein, 103 aa, Coprinopsis cinerea okayama7#130
MASISELVDSTIEKNRVVIFSKSYCPYCRKAKNLFAEKFPQVEPKVLELDELDNGSAIQDYLQQKTGQRTVPNVFVESQHIGGSDDTKAALESGKLAKLLTAA

SEQ ID NO: 30846 - protein, 489 aa, Zea mays
SSQQSVTLTHTGGTEPANVFFVAGLGEAREQPRAGATLLQLQLRQEVSQAGGHLQDAALMATAVSCPYSSSRAGAPALLLVALLLAAASWTTTAAAKNDTQRFRPGDELRRYRRVQALLKRLNKPALRSIQSPDGDLIDCVPAHLQPAFDHPRLRGQRPLVAGPPPARPKGNRLRDPIRNDTAEAAGVQQLWAASGESCPEGSVPIRRVTESDVLRASSVRRFGRAPAGRVRRDSVSGGHEHAVGYVAGDEYYGAKASINVWAPQVSTASEFSLSQIWVIAGSFGNDLNTIEAGWQVSPELYGDNAPRFFTYWTTDAYQTTGCYNLLCSGFIQTNSRIAMGAAISPTSAYNAGQFDISLLVWKDPNHGNWWLEFGSGELVGYWPSLLFSHLASHASMVQFGGEVVNTRASGSHTATQMGSGHFAGEGFGRASYFRNLEVVDWDNSLVPLAAGFHVTADHPSCYDIQGGVNAVWGNYFYYGGPGRNVRCT

SEQ ID NO: 30847 - protein, 259 aa, Salinibacter ruber DSM 13855
MCLILFAKDVHPEYPLIFAGNRDEFYDRPTAPAAFWDDAPHVLGGRDLKAGGTWLGITRKGHWATVTNVRDERPRRDDAPSRGRLVADYLREELAPEAYLDGLETEADQYNGFNVLVGTPEKTFYYSNRDGTPRPVRSGIHGMSNAQLDDSWPKVERGTSGLDALCEDKDLSIEALFDILDDRQPAPDGQLPQTGVGRETERMLSPPFIDGDEAYGTRASTVFLVHRSGRVTFAERSFDGGTATETRDFSFNLASPVAS

SEQ ID NO: 30848 - protein, 338 aa, Ralstonia metallidurans CH34
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 30849 - protein, 475 aa, Sinorhizobium meliloti 1021
MDTQLLIGSRFEAGTEAEEHILNPRTGAGIIDLAEASHAQIDAAVDAAERAFVGWSQTTPAERSNALLKIADAIEKEADEFAALEALNCGKPINAVKNDELPAIIDCWRFFAGAVRNLHAPAAGEYLPGHTSMIRRDPIGIVGSIAPWNYPLMMMAWKLAPAIGGGNTVVFKPSEQTPLTALKLARLIADILPEGVVNVITGRGETVGNALINHPKVGMVSITGDIATGKKVLAAAAKTVKRTHLELGGKAPVIVYGDADLEAVVNGIRTFGYYNAGQDCTAACRIYAEAGIYEKLVADLTSAVSTIRYNLDDDTENEIGPLISRRQRDRVASFVERAADQKHIEITTGGRTGSDEGFFFQPTVVAGATQEDEIVRREVFGPVVSVTRFTGKDDAVAWANDSDYGLASSVWTKDISKAMRAASRLQYGCTWINTHFMLTNEMPHGGIKQSGYGKDMSVYALEDYTAVRHIMINHG

SEQ ID NO: 30850 - protein, 468 aa, Ralstonia metallidurans CH34
MNSASTTVPTDLTNERLPSGRLLALGLQHVLVMYAGTVAVPLIVGGALKLPKDQLAFLINADLFAAGLATLIQAFGFWKFGIRMPVMMGVTFASVAPMIAIGNDPNVGLLGIYGAVIASGIFGILIAPMMGRMLGLFPPVVTGTVITLIGVSLMRVGINWAGGGQPTTRAVIDGVAKEVPNLAYGDLSNLAIAGLVLAVILLLSKYGRGLVANCAVLLGIIIGTLVAMALGKVSFEGLNEASYVAVITPLHFGIPKFELTAILSMCIVMLITLVESTGMFLALSDITGRKLSRDDLTAGLRADGLGTVIGGIFNTFPYTSFSQNVGLVTVTGVRSRYVAAAGGLILIAFGLFPKMAHVVASVPQFVLGGAGIVMFGMVAATGIRILGSCDFNRNRHNLFIVAISIGFGMIPTLSPTLFQYLPKWTDPFTHSGIVLGTIVAVALNLFFNGIQSAEEAMRNAAANSHGTE

SEQ ID NO: 30851 - protein, 201 aa, Synechococcus sp. WH 8102
MSSKLRLGVAGPVGSGKTALVEALCLRLRDQLQLAVVTNDIYTQEDAQFLTRAGALEPERIRGVETGGCPHTAIREDCSINRAAVADLEGQFPDLDLVMVESGGDNLAASFSPELVDLCIYVIDVAAGDKIPRKGGPGITRSDLLVINKIDLAPLVGADLSVMEADTRRMRGERPWCFTNLQNGDGLVQVVEFVLQQLPNA

SEQ ID NO: 30852 - protein, 524 aa, Ashbya gossypii ATCC 10895
MAFMFKPPEQRKRNEKSPRLSLPSTLIGSATPAGDEHASGAMGNSIGSDLHREQKLRGLGQSVQIAEQLSAGSTDTAGSDVLSQHAPSSASSQTSKVLPRRPVPPGMPALAFLSKHPYAQQVTGPLPTTSGEKAGSHSGATTLSAGPTRPPLPKLPYLHVEPKLPCEELPYSALHAGSSSSSNIHSPSRALQEMRLISAGSTPVEPVPPAATVPPCKDVDELEEEMWTHVHLKDQIEELGVLGEGAGGSVTKCKLRHGSKIFALKTITTLTTDQESQKQIFRELQFNKSCKSDYIVRYYGMFTDEEHSSIYIAMEYMGGRSLDAIYKHLLKHGGRVGEKVLGKIAESVLRGLSYLHQRKIIHRDIKPQNILLNEAGQVKLCDFGVSGEAVNSLATTFTGTSYYMAPERIQGQPYSVTSDVWSLGLTLLEVAQAHFPFDSGKFAANMPPIELLMLILTFTPQLKDEPEANIVWSKAFKSFISYCLKKESRERPSPRQMLRHPWIQGQMKKRVNMEKFIYKCWQAR

SEQ ID NO: 30853 - protein, 332 aa, Nostoc sp. PCC 7120
MTKNLLEQLREMTVVVADTGDIQAIEKFTPRDATTNPSLITAAAKMPEYQEIVDQTLLQAKKDAGAGASKGQIVSLAFDRLAVSFGLKILQIIPGRVSTEVDARLSYDTEATITKARELIAQYKAAGIGPERVLIKIASTWEGIKAAEILEKEGIHCNLTLLFGLHQAIACAEAGITLISPFVGRILDWYKKETGRDSYPSAEDPGVLSVTTIYNYYKKFGYKTEVMGASFRNIGEITELAGSDLLTISPGLLGELQATIGELPRKLDPAKAATLDIDKISIDKATFDKMHAADRMAYDKLDEGIKGFTKALEELETLLAERLARLEVVASH

SEQ ID NO: 30854 - protein, 515 aa, Frankia sp. EAN1pec
MPHSLRGPRRSRSRSSESPASAPRDAAPRDAPPRPGGGPSHAEHGVHLAFGADPATSMVVSWITREPVVRPLARVVTGTAEAVREVEAGTRSYTDAATGWEIYAHHALLDELAPDTEYTYEITYQTTAAGVVREVGRASFRTAPRGRAAFTFACFGDHGTDASDNPFGTPASGALVAGVERVDPLFTLVDGDLAYSNVSDVPPRAWADWFAMISTSAARRPWMPSVGNHETERGNGALGLAAYQTYFQPPDNGEEPYLAGLWYAFTVGGVRFVVLSGDDVCYQDAGRVYLHGYSSGRQTAWLERQLAEARADQAVDWIIVALHQAAVSTAEFHNGADLGLREAWLPLFDQYGVDLVISGHEHHYERTHPLRGVVDGSTTLTPRPVPGSVSVAGGGGGGTATLDTSAGTVHMLIGTGGSSTPSAGQLFDPPACRVVVGVREREPGQRQRSSIRAVEPAPWLAARFPEHPYAFAALTVDPGEPGGTTRIQVTVYDSADAVPVPFDTFTLARPRADAT

SEQ ID NO: 30855 - protein, 425 aa, uncultured archaeon GZfos17C7
MKEEKDYFVFGGMDVVELAERYGTPLYVTDENKLRNNFKSYKNAFETTNIDTDIYYAVKANGNLALLKILASEGAGADVFSAGELELTKLAGIPAEKILFNGNSKSDDDLKEAVESGVRVSVDSVDELRALSAVANELGREVEIAIRVNPDVSPDVHAKIATGLKESKFGIPFHDVIPVCEEAEKLPNVLLAGLHCHIGSQILDISVFGEATEKMMALVERMYERGMKLKFVDLGGGLGIGYRQEEKATAPTPEDLAEMILPLFENKIRDLGISLKLVLEPGRSIVGASTILLSRVNAVKRANKNFVAIDAGFNLLIRPVMYGAYHEVVVANKVNERASELYTVVGNVCESGDIMAKDRMLPKVERGDLVAILDTGAYGFSMSSQYNGRPRCAEVLVCNGKADLIRSRESIEDLIRNQEIPARLI

SEQ ID NO: 30856 - protein, 403 aa, Oryza sativa
  misc_feature (104)..(104): Xaa can be any naturally occurring amino acid
MDWAAAGYTAAALVCAAAATVIALVHIYRHLLHYAEPIYQRFIVRLIFMVPVYAVMSFLSLILPDNSIYFNSIREIYDAWVIYNFFSLCLAWVGGPGAVVVSLXGRTLKPSWFLMTCCFPAIPLDGRFIRRCKQGCLQFVILKPILVVITFILYAKGKYADGNFSVKQSYLYITIIYTVSYSMALYALAVFYAACRDLLRPYNPVPKFIMIKSVVFLTYWQGVLVFLAAKSRFIKNAEKAADLQNFVLCVEMLIAAIGHLFAFPYNEYAGPNGRPSGDFKGSLLHALKFNDFYHDTVHQFAPTYNEYVLYNHNEGDSTQRKYPSVSTVPSGRDVELSGISVMPANSAVTSSVSSNQADQEETMSTPIKDRVDNVGLYDLTDLLDVDLSNYPAKVPAISDVRKQ

SEQ ID NO: 30857 - protein, 676 aa, Ashbya gossypii ATCC 10895
MSPTPLYPSVSSPSHAKKTLRQKQIEEYYAAEIYPPIIDGPVDYDLPQLKVYGDQRPCPELILDDSENALRPLVEEWLEKLNAMLESINTGARREIIHSNMDNVFTNHAAWRDHLAVSWDLHTFNTLDDLKDRLVPFLESALLENVKLDDLADYHYKYGFGKVLVHEETWDHPPIEWIQVYYSFENKIGYGKGIARLAAVEDELTGEATLKCFTFYTVLEDLKAYPEKILRNRPEGVNHGQHVGRQSWLELRAKETTFDRNNQPTVLIVGGGQGGLAVAARLKSFGISSLIIEKNARVGDNWRNRYKFLVLHDPIWYDEMPYLRFPPTWPVYTPKDKLGDWFDAYAKSLDLNTRCASTVTGASFDELTGRWRVEVTDNLSGGVTYFAPSHLILATGHSGEPRLPKFKDQELFEGKIVHSSEHGTGAEYKGKRALVVDDCNSAHDICQDFYEQGADVTMLQRSSTCIITATHGTIHNNRGLYDEDGPVTETADHIFHSMPIHLLNGMMQQQYRVSCRDDEELLRSLQRVGFKLNGGYNGTGLFGLYFRQGSGYYIDVGCSGLIADGKVKLKQGVGIERFLKNGVVFTDGSRLENIDIVVLATGYTNMRETARRLFGNKVAGRLDPVWGLDEEGETKTMWRNSGHPNFWFMGGNLALARYYSKRLALKIVAQEMNIFY

SEQ ID NO: 30858 - protein, 343 aa, Nostoc sp. PCC 7120
MAKLKVGINGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMVQKEQLAAV

SEQ ID NO: 30859 - protein, 414 aa, Sulfolobus tokodaii str. 7
MAISLAKKYQGKLEIMPKIPIRSYEDFALIYTPGVAELVKEIQKDENQSFELTSRWNTIAILTDGSRVLGLGNVGPIASLPVMEGKALLFKFLGGVDAFPLPIKVSDKEEFIQVAKAIEPAFGGINLEDIESPKCFFILEELQKTLNIPVWHDDQQGTAGAVLAGLINAIKITGKDKNSKIVLMGAGAANIATAQLLIKYGFNPKNMILIDKEGPLYAERGDVDSLMFKHPWKYELAIQTNSERVKTIEEAFKGADILIAASSPEVRIDKKLIRMMNKPIVFALANPIPEIYPNEAKEAGAVIVATGRSDFPNQVNNSLIFPAVFRGVLDSRAKKITDEMIIAAAEELAKYAEEKGLREDYIIPRMDEIEVYYRMAAAVATKAVELGYARLKLSYREFLESAKERILRARRLSL

SEQ ID NO: 30860 - protein, 980 aa, Aspergillus nidulans FGSC A4
MSTHDNADRQSEFVADAVTAMKLEQSENNTDAPILNGGGAAMKPDSKAASPEPLIKDERASSTFMKSRSSSRTPSSRTPLKKEHSDSEDIQEKRGDDASGTEKVGGGISVKMEPGQPPKLARSSSQKVVPRPPQLFLDLPDSTEEAQKTFEVIETCQYANKYMGYTEHAMECDCAEEWVLVVVLAPSPSFRVPSQNPASSTNRACGEDSDCINRATKIECMGDCGCGPDCQNQRFQRREYANVAVIKTEKKGYGLRAEEDLRPHQFIFEYVGEVINEGPFHRRMRQYDAEGIKHFYFMSLSKGEFVDATKKGNLGRFCNHSCNPNCYVDKWVVGEKLRMGIFAERHIQAGEELVFNYNVDRYGADPQPCYCGEPNCTGFIGGKTQTERATKLSNATIEALGIEDADGWDTAVAKRPRKKKMGEEDEEYVDSVQPKSLDESGVTKVMAALMQCKEKWIAVKLLGRIQRCDDERVRNRVVKMHGYQILNSQLAMWKDDFNVVLQILDILDKFPRLTRNKIIDSKIESTIQPLTSCGDERVEQKATVLLQLWSTLEIGYRIPRMKRDPNAATPTVSQFHRRDDISDERQQRPRSRSRSRSIEAPRGPAAQKRGGQGPRNQHHQGPRTFRRRFDPLPQGWFAAESNGRTYYYSARGDTTWTRPTKPAPQPPPPPKESRDKALQSIIDGIMNAKEQTPKEKSGTPTTPQPSKPTPEGKDRQEKWRSYSEEKQKKLYENTLYPHIKYVVDKFKHKLPKDDLKRYAKDVAKKLVNSDFKNNRVTDPTKIDDKQQKKVKKFCKEFFDKAVAKHQAHEKRKAEKLAKEGSSDNKLATPVGGQSEGDGTPDVKMSDDEGSTGREGTGSLKRKRDELSVGNTNTPDDTPTSSTKRQRSSTPPPPPPPAMNTNDNNNDNDDMSVRSDEPDADADADEVVLVGNPTPPPPPPPPPQEDMRIPDADAETNGHNFEGYGEMNRSHQAQIGIEGNV

SEQ ID NO: 30861 - protein, 228 aa, Ralstonia metallidurans CH34
MTQDELKALVAQAAADYVKQEVPEGAVLGVGTGSTANLFIDAVAAFKERFSGAVSSSEASTRRLQQHGFNVLDLNEVDSIPVYVDGADEIDNSGAMIKGGGGALTREKIVASVADRFVCIADGSKLVPTMGAFPLPVEVIPMARAAVARSLAALGGQPRLRMTKEGGIYKTDNGNVILDVSGLKIENPKALEQQINQLPGVVTVGLFALRGANVLLLGTEQGVQRSDY

SEQ ID NO: 30862 - protein, 318 aa, Ralstonia metallidurans CH34
MNELEQLRQFTTVVADTGDFQLMKQYKPQDATTNPSLIFKAVQKPEYRPLLEQAVRDHHGNSGLDGVMDQLLIAFGCEILAIVPGRVSTEVDARLSFDTEATVAKARHLIGLYEQRGVARERVLIKIASTWEGIRAAEVLQRENIRCNMTLLFSLAQAVACAEAGAQLISPFVGRILDWYKKQAGEKWDPVANGGENDPGVRSVRQIYDYYKKFGYATEVMGASFRGTDQILSLAGCDLLTISPELLEQLAGGQSAVALKLSVEQAQAGNVARIAADEPAFRWQLNEDAMATEKLSEGIRLFAADAVKLEKLVGELAS

SEQ ID NO: 30863 - protein, 457 aa, Escherichia coli K12
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 30864 - protein, 435 aa, Wolbachia endosymbiont of Drosophila ananassae
MPIEILMPALSPTMSKTGGKIVKWHKKEQDKVEVGDVIAEIETDKAIMEFESIDEGVLAKILVTEGTSGVPVNQPIALMLEEGEDESALNNYTSTSINSAVKKEVTKSAVDNQKSEHQDLNGKPISHSSVSFQRVTLESNPSMSSQCLTLGSRKEEWIPVSATQMTEGYAEGRTKISPLAKKIAQNEGVNVQQLKGTGPYGRIIKADVLEFLGSGIHTESPEKDTIVEVSNMRQVIAQRLTESKQNVPHFYLTVDCQVDKLISLKNEINSADENNKVTINDLIIKAAAFSMKKFPDINSSWIDNKILRYSNIDISIAVALEDGLITPIVKNADKKGILSISKEVKDLVSRARSGKLKPEEFQGGGFTISNLGMFGIKAFSAIINPPQSCIMAVGASKKQPIVMNEKIEIAEIMTVTLSVDHRAVDGALGAKFLNA

SEQ ID NO: 30865 - protein, 133 aa, Triticum aestivum
RDAQSGGSVVCLTQIIGAERGLYPGAAAYGTSLGAVHQLVRLSAMELGKHKIRVNAVCRGLHLGDKFPVSVGEEKAEKATGEVMPLRRWLDPEKDLASTVLYLVGDESRFMTGTTIYVDGAQSIVRPRMRSFL

SEQ ID NO: 30866 - protein, 257 aa, Arabidopsis thaliana
MKLIEKTMSMNQFRTMEEEKQDGGELFHTIEVAKVDRNNVSQPPPAATAALLEVPGDELNLIPPLNFSMVDNGIFRSGFPDSANFSFIKTLGLRSIISLCPEPYPENNMQFLKSNGISLFQFGIEGSKSKCLPGLENEVWLHIWSSKHQKEDFYTNGNSKTSEPFVDILDQKIREALKVLLDEKNHPLLIHCKRGKHRTGCLVGCMRKLQKWCITSILDEYKRFAAAKARVSDQRFLESFDVSGLKHTPMSFSCSNR

SEQ ID NO: 30867 - protein, 264 aa, Triticum aestivum
MAVAGCGSREERWSLAGATALVTGGSKGIGHAIVEELAGFGARVHTCSRNAAELEECRRRWEEKNLRVTVSVCDVSVRAQREKLMETVRQTFDGKLDILVNNAGQLLFKPAAECTAEDFSNLMTTNLEASFHLSQLARPLLIHASIAGGGSIINVSSIGGSIAFAGSTVYAITKGALSQLTRNLATEWAPNKIRVNGVAPGFVTTDMIKDVDPEYMKQENSKTPLGRSGKPVEIASAVSFLCMPAASYITGQVICIDGGRTISS

SEQ ID NO: 30868 - protein, 910 aa, Coprinopsis cinerea okayama7#130
MAIPTTRPKLKKAFKKARTIAPLYTSGPVASTSDGERLATCVGEEIVLTDVKSGEELCRFAGDTESITSLCITASGKYLIAFSASLSLRIYELPQTEIPTEKIRPIRTIGRAHDAPVHVCTSDPTSTLLASGSADGIVKVWDVAHGYVTHVFRGHGGVVSALTFNFPQDPTSVGQTGPIRLITASVDTHIRIFNLTDGASTSSGGGKPEAVLDGHVSVPRGLDVSLDGKWLISGGRDSVVLLWDLQPSQQPTSKVTKKGGKGKSAGPPPQLVKTVLALERVEAVGFIKHSSKYHQQLHELQFYVGGQKGVVTVRGVEDEQDSFVLGEKRTRALTEEEEEQRQIVNILYSQSTETLVSIHADQNIMIYSLAQQRLKKQLVGFNDEIVDSTFVRSKPTDTSPLLALATNSSLIRVYSPATLDARLLEGHTDIVLALDKSADGTFLASASKDKEVRIWAPRQDPNDESAWGYACVAVCRGHAESVGALAMSRVNEGSGSALKFAFTGSQDRTIKMWDLSEVTATPSNDEIIHCKSLTTHKAHEKDINSLDVSPNDKLLVSGSQDRTAKVYTVDFTRTSSGNRGELRLLGTCKGHKRGVWTVRFCRTNRVLATGSGDKTIKLWSLDDFACIKTFEGHTNSVLRVDFFNAGMQLVSTASDGLVKVWGIQDEECVATLDNHEDKVWALAITPDEGTVVSGGADSMVTFWEDCTEETELEQEQQRAEMVLKDQEFQNYVSLGDYKRAIQLALSLGQPGRLLSLFTNVLSSAGEDEGSNKGSQLLDQVMQTLEAPDFVKLLAFIRNWNASAKTSAVAQAVLHSIVKQRSADEVIQYFKDEAAIKNLTIGPGKVVAPLPSSGDALKEVVEALIPYSQRHLARMERLLQESYVVDFILGEMDSGMFESAVDDDDGMDIDY

SEQ ID NO: 30869 - protein, 103 aa, Triticum aestivum
MSGRGKGGKGLGKGGTKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 30870 - protein, 685 aa, Arabidopsis thaliana
MDVDVDVDVEMDMDMDMYVALVEVEVEVFLLRTQILTESRKGRMITNMKKPNGNVTNVCDRCGGNGHWFHTCRIPKYLVELYKQSLKQDGKNTETNLVSPAHASNAMTIDEPDDHRRRLRARARGHFRQSFELRSAFPTRLHRFDLQSFDKEPTNPVDFGAETLSYEDYYDETRDRYDKAFLMMITYQCDALVDKFNVTPLIIAIRESELQSEDGEVKDTKRPKTHKAEPCNLDGKRAVTIWFSMLKMTMPLSSSLVISFLACHQAGAPRANGRVISCVSGTSSISRNFIYLYCTWNRAVKAVEAILETSDKLEQWSKEPESAIDYLKNVYDKGDNESKALALILFGCWRDFVGEFAPVRICNKGCCLLIGYNPKAKVVVSLRSNASQDDSHILPPNPYECFELGSANVPVYSTEWSDDDPSEDELPIAGKKGKKGKKAKKPRRNWSSTEDVVLISGWLNTSKDPVVGNEQKGAAFWERIAVYYNSSPKLKGVEKRGHICCKQRWSKVNDAVNKFVGSYLAASKQQTSGQNDDDVVSLAHQIFSKDYGCKFTCEHAWRERRYDQKWIAQSTHGKAKRRKCEADSEPVGVEDKEARPIGVKAAKAAAKAKGKAKLSPVEGEETNALKEIQSIWEIKEKDHAAKEKLIIIKDKKNRTKFFERLLGKTEPLSDIEIELKNKLINELLA

SEQ ID NO: 30871 - protein, 496 aa, Triticum aestivum
  misc_feature (66)..(66): Xaa can be any naturally occurring amino acid
  misc_feature (68)..(68): Xaa can be any naturally occurring amino acid
  misc_feature (138)..(138): Xaa can be any naturally occurring amino acid
  misc_feature (262)..(262): Xaa can be any naturally occurring amino acid
  misc_feature (264)..(264): Xaa can be any naturally occurring amino acid
  misc_feature (266)..(266): Xaa can be any naturally occurring amino acid
  misc_feature (274)..(274): Xaa can be any naturally occurring amino acid
  misc_feature (276)..(276): Xaa can be any naturally occurring amino acid
  misc_feature (283)..(283): Xaa can be any naturally occurring amino acid
  misc_feature (299)..(299): Xaa can be any naturally occurring amino acid
  misc_feature (309)..(310): Xaa can be any naturally occurring amino acid
  misc_feature (313)..(313): Xaa can be any naturally occurring amino acid
  misc_feature (332)..(334): Xaa can be any naturally occurring amino acid
  misc_feature (338)..(338): Xaa can be any naturally occurring amino acid
  misc_feature (349)..(349): Xaa can be any naturally occurring amino acid
  misc_feature (354)..(354): Xaa can be any naturally occurring amino acid
  misc_feature (356)..(356): Xaa can be any naturally occurring amino acid
  misc_feature (360)..(360): Xaa can be any naturally occurring amino acid
  misc_feature (365)..(365): Xaa can be any naturally occurring amino acid
  misc_feature (371)..(371): Xaa can be any naturally occurring amino acid
  misc_feature (385)..(386): Xaa can be any naturally occurring amino acid
  misc_feature (390)..(390): Xaa can be any naturally occurring amino acid
MAGTGVFADVLDGEVYKYYADGEWRASASGKTVAIVNPTTRQTQYRVQACTQEEVNKVMDAAKVAXKXWARTPLWKRAELLHKAAAILKEHKTPIAECLVKEIAKPAKDAVSEVVRSGDLVSYTAEEGVRILGEGKLXVSBSFPGNERNKYCLSSKIPLGVVLAIPPFNYPANLAGSKIGPALIAGNALVLKPPTQGAVAALHMVHCFHLAGFPKGLISCVTGKGSEIGDFLTMHPGVNCISFTGGDTGIAISKKAGMVPLXMXLXGKDACIVXEXADLDLVXANIVKGGFSYSGQRCXAVKVVLIMEXXADXVVZKVNAKLAKLKVGPPEXXXDITXVVTESSANFIXGSGBXCXGERXNFLPXVQEKGXLIWPLLLDHVRPDXXIAWXEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 30872 - protein, 362 aa, Glycine max
IRLELVFTIAACFMVELGYAKPDAKEVLKGLFVPGLKGSGATGLAISLLGAMVMPHNLFLHSALVLSRKIPRSVLGIREACRFYMIESAFALMVAFLINICVISVSGTVCNSSNLNAEDQLSCQDLDLNKASFLLRNVLGKWSSKLFGIALLASGQSSTITGTYAGQYVMQGFLDLRLEPWIRNMLTRCLAIVPSLIVAVIGGSAGAGKLIIIASMILSFELPFALVPLLKFTSSKTKMGTHVNSTMISAVTWIIGTLLMAINIYYLITGFIKLLLHSHLKIVAKVFLGILGFSGMAMYLAGTTYLVLRKNKEATHLLALTAPENQQMTNELGNGSIYSLPREDIVSMQLPQRSTPAPADVD

SEQ ID NO: 30873 - protein, 410 aa, Pseudomonas sp.
MATHVAIIGNGVAGFTTAQALRAEGFEGRISLIGNEPHLPYDRPSLSKAVLGGSLEHPPVLAEADWYGEARIDMLSGRSVTNLNVDARTISLDDGSTFAADAIVIATGSRARTLALPGSQLTGVVTLRTYDDVRPLCRGWTPATRLVIAGGGLIGCEVATTARKLGLAVTILESADELLVRVLGRRIGAWLRGLLTELGVRFELGTGVAGFSGDDRLEEVLASDGRRFAADNALVCIGAEPEDQLARQAGLSCDRGVIVDDHGATHAEGVFAVGDAASWPLRDGGRRSLETYMNAQRQAAAVAAAILGKHGSAPQVPVSWTEIAGHRMQMAGDIEGPGEFVLRGTLGDGAALLFRLRDGRIQAVVAVDAPRDFAMAPRLVEARAAIEPARLADFSNSMRDLVRAQQGDSA

SEQ ID NO: 30874 - protein, 126 aa, Candidatus Kuenenia stuttgartiensis
MNIYAGNLARQTTEEELKQVFEEFGQVTSVTIIKDKFSGESRGFGFVEMPSRAEAQAALDSLNGKDLNGRVLNVNEALPRTDDRKQGGGGGRGRSGGGRSGGGGGRSGGGRSGGSGGGRSGGGRPW

SEQ ID NO: 30875 - protein, 674 aa, Synechococcus sp. WH 8102
MCGIGGVFLADRHQTLDRQLLVNMAAIQSHRGPDGFGVECLDAAGVGFCHARLSIIDLNESRARQPFLSNDRQVLMAHNGEFYDFQRIRADLTAQGVRFSSKSDSEILLRLYQRQGLESTLPLLRGEFAFALFDAADDCLYLVRDRFGIKPQYWTMTPEGLVFGSELKVLFAHQAVERRFTSEGLFHQLMQTMVPGTTAFAGVHQVQPGHVLKVQRRSDRLEVSESTYWDVDFPRLDQRDSTLTEADHIANVRAALLEAVEMRMVADVPVGCYLSGGIDSCSILGLASAVSQGPVKAFTIGFDDARYDETPIAAEMAEATGAEQDVMRLSGRELYGHMEQTLWHTERTIYNTLAVAKYLMSRHVNSVDYKVVMTGEGSDELFGGYPAFRRDMFLHGLEDLPQSDRQDWESLLQTNNSLVQGAMLAADQVDDPDLDAVVGFTPSCLQPWLACAPLVPDLLADEHRQALVEYSPGKAIAEQLNPQQLDGRHALDKAQYVWIKTMLEGQILTWGGDRVDMANSMEARPAFLDHHLAAAAVQVPPELRIKGKTEKYVLREAMAGLLPEVLYKREKFAFMAPPAHTEPEKWAQMKQLADDYLSDEAIDAAGLLSKEGVRALFARHDDPATTDAERVQMDAVINHLLGVQMLHRMFVAADVPAQAREQADRLGWRVLMPV

SEQ ID NO: 30876 - protein, 2047 aa, Oryza sativa (japonica cultivar-group)
MADPFVADDQTDADFFDKLVDDDDDLSPAPAPAPVPAQQSAEAALLPALSDLSLADDDTDPSPAPPPVEAPPEGASPESGKGAVHTTVKQVQWASFGGAADDGADPFSDLSGGAADDGFLGTMAGNQSFQTSVIGSVGASAHGIFGGSQSLTAEVTDQDFFGGTSDQNTDTQQQQLEQSGSSAFDSTDPKYLESIYPGWKYDEATQQWYQVDNSDTHGNATQVDTSTENIQQQQLAASYMHNPTQSSLETIAEEGTTTGSVSTWGQGGTSEYPPNMVFYAEYPGWYFDTNTQQWQSLESYQQAVTASAVQDGANNGVVASSAETNYSVKQTEDLPAHNQVAQHNSFSNNYSYQSQWQTNSFSNSMQPESATASLPDSFQSLGQHAISESFNSSTNSQVSFNTAETATSHYGNVNLDSSSTQGGYTASGGQQTGYKGFEPFTGHQAGYKGFEPSTGHQTSHKLFDPSAGNQNSYKPFEPSTGHHQHKGFEPSTNHQGDYKAFEPSTHNQGGYKGFSPSTVQQPGYKGFEASTGLQTNFKGFEPYSGQQAGYTGSLPSTGHQSSYMGFETSSNQGYGDANNVANSQGFVPMESMYGSHNQAHTNPQVPLSNSYLSVDNSKNFSQQQFLGPNASHLQFGQSPHEERSSAGRPPHALVAFGFGGKLILMKETNSMATNYDSGNQGNSSGTVSVLNLSEVVTDKADALSASNGSALSYFHALCRQPVPGPLVGGSAASKDVNKWLDDMIALYESSTSEFQRGDPRKLLISLLKILCHHYGKLRSPFASDPSHEDTDGPEMAVTKLFSSCKRSSFQMGDFGSHVRCMKNIPSENQMQAVAQEVQNLLVSGRRKEALQCAQEGQLWGPAIILALQLGDKFYVDTVKKMAHCHFLSGSPLRTLCLLIAGQPADVFNADNNISSNYGSQQPMEPSPNGMLDDWEENLAIITANRTKGDDLVITHLGDCLWKEKNEVAAAHSCYLVAELNIDPYSESARLCLLGADHLKCPRTFASPEAIQRTEIYEYAKVLGNSQYILLPFQPYKLIYAYMLAEVGRVADSLRYCQASMKVLKASGRAPELEAWKQLFSTLEDRIRTHQQGGYGTNLAPAKLVGKIFTSLDKSISRMMGTPSAPLPPLPQGAVSDRESYTAPGATKFANSQSVMTMSSLMPSASVQSMSEMSDSGRKIAHNRSVSEPDFGRTPKQGAGSDSTQSTAPGSGSSRFGWLGSTLQKTMGFVSKSHRQAKLGQQNKFYYDEKLKRWVEEGAEIPAEEPPLPPPPSKPSFQNGVVDYKLNGPMSASHTPNGFMEGKSSTSSEHGSGMPPIPPSQNQFSARGRMGVRSRYVDTFNKGGGGGAVPSYNKPAVASVTPPSGAKFFVPTAAVVAAEQMPNQTAETHGETFRPDERSSPAETSFSSPPPATQFSAPLMVPTIQRYPSMDNITTPNNGSGLSSGSNSSSFSRSRAASWSGTYSEQINAVAGARSPDQQTMPSPLMPGKQSHSRSNSNSSVQFNSLTEDLHELRTLRDALDYDRSALVRYFSAASASFPTKGGAAAGVEKRIGGARFPQCKQPGKELETFKVSLGGLNGRYACRRAPNNCIPTTITGLNGSLSCGQVSSARSFSSSADLPPHQEIGMPSLSPTMTEGNIARWLKKEGDKVSPGEVLCEVETDKATVEMECMEEGYLAKIIHGDGAKEIKVGEIIAVTVEEEGDLEKFKDYKPSTSAAPAAPSEPKAQPEPAEPKVKETEPSRTPEPKAPKTEEASQPGGRIFSSPLARKLAEDNNVPLSSVMGTGPDGRILKADIEDYLASVAKGGKREALAAPGLSYTDVPNTQIRKVTANRLLSSKQTIPHYYLTVDARVDNLIKLRGELNPLQESSGGKKISINDLVIKAAALALRKVPQCNSSWMSDFIRQYHNVNINVAVQTEHGLFVPVIRDADKKGLGTIAEEVKQVAQRARDNSLKPEDYEGGTFTISNLGGPFGIKQFCAIINPPQSAILAIGTAEKRVIPGSVDGQYEFGSFMSATMSCDHRVIDGAIGAEFLKAFKGYIENPNSMLL

SEQ ID NO: 30877 - protein, 123 aa, Glycine max
  misc_feature (16)..(16): Xaa can be any naturally occurring amino acid
MAKFGEGDKRWIVADXPDGTNVHNWHWAETNCLEWSRTFFKNSFTNVAVGGGDGDATITIKKVEKLDGEAYVNVRKGKVIPGYEISVRLAWEGEARDANGKVLQRVDGAVEIPYISDENGRED

SEQ ID NO: 30878 - protein, 324 aa, Zea mays
MYVARESTKLWRRVCAETTAELQLLFEKWQLLLAGLVFQYIHGLAARGVHYLHRPGPLLQDLGFMALPELGQEKGYLSESLFTFIFISFFLWSFHPFVYHSKRFYTVLLWRRVLAFLVASQFLRIMTFYSTQLPGPNYHCREGSKLATLPPPNNALEVLLINFPRGVLFGCGDLIFSSHMIFTLVFVRTYHKYGSNRLIKLLSWLMAIIQSLLIIASRKHYTVDVVVAWYTVNLVVFFVDKKLPEMPDRTNGLSLLPVSTKDKDGRMKEELHKLEKDGRMMDEFHKLLNGNTVDATDWRQRVQMNGKHGEDTNHTVSDATPTGT

SEQ ID NO: 30879 - protein, 368 aa, Burkholderia xenovorans LB400
MKTKAAIAWKAGAPLTIEEVDLEGPRAGEVLIEVKATGICHTDYYTLSGADPEGIFPAILGHEGAGVIVDTGPGVGTLKKGDHVIPLYTPECRQCKFCLSRKTNLCQAIRSTQGKGLMPDSTSRFSIDGKPLFHYMGTSTFSNYIVVPEIAVAKVREDAPFDKICYIGCGVTTGVGAVVYSAKVEAGANVVVFGLGGIGLNVIQGAKMVGADRIIGVDINSGRVELAKKFGMTHFINPTEVENVVDHIVQLTDGGADYSFECIGNTKVMRQALECTHKGWGQSFIIGVAAAGEEISTRPFQLVTGREWKGSAFGGARGRTDVPKIVDWYMEGKINIDDLITHRLPLERINEGFDLMKKGESIRSVVLY

SEQ ID NO: 30880 - protein, 657 aa, Staphylococcus aureus subsp. aureus MW2
MAKETFYITTPIYYPSGNLHIGHAYSTVAGDVIARYKRMQGYDVRYLTGTDEHGQKIQEKAQKAGKTEIEYLDEMIAGIKQLWAKLEISNDDFIRTTEERHKHVVEQVFERLLKQGDIYLGEYEGWYSVPDETYYTESQLVDPQYENGKIIGGKSPDSGHEVELVKEESYFFNISKYTDRLLEFYDQNPDFIQPPSRKNEMINNFIKPGLADLAVSRTSFNWGVHVPSNPKHVVYVWIDALVNYISALGYLSDDESLFNKYWPADIHLMAKEIVRFHSIIWPILLMALDLPLPKKVFAHGWILMKDGKMSKSKGNVVDPNILIDRYGLDATRYYLMRELPFGSDGVFTPEAFVERTNFDLANDLGNLVNRTISMVNKYFDGELPAYQGPLHELDEEMEAMALETVKSYTESMESLQFSVALSTVWKFISRTNKYIDETTPWVLAKDDSQKDMLGNVMAHLVENIRYAAVLLRPFLTHAPKEIFEQLNINNPQFMEFSSLEQYGVLTESIMVTGQPKPIFPRLDSEAEIAYIKESMQPPATEEEKEEIPSKPQIDIKDFDKVEIKAATIINAEHVKKSDKLLKIQVDLDSEQRQIVSGIAKFYTPDDIIGKKVAVVTNLKPAKLMGQKSEGMILSAEKDGVLTLVSLPSAIPNGAVIK

SEQ ID NO: 30881 - protein, 214 aa, Zea mays
MESFVQKHVVGVPLTSFAYADEERRGKPSCSAMVHKKNKKGSFICWMNKLSHKTDNYMQGFKEHLSLGPKVSETIKGKLSFGAKVLQAGGIDKVFREYFAVEEDEKLLKAFQCYLSTTAGPIAGMLFISTKKIAFHSDRPLNLLSPKGGRTRVPYKVLIPTKRIKSASVRGNLYNPDEKYIDVVTVDGFDFWFMGFVSYEKSFRYLQNAIVELR

SEQ ID NO: 30882 - protein, 469 aa, Burkholderia xenovorans LB400
MQSNAVHPCDQRLPAGQLLTLGIQHVLVMYAGAVAVPLIIGAALKLPKDQIAFLISADLFSCGIATLIQTLGLWIFGIRLPVIMGCTFAAVGPMVAIGTNPSLGILDIFGSTIAAGVVGILLAPAVGKLLRFFPPVVIGVVISVIGLSLMEVGINWAAGGVGNPDYGNPVYLGLSLIVLMLILLINKFARGFLANISVLLGIVAGFVIALALGRVNMEGVTHAPWVGFIMPFHFGLPHFDPLSIATMVTVMFVTFIESTGMFLAVGDMVDRPVDQKTLVRGLRVDGLGTLIGGIFNSFPHTSFSQNVGLIGVTGVKSRFVCAMGGVILVLLGLFPKMAQVVASVPAFVLGGAGIVMFGMVAANGIKVLSKVDFVKNHHNLFIVAVSIGLGLVPVVSPHFFSKLPPALSPLLHSGILLASVSAVVLNLIFNGVKSEKKARCEIRSAGHDFDGRGGNEPRRDEMLRAADLH

SEQ ID NO: 30883 - protein, 288 aa, Escherichia coli K12
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAIHTAAFALPQYLQDALASQPS

SEQ ID NO: 30884 - protein, 524 aa, Aspergillus nidulans FGSC A4
MTPPSVSPIPSQVSSAATSQISSDHGERQVTQALAGMNLSALNGDAALPHSVKPPKQTMANRISRMFTGTGRSTPKEPESSRELSDSSSDGGKPTTNGSGKQSRPTSRPSSKPPSRAPSRQTSTKEVPKSEKNEKNEKTDRKAKPAGKDQKEGSTVQKRFEILPDNSHRHHLKSTRRQEKLTDLLRDMLGGRKKDDHAEDQQLSLMSTWIDQFKSERDKLAADKKGGPNATASLVDKYGKCQEIVGRGAFGIVRISHKVDPKDSKSEQLYAVKEFRRRPQETSKKYQKRLTSEFCISSSLRHPNIIHTLDLLQDAKGDYCEVMEYCAGGDLYTLVLAAGKLEVAEADCLFKQLMRGVEYMHEMGVAHRDLKPENLLLTTHGALKITDFGNGECFRMAWEKEAHMTAGLCGSAPYIAPEEYVEKEFDPRAVDIWACGVIYMAMRTGRHLWKLARKEEDEFYRRYLEGRKHEDGYAPIETLHRARCRNVVYSILDPNPSRRINSSQILKSEWLREIKLCQAGEEGF

SEQ ID NO: 30885 - protein, 220 aa, Escherichia coli K12
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLGEMPQERRLDTLCELNVMEQVYNLGHSTIMQSAWKRGQKVTIHGWAYGIHDGLLRDLDVTATNRETLEQRYRHGISNLKLKHANHK

SEQ ID NO: 30886 - protein, 502 aa, Propionibacterium acnes KPA171202
MTHTTQRSHEDNPQGPKVSVTRDDPRAATIEEIQPIVDRGDQGYAETLTNRQVQMMAIGGAIGVGLFLGAGSRLRSAGPAVLISYAFCAVIAFLVMRALGELVIHRPSSGSFVSYARELLGDRWAYAVGWMYMLNWMTSGIAELTAIGTYLQFWWPSLPMWVPSLVALMILVSVNLISVKAFGEFEFWAALLKVVALTAFIIVAIGLVASHVNVGGHRAAVSNLWRFDGGFAPQGVLPLILVIQGVIFAYATIELVGTASGETQNPRKVIPKAVHAVVFRLVVFYLGSLALLAMLLPYKEYSADESPFVTAFSAMGVGWIGDAMNIVVITAAFSSVNSGLYATGRVLKSLAAAGEAPKFAGTLNRFKTPAGGILMTASVFLLGVGLEYVVPERAFEISINTAAVGVIWTWATIFWCQLVLRRRVNEGRITDSGFHMPGYPITGIFGIVSLAGVTALMVLDPQNRIVLAAALVYIAVMLVAWPAVKRNKARHPELNAQEDITF

SEQ ID NO: 30887 - protein, 338 aa, Triticum aestivum
  misc_feature (153)..(153): Xaa can be any naturally occurring amino acid
MASPPRHLLPLLLLLALLGTSSAAAAPGVIRLPRAGACATPADPAVYDRPVIGIVTHPGDGAAGRIDNGTSTSYIGASYVKFVEAGGARVIPLIYNEPDERLLEKLSLVNGVLFTGGSVKRGPYFETIKKVFQYVLDKNDAGVPFPLFAQCLXAFELVSMIVSKDNNILESFHASDQASTLQFPNYSSLQGSVFERFHPDLIQKLSTSCLVMQNHKYGISPKRMRENDALSSFFKILTTSPDENGEVYISTVEAQKYPITCTQWHPEKAIFEWGKPMIPHSEDAVQVTQNFANYFISQARKSPNRPPADKVLDNLIYNYSPTFSGKTSKSFELVYLFS

SEQ ID NO: 30888 - protein, 360 aa, Synechococcus elongatus PCC 7942
MAVRKLGVLTSGGDCPGLNAVIRAIARHAVGNYGWELWGIAYATQGLLKRQAIALSPHHFDRQSLDPLLCSGGTILGSINRGDTLAHQAEILAGYQELGLDALIGIGGDGSLAILRQLAEAGRWQFIGIPKTIDNDVALTERAIGFDTAIHTVAEALLSLGSTAASHDRIMIAEVMGRQSGHLALQGGIAGGADVILLPEIPYRLLELCHYLQQLRDRWQRRYAVIAIAEGTHHPPEVTQGPGSLGEQLVQAITAQDPTLDARVTVLGHVQRGGNPVASDRLLATQMGYAAVERLAAGASGEMMAWQGGRVVSVPLEAVCLQSPTLVDPHSPLVDTAAGLGIFLGDRSLTPWRGSACPTH

SEQ ID NO: 30889 - protein, 549 aa, Oryza sativa
GTRRHTTRPSLLLLLLRRCRRRRWCPRRRRRAVARARTLLCVPATARAPREMAAELAAAAALGADVAELRLDRLAGFAPRRDLPVLLAQPRPLPALVTYRPKWEGGEYEGDDEPRFEALLLAMEMGAEYVDIELKVADKFMKLISGKKPETCKLIVSSHNFENTPSTEELENLVAQIQATGADIVKIATTATEIVDVAKMFQILVHCQEKQVPIIGLVMNDRGFISRVLCPKFGGYLTFGSLEKGKESAPAQPTVTDLINVYNIKQIGPDTKVYGIIGKPVGHSKSPILHNEAFRSVGLNAVYVPFLVDDLANFLNTYSSPEFAGFSCTIPHKEAAVRCCDEVDPIAKDIGAVNTIIRKPNGKLVGYNTDYVGAISAIEDGIRASQPTDTTTSPLAGRLFVVIGAGGAGKALAYGAKEKGARVVIANRTFARAQELGNLLGAPALTLAELENYHPEEEMILANTTAIGMHPNVNETPLSKQALKSYAVVFDAVYTPKETRLLREAAECGATVVSGLEMFIRQAMGQFEHFTGMPAPDSLMRDIVLTKIQ

SEQ ID NO: 30890 - protein, 780 aa, Salinibacter ruber DSM 13855
MAQDDLRRELGFWDALTIGAGTMIGAGIFLLAGVALELTGPAAIFSYLAAGIVCMITAASAAELATGMPTSGGDYFFVSRSLGPALGAISGVGIWLSLTFAISFYLFGLGEYLSQFLPLTPFWGAFAGGLLLTAINVYGAKESGQMQVIVVLTLMGILGAFCGIGAFYIEWSNFTPFFPFGGAPVASTTALVFVSFLGFVKIAAVAEEIKNPAKNLPRTLIGSVALVTLLYVVILLVIGGIFEQETIGEVRDPLTQAARTLAGPIGAGAIIFAGLLATVSSANASIMASSRINLAMARDRMVPNWLSAIHETLLTPHRAILLTGVLALAFLFIESLEQLAKIASVLQLYSYAALNVGCVALRVAQPDWYEPSYRTPGFPFVQGLAALACIGIILYSGPFAQIAIVVLILASLGWYYVWGRSRVEIEHAVPEFREQWAAQGWSALAAPAPEFAVQVPEVLSAAERAVDADGPRRVSVALANPEHEHDLLQLGRYIATGRTEGGHVAGIHLVDVPLQTPLRSARAQFTERPSLERAIADLPQEAAARPSTNDLDHTPLEATDIESVIDVAHDVFGGLIDETQAQTSDMLLMGWQGGFNVGRIYNSPIQRIVSDLPADLGVLKDRGFDSVDQILLPWGGGLHAQLGLEIAVRVARITDATVHLLRVVREDVDVEDEKAALDDTVQGLVDTDRVEYLVRQSDSVTGGIDATLTEADYDFAIIGASREWSLRQVLFGSIPDVVADRADCSVLMVRRYVPNTLSVRAVEGVKRLKETVGLTTSPEE

SEQ ID NO: 30891 - protein, 1245 aa, Arabidopsis thaliana
MASQMPFTTISRKISCMKLLPLCPLQLSTTQTPTTIPMSLSFYKNELSDDTPCQSGYTDYISFQVPDETFPEISNCIGIAKGYKQNSNNEKNGYTSLEAVLLSVPNGYTCVDLSLYKDKELVLLLNKTNTDSEGSGEACMMVVQTGDLAFISISGSSSLNQWELEDLKVLLISSINIDGSIVNLEMENEKVRKVPHSVIAPLAVSASRGVACVFAERRRALVYILEEDEDEEISDENSTKEARRNSLSFSKLYATVTEVVLFCLMENDQFMCPTDIITGIVFIDGELAMLTLTADGELRWTEYGLRQYLSMKKDVLGFIVEGKQIRVKAVVEKEAGGICCGQFGGDFVRKDFVFEPLIDQNGWCYKLRQYLDSLGRPKRLLVFVNPFGGKKSAREIFVKEVKPLFEDADVQLEIQETKYQLHAKEFVKSMDVSKYDGIVCVSGDGILVEVVNGLLERADWRNALKLPIGMVPAGTGNGMIKSLLDTVGLRCCANSATISIIRGHKRSVDVATIAQGNTKFFSVLMLAWGLIADIDIESEKFRWMGSARIDFYVCLVDKFDNYCIAVVKLLALQRIICLRRYNGRILFLPAPGFEGYGQPASCSLYQEPHVSDKEVGYQGPETKFEDLEWREMKGPFVTIWLHNVPWGSENTLTAPAAKFSDGYLDLIVLKNCPKLVLLSLMRQTSSGTHVESPYIVYIKLTVEKVKAFVLEPGALVDEPDKEGIIDSDGEVLARGKRTYKCDQKALMSYDKLQVTVDQERLFCKFCISQRELVLAKLSPTTKLVSLHLAMDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGRTRSLDVATISQGTTKFFSVLMLAWGLVADIDIESEKFRWMGSARFDIYGLQRIICLRQYHGRILFVPAPGFESYGQRASCSIDKEPSGSDKTLVYQGPDSKLENLDWREMKGPFVSVWLHNVPWGAENTLAAPDAKFSDGFLDLIVMKDCPKLALLSLMTKLSDGTHVQSPYASYLKVKAFVLEPGARIDEPDKEGIIDSDGEVLARGRKSYKCDQKALMSYDKLQISVDQGLATLFSPE

SEQ ID NO: 30892 - protein, 408 aa, Oryza sativa (japonica cultivar-group)
MASMAARSSRKRRSPPPRGLGDLHDDVLERVLARLPPATFFRLRAVCRRWSAAAASPTFLRACARVPSRDPWFLMLSGARPRPPLAFDAAGRSWIPCRAAPGGSDGGADAAVPVASSGGLVLYRAPGTGELLVANPLTGASRALPSPPGAHGGAPRLHAIAMYGSPYRVALFADELPDLSMSVFDSSRGSWEGPVALSRRPDAAALLPDDAPSQGGADDTVYFLSKSGDVVATNMQRSASKQYSSVVVAASSDGGDAVAYFLSHSGTVVACDTARRTFAELPRILPVYFEYSIDVVACDGAAYAVVLAEYLDTASLRVWGFAGGAWRQVAAMPPAMSHAFHGKKADINCVGHGGRLMVCVSSGEANGCFMCDVGSNQWEELPKCVNGDGEVNDFLAAFSFEPRLEISV

SEQ ID NO: 30893 - protein, 575 aa, Parvularcula bermudensis HTCC2503
MARILVTSALPYINGVKHLGNLVGSMLPADVYARFMRARGHNVAFLCATDEHGTPAELAARKAGQPVAEYCAAQHETQASLAAAFGLSFDHFGRSSSPTNHELTRHFADRLEAEGYLEERVSQQVYSNADARFLPDRYVEGTCPNCGFEKARGDQCDNCGKLLDPTDLIDPYSAISGSKDVEMRDTRHLYLLQSKLEGEVRAWVDTHKDWPLLTRSIAYKWIDEGLRDRSITRDLDWGIPVRRDGFEGKVFYVWFDAPIEYIAATKEWDPEGWESWWRTDQGADEVTYVQFMGKDNVAFHTVFFPCTLIGSREPWKRVDHLKSLNWLTWYGGKFSTSEGRGIFMDQAIDLMPADTWRWYLMANAPESDDTAFTLQSFAGAVNKDLADVLGNLVNRVTRFTASKFEGQVPPGGEPGEAEQTLYREVDDRCAALTGALEAMEFRKAFAALRGLWAAGNEYLQVTAPWTAFKTDPDAAAVSVRTALNLIMLIAEVSAPVIPETADKILGIFGRQGEEPPAWPTGPAAQLLTRVQPGTPVPAPEVLFKKIEDEQLAEWAVRFGAPSAGETGETAETAGD

SEQ ID NO: 30894 - protein, 743 aa, Synechococcus sp. WH 8102
MSDGPRSVRSQCPYCGVGCGLELLPPAVKGQAVKRDAEGNPMWTARGDREHPSSLGQVCIKGATVGETLARGRLRQPLFRSKLTDAFAPISWDDALDKITGQIKASLARRGNADGIAMYGSGQFHTEDYYLAQKLLKGALGTNNFDANSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRDNGQDPAFIDNHTENYDAFFDVAARWTPRRVALFCNIPEKRLRDVAALFHRRQKVLSLWSMGVNQRREGTAVVQGLINLHLLTGQIGNEGAGPFSLTGQPNAMGGREAGGLAHLLPGYRLVANPEHRAEVEQAWKLPAGQIAAKPGLAAWQQVEAMERGDLDLWWVAATNPLVSMPDLDRVKQAMGNCPLVVVSEAYADSETSHYAHLLLPAAQWSEKAGAMTNSERRVTFCPAYRLRFGESRPDWEVFADVGRRLGYTEQFRFDSAAEVYAEFTRLTQGRLCDVSGLSHELLEQAGPQQWPYPMGSIPSTAAKRLYENHLFATPSGRARFSTDQPLGLAEPPCDTYPLVLTVGRYLGQWHTMTRTGKVERLMKQHPEPLLEIHPSDAQELQLRNGELAAISSRRGHLTATVKVTDRIRCGTVFLPMHWGFTQEKACEANTLMHDDACPVSKQPELKACAVIVAPAVSVVKPVEQEKGRLEALRRLLTPALR

SEQ ID NO: 30895 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMNEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEVHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 30896 - protein, 478 aa, Xylella fastidiosa Dixon
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGMPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 30897 - protein, 126 aa, Staphylococcus aureus subsp. aureus MW2
MKIINTTRLPEALGPYSHATVVNGMVYTSGQIPLNVDGEIVSADVQAQTKQVLENLKVVLEEAGSDLNSVAKATIFIKDMNDFQKINEVYGQYFNEHKPARSCVEVARLPKDVKVEIELVSKIKEL

SEQ ID NO: 30898 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 30899 - protein, 504 aa, Zea mays
  misc_feature (149)..(149): Xaa can be any naturally occurring amino acid
MADHQPQVEVLTESVRVNGTKAEATLVGGELAWRPAAGGNGEGQERRLELESEVLGFQMDGRQLKFATFAASGGGDGKGGGGDGNRRRGEVEMEMENEATAVRWGDVISDRLASLGRPKKLFIIVNPYGGKRSGPSIFQNEVLPLIEAXGVLYTMQETKHRLHAQEIAHSLDLRKYDGIICVSGDGVMVEVVNGLLQREDWEAAIKVPLGIIPAGTGNGMARSLLHAAGEPFSISNAVFAIIRGHKRALDVTSVVQGKARFFSVLMLTWGLVADVDIESEKYRWMGSARLDFYLLLRILNLRRYNGRILFVPAPGYEEVGDPVDQATGYETNGFSTGFQDDGRTGSNGETCGYVGPSSIKEAGLRWRSLDGPFVSVWLGNVPFASEDAMAAPKAEFADGYLDAAIIKDCPRWDVLGLVFQMKDGSYVNSPCVEYFKVKAIRIEPGLRVGSSTEAGIIDSDGEVIARGDESDSRAGDDEPGHLMAYAPPIQLTVDQGLATMLSLR

SEQ ID NO: 30900 - protein, 117 aa, Arabidopsis thaliana
  misc_feature (80)..(80): Xaa can be any naturally occurring amino acid
MASSMLSSATMVASPAQVTMVAPFSGFKESVAFSVTRKVNNDITSIISNGGIVNCMQVGPPIGKKKFETLSYLPDLNDSXLAKEVDYFIREKRVPLGGTCRGGMEFEHREARVLTPE

SEQ ID NO: 30901 - protein, 141 aa, Ralstonia metallidurans CH34
MAIERTLSIIKPDAVAKNVIGQIYARFEAAGLKVVAAKMVHLSRGEAEQFYAVHKARPFFKDLVDFMVSGPVMIQALEGESAIAKNRDLMGATDPKKAEKGTIRADFADSIDANAVHGSDAPETAAVEVAFFFPGMNVYSR

SEQ ID NO: 30902 - protein, 266 aa, Escherichia coli O157:H7 EDL933
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDINVQLHTVIAQYPGAELETKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 30903 - protein, 305 aa, Triticum aestivum
  misc_feature (128)..(128): Xaa can be any naturally occurring amino acid
  misc_feature (139)..(139): Xaa can be any naturally occurring amino acid
  misc_feature (212)..(212): Xaa can be any naturally occurring amino acid
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGXSPADLALIRMXQADSTLPAAQRRHYKNAFHALYRITADEGVLALWKGAGPTVVRAMSLNMGMLASYDQSVELFRDKLGAGRISXTLLEASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 30904 - protein, 87 aa, Volvox carteri f. nagariensis
QGEDQKKLDVVSNEVFKNCLASCGRTGIIASEEEDQPVAVEETYSGNYIVVFDPLDGSSNIDAGISVGSIFGIYEPSEECPLDAMDD

SEQ ID NO: 30905 - protein, 502 aa, Arabidopsis thaliana
MAESTKSKKLSVRLLIDELKNKVVLAESGKDFVDVLFSFLALPMGTIVRLLEKHQKSPQVGIGCFNNLYKSVSEMDLESFQTEACKQVLLYPRSVNLEKFRNMKLKIDDTRAVKYFVCSGFKESCRHHYSISNTEECECGEIVDSKVVKRVMNREIKGLEEEQVQGRILRKDNDGVFFSCKASSFIITDDLKVEASSMDNVLNTLRGLGYADTSKLSEILLHVGVSEVLTLLECFFTSDLPLTDTFLKKQSSLQMIRSRIPLSPTLQGSGDGAVPGQTITFKAFVRKPNIKILCVECGADFIDLLFTFLALPLESVWNISAGNISLGCIGNLFRSFKRIDASSSSKTKLPSFYSCPKQLLDVVTEQQEIYCSFKCVVETNNEYDFKFTRKMPPRPNSLKEKNQNMFFTNKTSVLYLTSFGFMKQNTRFLVTDDLVIKPKNLVSNISLLKLNMHLDKEDVEEHVITIGKLEAISLLRASLMTSSALTSSFWSLISKKAKAETQ

SEQ ID NO: 30906 - protein, 406 aa, Brucella melitensis 16M
MSEEFHKIRRLPHYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 30907 - protein, 472 aa, Shigella flexneri 2a str. 2457T
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 30908 - protein, 347 aa, Coprinopsis cinerea okayama7#130
MSGTSKSSQPRTLSTAEGFICGGIAACIAVTVSNPAEVAKTRLQLQGELAKGGGVRVYNNSLDVLKKTWRNEGIRGLQRGLGPAYVYQILLNGSRLGFYEPFRLAANSLLGWAPSDQVVMTSVFAGASSGAVGATLGNPLFLVKARMQAYSPSLPVGTQHKYRSSLHALSTIFKAEGPRGLVRGVDAAILRTSMGSSVQLPSYNFTKRTLVKNNILPENSTWTFLVSSAVSGACVLVVMQPADTALTRVYNQPTVIGPDGRVRGALYKNPLDCLWKTFKTEGVRGWYKGSTAHFMRIAPHTYEFIVVLTCAEADFGPCRIITLTANDIILNLYKKAKFGHLDQDADS

SEQ ID NO: 30909 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMNEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 30910 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGINTFGASA

SEQ ID NO: 30911 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELDSQGEKIRVVSMPSTDVFDKQDAAYKEEILPNAVRRRVAVEMGASQNWYKYVGLDGAVLGIDTFGASA

SEQ ID NO: 30912 - protein, 856 aa, Populus nigra
MMSSLQKPFSMFLRVLFFLLLMCIIPSFFAFPSNSSATSFGAAKYEAAEGNEEAEALLKWRASLDDSHSQSVLSSWVGSSPCKWLGITCDNSGSVANFSLPHFGLRGTLHSFNFSSFPNLLTPNLRNNSLYGTIPSHISNLTKITNLNLCHNHFNGSLPPEMNNLTHLMVLHLFSNNFTGHLPRDLCLGGLLVNFTASYNHFSGPIPKSLRNCTSLFRVRLDWNQLTGNISEDFGLYPNLNYVDLSHNNLYGELTWKWGGFNNLTSLKLSNNNITGEIPSEIAKATGLQMIDLSSNLLKGTIPKELGKLKALYNLTLHNNHLFGVVPFEIQMLSQLRALNLASNNLGGSIPKQLGECSNLLQLNLSHNKFIGSIPSEIGFLHFLGDLDLSGNLLAGEIPSEIGQLKQLETMNLSHNKLSGLIPTAFVDLVSLTTVDISYNELEGPIPKIKGFIEAPLEAFMNNSGLCGNANGLKPCTLLTSRKKSNKIVILILFPLLGSLLLLLIMVGCLYFHHQTSRERISCLGERQSPLSFVVWGHEEEILHETIIQAANNFNFNNCIGKGGYGIVYRAMLPTGQVVAVKKFHPSRDGELMNLRTFRNEIRMLIDIRHRNIVKLHGFCSLIEHSFLVYEFIERGSLKMNLSSEEQVMDLDWNRRLNVVKGVASALSYLHHDCSPPIIHRDISSSNVLLDSEYEAHVSDFGTARLLMPDSTNWTSFAGTLGYTAPELAYTMRVNEKCDVYSFGVVTMEVIMGMHPGDLISFLYASAFSSSSCSQINQHALLKDVIDQRIPLPENRVAEGVVSIIKIAFACLLANPQSRPTMRQVASELIARWPPLPKSFSAITVEDLMPQTTVTG

SEQ ID NO: 30913 - protein, 338 aa, Candidatus Kuenenia stuttgartiensis
MSGSKIITVQRHIIEQERDHPEATGELTGLLWDLTIAAKIISREVNRAGLADILGLTGQENIHGEEVKKLDEYANDVIIKSMDHGGHLCVMASEENEDIIPIPDQYPKGKYMLMFDPLDGSSNIDANVSVGTIFSIYRRKTTAGNGTLEDCLRKGVEQVAAGYIVYGSSTMLVYTAGHGSHGFTLDPGIGEFLLSHKNIQIPSRGKIYSINEGNTNTWDEGTRKYINDLKKVTPETGQKPYSLRYIGSLVADFHRTLLYGGIFLYPADYKDPNKPKSKLRLLYEAAPLAFIVEQAGGKASTGDTAIMEIKAEQLHQKTPLIIGSKEDVEKYEGYFKNK

SEQ ID NO: 30914 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHTAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 30915 - protein, 148 aa, Triticum aestivum
  misc_feature (105)..(105): Xaa can be any naturally occurring amino acid
MAAAEPSGSSQPGAPGRWSLHGKTALVTGGTRGIGRAVVEELAALGVAVHTCSRKEAELGERLKEWEARGFRVTTSVCDLSVREQRERLIADVAERFGGKLNILXIVFISSVCGLVAVFSGTLYAMTKGAINQLTKNLACEWAKDGIR

SEQ ID NO: 30916 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVISMPSTDVFDKQNAAYKEEILPNAVRRRVAVEMGASQNWYKYVGLDGAVLGIDTFGASA

SEQ ID NO: 30917 - protein, 386 aa, Synechococcus elongatus PCC 7942
MTAVSEFRPGLEGVPATLSSISFVDGQRGVLEYRGISIEQLAQQSSFLETAYLLIWGHLPTQQELTEFEHEIRYHRRIKFRIRDMMKCFPDSGHPMDALQASAAALGLFYSRRALDDPEYIRAAVVRLLAKIPTMVAAFQLIRKGNDPIQPRDELDYAANFLYMLTEREPDPVAARIFDICLTLHAEHTINASTFSAMVTASTLTDPYAVVASAVGTLAGPLHGGANEEVLDMLEAIGSVENVEPYLDHCIATKTRIMGFGHRVYKVKDPRAVILQNLAEQLFDIFGHDPYYEIAVAVEKAAAERLSHKGIYPNVDFYSGLVYRKLGIPSDLFTPVFAIARVAGWLAHWKEQLNENRIFRPTQIYTGSHNLDYTPIADRDLAIESD

SEQ ID NO: 30918 - protein, 162 aa, Brassica napus
VDPRVRLLQPEFVDPLNQTAMACPAFPLCPLAITEAERGIPSILKRVRAMFEKVGLEYDESVVVRVTGCPNGCARPYMAEVGLVGDGPNSYQVWLGGTPNQTQIARAFMDKVKIQDLEKVFEPLFYNWKLGRQAKESFGEFTTRMGFEKLKELISAYEGSPQ

SEQ ID NO: 30919 - protein, 265 aa, Triticum aestivum
  misc_feature (257)..(257): Xaa can be any naturally occurring amino acid
MAERNLSQIISQLKHSPSMSYTDANALLSKAKLALLKLNALTPSPSTPTQLLPLARETYEQGALFAIRARNPEAFTRYVQQLQPFYELPASVLPPNLLERNKVTGLSLLLLLTQGRYGEFHTELESLENREGGGGDVESDRYLGYPIRLERWLMEGSYDRVWKAMKSSEVPCDEYSVFSEILKNQIRSEIASSSERAYPSLPISSTKSLLFLDSEGDVISFAHHRGWIVRDGHIYFPDAAEGENGDQNKEMSQMVIXDALGYARE

SEQ ID NO: 30920 - protein, 120 aa, Triticum aestivum
ATYHYYRPAQNNWDLGAPAVSAYCATWDASKPLSWRSKYGWTAFCGPAGAHGQASCGKCLQVTNPATGAQITARIVDQCANGGLDLDWDTVFTKIDTNGIGYQQGHLNVNYQFVDCRDNN

SEQ ID NO: 30921 - protein, 397 aa, Burkholderia xenovorans LB400
MNKVLRLSDLIAEGKLSGKRVFIRADLNVPQDDQGNITEDTRIRASVPAIKAALDAGAAVMVTSHLGRPTEGDFKPEDSLAPVAKRLAELLGREVPLVANWVENGVNVAPGSVVLLENCRVNKGEKKDSDELAQKMAKLCDIYVNDAFGTAHRAEATTHGIARYAPVACAGPLLAAELEALGKALGAPKRPLVAIVAGSKVSTKLTILKSLADKVDQLIVGGGIANTFMLAAGLKIGKSLAEADLVNEAKAIIDAAKARGASVPIPTDVVTAKEFSPTAKAEVKAVADVQDDDLILDIGPETAKVLAAQLEKAGTIVWNGPVGVFEFDQFGNGTKTLAEAIAKSSAFSIAGGGDTLAAIAKYGIHDKVSYISTGGGAFLEFLEGKKLPAVEVLESRA

SEQ ID NO: 30922 - protein, 458 aa, Listeria monocytogenes str. 1/2a F6854
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQILKASNRKTKIRHN

SEQ ID NO: 30923 - protein, 272 aa, Thellungiella halophila
MATQPPSSSSAREEFVYMAKLAEQAERYEEMVEFMEKVAKAVDKEELTVEERNLLSVAYKNVIGARRASWRIISSIEQKEESRGNNDHVSLIRDYRTKIETELSGICDGILKLLDTMLIPAAASGDSKVFYLKMKGDYHRYLAEFKTSQERKDAAEHTLNAYKAAQDIANAELAPTHPIRLGLALNFSVFYYEILNSPDRACNLAKQAFDDAIAELDTLGEESYKDSTLIMQLLRDNLTLWTSDMQDDDDVIKEAAAAAPAAPKPAEEQQQS

SEQ ID NO: 30924 - protein, 616 aa, Bacillus clausii KSM-K16
MCGITGWVDWQRNLRTETKQMKNMANTLNRRGPDALETWTSDHAAFGHARLVVVDPEGGKQPMTRTAKGNTCTIVYNGELYNTEELRKELLAHGHTFAGHSDTEVLLKAYMEWGAACLEKLNGIFAFAVWDEQEQTLFMARDRLGVKPLFYTEKDGMLLFGSELKALLAHSQIEAVVDRSGLADVMGLSPSRTPGHGIFKGIVELRPAHYLQFSKNGSAVKRYWQLQSNIHTETAHETAAHIRELLEDIVERQLFADVPVGMFLSGGVDSSALTAIAARIYEKQGNAPIFSYSIDYEENEKYFKASTFQPNADADWVEKVAAHCGTNHKNCIIGNDVLANLLKESVLVRDTPGMADVDSSLLWFCKQIKNDVTVGLSGECADEIFGGYPWFHKAEVMAIDGFPWMRSLDERIQLLQPDWQKRLNLQEYVYDRYKETIQETPRFDGDSPEEARRREISYLNMIWFMTNLLDRKDRMSMGASLEVRVPFSDHRLVEYVWNIPWEMKTYGGREKGILRKALQGLLPDDVLFRKKSPYPKTHHPLYTAAVTKAIQEVVRQKDAPLFTFINRDRLKEIADKGGFDTGKPYFGQLMAGPQLLAHFVQIDYWMKAYNIQIDES

SEQ ID NO: 30925 - protein, 430 aa, Candidatus Kuenenia stuttgartiensis
MTIIYSIKAREILDSRGNPTVEVDVILKNGIMGRAAVPSGASTGKREALELRDTDKPSRFMGKGVQTAVKNVNEIISHKLEGMDATRQVEIDNLLIQLDGTKNKEKLGANAILGVSLATAKAAANALGVPLYRYIGGTNAKVLPVPMMNILNGGKHADNNLDIQEFMIVPVNADSFANALRTGAEIFHTLRSVLKSNGYNTNVGDEGGFAPNLKTNEEAIDLILQAIKDAGYSAGKDVYLALDSAASEFYQEGKYVLRTEGCKKKTSDEIIALYTEFLNKYPICSIEDGLAEDDWDGWVKLTNQLGKKVQIVGDDIFVTNTEILAKGIERGVANSILIKVNQIGTLTETLDAIELAKTNGYSVVISHRSGETEDYTIADIAVATNAGQIKTGSLSRTDRICKYNQLLRIEEDLSDNAIYGGKLCRLQKQV

SEQ ID NO: 30926 - protein, 293 aa, Mesorhizobium sp. BNC1
MFRGSITALVTPFRQDGSLDKKAFGALVEWQIAEGSSGLVPVGTTGESPTLTHDEHQEVIRLCVEAANKRVPVIAGAGSNSTREAISFAEHAEKVGADALLVVTPYYNKPNQRGLYEHFAAIARSTSLPIFIYNIPPRSVVDMLPETMARLAADFKNIVGVKDATAKLDRVSEQREACGPDFIQLSGEDATALGFNAHGGVGCISVTANVAPRLCAEFQAASLRGDGARAIELQDRLFPLHKALFLEPNPAGAKYALSRLGRLENVLRSPLVTVEASTAEKIDAAMKHAGLLN

SEQ ID NO: 30927 - protein, 160 aa, Solanum tuberosum
MKKVILKLEYFDEKIKQKAMKKVSGLEGVESISIDSKDKKLTITGNIDPVSLVSKLRKLCHTDIISVGPAKEPEKKKDDGAKKDEGAKKDDGKKEDAKKGDDKKGGDDKKKEEAPPVLKGFPAPMFYHYNQHPYQHYQPPVPAYYHHRSVEEDPNSCVIC

SEQ ID NO: 30928 - protein, 398 aa, Propionibacterium acnes KPA171202
MAEQQTNGNWQERYHNALLGVFGNPQLCLDHGQGCVVVDNDGKEYLDLLAGIAVNALGYAHPAWVEAVSHQSETLAHVSNFFTTGPQLDLAEKLLALAKAPKGSAVFLSNSGTEANEAAIKICLARKNGRIIALDHAFHGRSLGALSLTHKIAYRQPFGPSAVDVTFIAPEDPDALASELDRGDVSGVFMEPIQGEAGVVPLSDEYLQQVRELTACHDVLMVVDEVQCGMGRTGRWFAHQSAHITPDVMTMAKALGGGFPIGVTMTFGSDVSGILAAGQHGTTFGGNPLACAAALAVISTIESDDLLTHVRQIGTLMSTALRQSHPRITEVRGTGALLGVQFDSDIAADLVAAARDAGFIVNAVNPSTLRLAPPYILTKAEAESFIAALPRLIDAVQA

SEQ ID NO: 30929 - protein, 426 aa, Escherichia coli K12
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 30930 - protein, 172 aa, Picea abies
MSNPKVFFDMQVGGAPAGRIVMELYADVVPKTAENFRALCTGERGTGRSGKPLHFKSSTFHRVIPGFMCQGGDFTRGNGTGGESIYGEKFADENFARKHTGPGILSMANAGPNTNGSQFFICTAQTSWLDGKHVVFGQVVEGLDVVREIEKVGSGSGRTSKPVSIADCGQLS

SEQ ID NO: 30931 - protein, 578 aa, Medicago truncatula
MRNFQFFQRFSKNFRDYDSQFKLVLLCTTVSGGGLLAYGEAVATSESAVPEKKKVLVLGTGWAGTSFLRNLNDPRYEVHVVSPRNYFTFTPLLPSVTCGTVEARSIVEPVRNIFRKKHVDSRFSEAECLKIDAVNRKVYCRSNINNNLNEKEEFVVDYDYLIIAVGANVNTFNTPGVTENCHFLKEVEDAQKIRRTVIDSFERASLPSVSDEERKRILHFAIVGGGPTGVEFAAALHDFVSEDLVKLYPGVKDLVKITLLEAGGHILSMFDKRITTFAEDKFKRDGIDVKTGSMVTKVSDREITTKEMKNGGEITTIPYGMAVWSTGIGTRPFIKDFMTQIGQVNRRAIATDEWLRVEGTDNVYALGDCATINQRKVMEDIAAIFKKTDADNSGTLTLKEFQEVMNDICERYPQVELYLKNKQMHGIADLLKESKGDVKKESIELNIEELKTAFSNVDSEMKFLPATAQVASQQGTYLAKCFNRMEECEKNPEGPIRFRGEGRHRFKPFRYKHLGQFAPLGGEQTAAQLPGDWVSIGHSSQWLWYSVYASKQVSWRTRALVVSDWMRRFIFGRDSSQI

SEQ ID NO: 30932 - protein, 157 aa, Brucella melitensis 16M
MPEAANAKPWRDFGMTVRSILETKGRDVVVIASADTLSQAVAMLNKHKIGALVVCDEAGHIEGILSECDVVRALAAQESQAMSKSVAEVMTSKVQVCHEHHTINQVMKIMTRSRFRHMPVEEGGKLVGIISIGDVVKRRIEDVEREAEDIRTYIATA

SEQ ID NO: 30933 - protein, 111 aa, Brassica napus
MGSLMSGWDSPTKDPNSVRRCKSLTREEIDAFWKTKKKTEEKHVQAVSNLVAQEVAESQGIEDRYENQSKTTGWWKRSNWAFLNEPREEEGRPNNYVPQFQVAHIAKIAGQ

SEQ ID NO: 30934 - protein, 588 aa, Synechococcus elongatus PCC 7942
MSETLASETLTPELAAVREKTVVDNLDELLEILPPQLRDQLLRHPQKDRLVEVVLDLGRFPEARFPEGAEYLSETPVSREDLAYCAARVGDFGADNRAGIERTLHRISAIRNRKGEVIGLTCRVGRAVFGTVGMIRDLVETGQSLLFLGRPGVGKTTALREVARVLADDLLKRVVIIDTSNEIAGDGDIPHPAIGRARRLQVARPELQHQVMIEAVENHMPEVIIIDEIGTELEALAARTIAERGVQLVGTAHGNQIENLIKNPTLSDLVGGIQSVTLGDDEARRRGSQKTVLERKAPPTFEIAVEMLERYRWVVHEDVANTVDLLLRQGQPNPQVRTLSEDGRVLIAPAFKDAPKQPASVTQQTWSHTSDRGWRSSGRMRPLPPVLDVPTTREDLRDPEVAFEQALATDVARPVGPNGEELPLHVYPYAVSRHYLEQVIDTLQLPVLLTKDLADADVVLALRGNLKGQSKLRHVARNHHVPIHVIKSNTMPQIVRALRRLLNQEQLDEPETVNLELFTKAGKNDEIEALEEARLAVEQIVLPKGQPVELLPRSAIVRKMQHELVEHYRLKSASFGEEPNRRLRIFPA

SEQ ID NO: 30935 - protein, 264 aa, Oryza sativa (japonica cultivar-group)
MEDRDRDHRGGADEDAPGPAAAAVAAVDGEDEVEDDGGGFSFPVPPFAADAFIVPVYPVFGRPMSPPPREAVVEEEEEDEPETATLRVPLGRLLLEEREFRARQRESSGTSPVQPQRRRPDDEGELEGVPPESYCLWAPGGQPSTTPASPRRCRKSGSTGSVLRWRRISERLVRRSHSDGKEKFVFLNAPGGGAPSPHPPKDNDDANGGGSVGKGDAGRHGWSYYSKGGGGGSGGRRRSYLPYKQELVGLFANVSGLRRSYHPF

SEQ ID NO: 30936 - protein, 245 aa, Ralstonia metallidurans CH34
MRQKLVIGNWKMHGSLAANAALLEGIKAAPARAKLAVCAPFPYLAQCQTLLSGSQVAWGAQDVSSEARGAFTGEVAASMLGEFGCGYALVGHSERRTYHGETDAVVAAKALRALEFDIVPVVCVGETLAEREAGQTEAVVGRQLQAVLDALSIEQLGRIVLAYEPVWAIGTGKTATSAQAQEVHAALRARVTAKDAGVAARMAILYGGSVKPDNAAELFSMSDIDGGLIGGASLKADDFLAIGNA

SEQ ID NO: 30937 - protein, 417 aa, Ralstonia metallidurans CH34
MADIKNYTLNFGPQHPAAHGVLRLVLELDGEVIQRADPHIGLLHRATEKLAEQKTWIQSVPYMDRLDYVSMMVNEHAYVMAIERLLGLEVPIRAQYIRVMFDEITRLLNHLMWIGSHALDVGAMAVFLYAFREREDMFDMYEAVSGARMHAAYYRPGGVYRDLPDTMPQYRASKVHNEKAIKVMNEARSGSLLDFIEDFTNRFPTYVDEYETLLTDNRIWKQRLVDIGVVTPERALQMGFTGPMLRGSGIEWDLRKKQPYEVYDKMDFDIPVGTAGDCYSRYLVRVEEMRQSNRIIKQCIDWLRRNPGPVITENHKVAPPSRVDMKSNMEELIHHFKLFTEGIHVPAGEAYAAVEHPKGEFGIYAISDGANKPYRLKIRAPGFVHLAALDEMARGHMIADAVTIIGTQDIVFGEIDR

SEQ ID NO: 30938 - protein, 366 aa, Aspergillus oryzae
MAGDNTPVGPLIQLPILDISNPNDPAVGKAMLDAAAKYGFLYVSSKGTDFTVSDVEKAFDLSRQFFKSPVEEKAACRIQPNNYGWSGMHVETLDPEHQRTGDFKEAFNFGEFKDGKAQHPLPRSLTSHEPEIAHFADLCNKTCDRILKLLALGLEIPEDFFTARHDPSQGPTGCNLRYLYYPSIASPTTSSYQHGTDVRAGAHSDYGSVTLLFQRPGQPGLEILTPEGTWAPVPVQPGQTAEEDRDAAFPFPPILVNIGDLLSYWTDGLLKSTVHRVVFPLSEQQSPNPQDRYSIVFFCHPLDKTELVPVPSDIVTAHRQKCKESGVQDEKVGFGGGAGSLEPGKRTLTAQEHLEARLAATYKFDK

SEQ ID NO: 30939 - protein, 378 aa, Thellungiella halophila
MLSTLMKLLSACLWPSSSGKSSDSTGKQDGLLWYKDSGQHLLGEFSMAVVQANNLLEDQSQVESGPLSTLDSGPFGTFIGIYDGHGGPETSRFVNDHLFQHLKRFAAEHASMSVDVIRKAYEATEEGFLGVVTKQWPVKPQIAAVGSCCLVGVICGGRLYIANVGDSRAVLGRAMNATGEVIALQLSAEHNVSIESVRQEMRSLHPDDSHIVVLKHNVWRVKGLIQISRSIGDIYLKKAEFNKEPLYTKYRLREPIKRPILSGEPSITEHEIQPQDQFLIFASDGLWEQMSNQEAVDIVQNHPRNGIARRLVKMALQAAAKKREMRYSDLKKIERGVRRHFHDDITVVVIFLDTNVVSSAKGPSLSIRGGGMTFPKKL

SEQ ID NO: 30940 - protein, 400 aa, Sinorhizobium meliloti 1021
MAFLADALSRVKPSATIAVSQKARELKAKGRDVIGLGAGEPDFDTPDNIKKAAIDAIDRGETKYTPVSGIPELREAIAKKFKRENNLDYTAAQTIVGTGGKQILFNAFMATLNPGDEVVIPAPYWVSYPEMVALCGGTPVFVPTRQENNFKLKAEDLDRAITPKTKWFVFNSPSNPSGAAYSHEELKALTDVLMKHPHVWVLTDDMYEHLTYGDFRFATPVEVEPGLYERTLTMNGVSKAYAMTGWRIGYAAGPLHLIKAMDMIQGQQTSGAASIAQWAAVEALNGPQDFIGRNKEIFQGRRDLVVSMLNQAKGISCPTPEGAFYVYPSCAGLIGKTAPSGKVIETDEDFVSELLETEGVAVVHGSAFGLGPNFRISYATSEALLEEACRRIQRFCAACR

SEQ ID NO: 30941 - protein, 220 aa, Yarrowia lipolytica CLIB122
MSRNSEKQGSMLHRFQQQQANAAGLLDVGRTVRPTYISGVESLPQAEKWRSQVMKEISRKVTKIQDPALSDFQLRDLNDEINKLMSERHRWDLQIRSLGGPNYASFGGKKRGYQYYGRARELPGVSEMLQSQKKDDTKKSGDFYIPPKNLNMVYFGYADDNVTGLMEFEKQRESELQDMLAGKPDEDSGFVVGDITVPEEGDLEARLLEERKRRVQALLD

SEQ ID NO: 30942 - protein, 222 aa, Phanerochaete chrysosporium
TLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEGGMWVKMREAQAMGQVA

SEQ ID NO: 30943 - protein, 425 aa, Photorhabdus luminescens subsp. laumondii TTO1
MTESMLAKRRSAAIARGVGVTTQVYAERAENAEIWDVHGQRYIDFAAGIAVVNTGHCHPRVIAAAREQMEQFTHTCHQVVPYENYVALAERLNRLVPGNFAKKTVFVTTGAEAVENAVKIARAATGRSGVVAFSGAFHGRTFLGMSLTGKVAPYKMGFGPLVSDVYRVPFPVGLHGISVEQTLNALENLFKADIEPTRVAAIIIEPIQGEGGFYPAPPELLKALREIADCHGIVLIADEIQTGFARTGKLFAMEHHEVVADLTTMAKSLAGGLPLAAVTGRAELMDAVVPGGLGGTYGGNPVAIAAAHAVLDVIEEEKLNVRATQLGEQLKQRLHELRPHVPQIADVRGLGLMIAVEFNHADSQEPDANFTNAVRQKALECGLILLMCGVHGNVIRFLPPLTIQNDVFNEALNILESVLLDLTKQ

SEQ ID NO: 30944 - protein, 132 aa, Arabidopsis thaliana
  misc_feature (72)..(72): Xaa can be any naturally occurring amino acid
  misc_feature (111)..(111): Xaa can be any naturally occurring amino acid
KSVSKGAKEEEKQKEVVRASSMLSSAVGVTSRAQATRVASINGLEVIGGIRVTGKTKKEIISMESKGGRVAXMKGGPPMGKKKLETLFYLPDLRDVEWAKEVDYLLGKQGXSCVEFELEHGLCTGSRETLPD

SEQ ID NO: 30945 - protein, 163 aa, Ralstonia metallidurans CH34
MLLAIKDFFNSLLLKELFKGMALTGRYLFARKITVQFPEEKTPMSPRFRGLHALRRYPNGEERCIACKLCEAVCPALAISIESDVRNDGTRRTTRYDIDLTKCIFCGFCEEACPVDAIVETHILEYHGEKRGDLYFTKDMLLAVGDRYEPQIAAAKAADAKYR

SEQ ID NO: 30946 - protein, 197 aa, Ralstonia solanacearum
MTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 30947 - protein, 166 aa, Pelargonium x hortorum
MASADVEYRCFVGGLAWATDDHALEQAFSQYGEVVESKIINDRETGRSRGFGFVTFSNEKSMNDAIEGMNGQNLDGRNITVNEAQSRGSGGGGGRREGGGGGGYGRREGGGGYSRGGGGGGYGGGGGGYGGGNGGGYGGGREQRGYGDSGGGSRYSRDSDGGNWRS

SEQ ID NO: 30948 - protein, 461 aa, Triticum aestivum
  misc_feature (405)..(405): Xaa can be any naturally occurring amino acid
MNSLQSFLAVAPVKPAAAAARLPSSRRARVSACLATPAPAPTTPAAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTKKGEYFKQLLKTKLSGNPHVKEIRGAGLIVGIELDVPXAGPLVDACLNAGVFLLTAGKGNVVRLVPALIVSEKELEQAAEVIRECLPALEASTS

SEQ ID NO: 30949 - protein, 1058 aa, Streptococcus pyogenes serotype M3
MPKRKDIQKIMVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALEAAKKIGFPVLVRPSYVLGGRAMEIVENKEDLIEYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 30950 - protein, 337 aa, Thellungiella halophila
MALEINNKLTEPVFAATANGGEKRAYVAFLAGNGDFVKGVVALAKGLRKAKSKYPLVVAVLPDVPEDHQKQLVEQGCVIKEIEPVYPPENQTDFAMAYYVINYSKLRIWKFVEYSKMIYLDGDIQVFENIDHLFDLPNGHFYAAKDCFCEKTWSHTPQYKIGYCQQCPDKVTWPEAELGPKPPLYFNAGMFVYEPNLYTYQNLLETLKVVPPTSFAEQDFLNMYFKDIYTPIPGVYNLVMAMLWRHPENVELEQVKVVHYCAAGSKPWRFTGKEENMEREDIKVLVKKWWDIYNDKSLDYKNVIGEKGGNPDLHKKQLVEALSEAGVLQYVKAPSAA

SEQ ID NO: 30951 - protein, 464 aa, Listeria monocytogenes str. 1/2a F6854
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKNDANVKWTLYDLADRLQMRGWQVPAYPLPKSLENIIIQRYVCRADLGFNMAEEFIQDFQASIQELNNAHILFHNTQQSGVHGFTH

SEQ ID NO: 30952 - protein, 534 aa, Aspergillus oryzae
MKGWLQTFCLTALLAGRALANEVELTQDEAHRQRCSGMYSRKAWGGDVDPFILTKFVRDGDAGDSDPLVSLVIFEWSDEALIGRTVSDDADEKETICDEKSVNDKLCEPGDIGSFILAPNASESEFTIVTQAVHLNNPAAINYPVKKTGFYCVSTYGYSGRDYKAVVEFRNAYGELPAAQIAKLPFYGGLTIVYALIGVFWAFLYVQNRHDILPVQNYITAILVFLIVEQLMTWGFYDYQNRHGLNVGAKVLMVIVAVLNAGRNAFSFFLLLIVCMGYGVVKPSLGRAMIYVRILAIGHFIFAVIYAVASLSITPDSAGPLVLLIVLPLAGTLTAFYVWTLNSLNATMKDLIDRKQKVKALMYKKLWWCILGSIIVIFGFFFINSIAFAGRSEASFVPEHWKSRWFVLDGWLNLVYLFDIGFVAYLWRPTANNRRFAMSDEIAQDDDGFEIRSFNSELDEEDALGGIPESSAHEQRRDLSPVPPKPVPAAPRQRESLDGETIFAVGEDGDKWSDDEDDLSRDSGERKRLTGKDA

SEQ ID NO: 30953 - protein, 510 aa, Picrophilus torridus DSM 9790
MKMDMNVFHDLGLEEVNSGVYDGEWARPSGKMIDVKSPIDGSDIARVSMATESDYERIISRAVEEFKKWRMIPAPKRGIIIKEIGDELRKEKKNLGKIVTMEVGKTASEGEGEIQEMIDVSDLALGLSRQLYGLTIASERPYHRMYEQWIPLGPVAVISSFNFPASVWSWNAFIAAVDGDVVIWKPSSKAALTAVAVMRVIESVLKRNNAPNIFFLMVSPGHDGGEWITNDKRIPLVSFTGSVAVGKKISENVAKRLGKTILELGGNNGAIVSDKSDINIALRGVVFGALATAGQRCTTTRRVIVQENIYDDFLERLKNAYSTIKVGDPRDKGVLVGPLIDEDAVKNYERAIETAIKQGGKLVFGGRRIKISGCENGHYVMPAIIEAKPDMAIVSEETFAPILYVMKYRNIEEAIEIHNSVPQGLSSSIFTNDLREEEAFLSAYGSDCGLANVNTSTAGAEIGGAFGGEKDTGGGRESGSDAWKYYMRRQTVTKNWGKTLPLAQDVVFDF

SEQ ID NO: 30954 - protein, 229 aa, Listeria monocytogenes str. 1/2a F6854
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNDDLKPVNKYYLDK

SEQ ID NO: 30955 - protein, 587 aa, Oryza sativa (japonica cultivar-group)
MGWWGEPAALHSERGFPVEGDCGTDTAGILLEMGGYEYATNGYHRGMEDDYEDEYYSEDPYDEEGEGAGQEYAEEDDEPPEGQQEFLQIRERLKEQIRRKAQAASASAAGRSSSSHDRKPQSTFGSFFGPSKPVISQRVIEERKSLKELQNTASMSRDRRPSAKEIPSSSKVQSKTNGHHHKQKIVNEAKRKAEALKDNRDYSFLLSDDADISPSPMEKPVARSSLSQKSDRESTHSAVKSRAPTGQTARLSNGYGLKNTLSSQRHTEGRVDSNRKVAGANRERVVLPDNGRMHSVVRNGSTQATTSKAASQKLPSKAPIANRPPIKSVSDQSLRANHSASKQLLSQNGRPQSSQSQRMQSTSHGQRPHQPVQSQWPLQSLQGRRPQQSPQNTRPQLMSKSQRPQQSLQRQRPQLSSQNERLESSERQRPPSQSYRPQSSQGQRPSSVQGRQYSEQRRIQANDRVKSAERQIRPPSKPMPSRQIPSNGMRDAHAKKKQPMKRRFNDLSEDEEDPLAMIRSMFRYDPSKYAGRDDDDSDMEADFATIEMEEQRSARIAKEEDDEQLRLIEEEERREQERKRRKMARGR

SEQ ID NO: 30956 - protein, 249 aa, Xanthomonas axonopodis pv. citri str. 306
MTRKLVLLRHGQSQWNLDNRFTGWVDVELTDQGRQEAVAAGRLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDSLQVRSFRYLGDPEAAKRAAEAVANQGKAK

SEQ ID NO: 30957 - protein, 428 aa, Prochlorococcus marinus str. MIT 9303
MNTSRSQAIFSAAQRLMPGGVSSPVRAFRSVGGQPIVFDRVKGAYAWDVDGNRFIDYIGSWGPAICGHAHPEVIAALQDALEKGTSFGAPCELENQLAEMVIDAVPSVEMVRFVNSGTEACMSVLRLMRAFTGRDKLIKFEGCYHGHADMFLVKAGSGVATLGLPDSPGVPRSTTSNTLTAPYNDLEAVKELFAENPDAISGVILEPVVGNAGFITPEPGFLEGLRELTREHGALLVFDEVMSGFRISYGGAQARFGVTPDLTTMGKVIGGGLPVGAYGGRAEIMEMVAPAGPMYQAGTLSGNPLAMTAGIKTLELLKQEGTYERLESTTERLINGILEAAKAAEVPITGNSIGAMFGFFLCEGPVRNFEDAKATDAERFGKLHRAMLERGIYLAPSAFEAGFTSLAHSEADIETTLKAFRESFAAVA

SEQ ID NO: 30958 - protein, 363 aa, Propionibacterium acnes KPA171202
MSLRFASADDLTWSSDERIALEHANPRFGAVLADHMAVATWQAGEGWGDDAVVNYHGLDINPGSAVLHYAQEIFEGLKAYRHADGSIWLFRPDQSGERFVRSAERLALPTLRVEDFVTACMRLVEVDSRWVPEPGEGGEKSLYLRPFMIAYQDFLGLAAASTVLFSVIGSPVGAYFVSGVKPLRLLVERRQARTAPGGTGEAKCGGNYAASLRSQIDAKTRGCNEVLFVDAVEHRWIEELGGMNFMAISKDGQLVTPELAGTILRGVTRRSILEVAPDLGLEPVERKIDVDELLDGVRSGEFPEVFACGTAAVVTPIGSFLDGDTDVKVSEPTGKTTMEIRRRLLDIQFGRAEDTRGWLKRVC

SEQ ID NO: 30959 - protein, 476 aa, Photorhabdus luminescens subsp. laumondii TTO1
MPVPTLRHFINSQYVESKSSEYFDLISPVTGETYARSPNATIADVNEAYASAKEAFKIWGRSTPSARQQALLALADAVEKNSERLIEAQSRNTGQLKHLIASEEVAASVDHIRFFAGAARFLEGKATAEYLPDMTTSIRREPLGVVGQVTPWNYPLMMAVWKIAPALAAGNTVVLKPSDTTPESTLLLAELAAPFFPTGAFNVVLGNASAGALVVSHKTPAMVSITGSVRAGLQVASSAAANLTRAHLELGGKAPVVVFADADMDKAVETIATAGYFNAGQDCTAASRVLVHESVYDTFVAKLVAAAKATRFGYPEDEEALYGPLNNARQLEQVKGFIARLPAHACIETGGRQAERSGYYFEPTVITGLEQHDEAIQTEIFGPVITVQKFRDEQDAIEKANDVKYGLASSVWTRDHGRALRLSRELDFGTVWINTHIPLTAEAPHGGFKSSGYGKDLSAYGFDEYTRIKHVMSSND

SEQ ID NO: 30960 - protein, 162 aa, Oryza sativa (japonica cultivar-group)
MKFMDDKEALYRRLAPEQLVAVEGLHDLCRWIKDHKLKRAAVTNAPRSNAELMLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 30961 - protein, 135 aa, Arabidopsis thaliana
MVKYVVFNHMSSDGDSVIFSGDKVPCEDRVLLIANHRTEVDWMYFWDLALRKGQIGNIKYVLKSSLMKLPLFGWAFHLFEFIPVERRWEVDEANLRQIVSSFKDPRDALWLALFPEGTDYTEAKCQRSKKFAAEN

SEQ ID NO: 30962 - protein, 197 aa, Brassica napus
  misc_feature (178)..(178): Xaa can be any naturally occurring amino acid
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIGSPVYIECSSKTQQNVKAVFDAAIKVVXLQPPKSKKKKKNKNRCVFL

SEQ ID NO: 30963 - protein, 225 aa, Persea borbonia
KRIENKINRQVTFAKRRNGLLKKAYELSVLCDAEVALIIFSNRGKLYEFCSSSSMLKTLERYQKCNYGAPETTVSTRETQSSHQEYLKLKARVEALQRSQRNLLGEDLGPLTSKELDTLEKQLDASLKQIRSTRTQYMLDQLADLQRREQMLSEANKNLKRRLEEGMQANPQVWDPNGHPVTYGRQQAPPQSDGFFHPLDTCEPTLHIGYQPADQITIAAPGPSV

SEQ ID NO: 30964 - protein, 917 aa, Propionibacterium acnes KPA171202
MSETLDRFIAGLSFEPDDYQVKACQDLDDGAGVLVAAPTGAGKTVVGEYATDLALASGLKCFYTTPIKALSNQKFHDLVTRHGEDQVGLLTGDVTINSEAPVIVMTTEVLRNMIYRNSHTLDTLGWVVLDEVHYLADRFRGPVWEEVILGLDPRVKIVGLSATVSNAEEFGEWLDEVRGDVRVVVSERRPVPLVQHVAVARRLYELFDSRRPTEVNPELTSIAKEEARFQRDDSRRPRGRSGKGKRSVSYGTGRFGGASAQRRGRGGRPRGPRNQTSRIQVVRSLHKVNLLPAIIFVFSRSGCDAAVSQLLNTDLVLTSQQEARQLRRIAQRRGEGLTDEERRAVGWNHFMAAFERGIAAHHAGLLPVIKAIVEEGFVAGLLKVVVATETLALGINMPARTVVLEKLVKYNGQTHADITPGEYTQLTGRAGRRGIDTQGHAVVCWQPGMDPRAVAGLASRRTYPLNSTFVPTYNMAVNLVGSMGREKARDLLEHSFAQFQIDRRLGGSAVRNRQTQADIEAYLKAAHCERGDFTVYARLRENIRELEHEQARLRKGELPSQVADSLSSLDPGDIIAVPSGRHAGWVVVVDPGTHGTRGQRPRPLVMTPDRTVIRLGHQDIDAPVTRVAGVKVPRHFHPENQADRRCLGKAFDRVLEGLGRPVVKPRRAAVDAELSDQITELRSQMKAHPCHSCPDRESHARFAERAMRLRRRSERELTKARAKATSIATQFERIVLVLEALGYLGTGGDTVTDAGRMLLGIYSELDLVTAEAIRRGVFDGLDCPQLAAVLSTIVHESRPGDRGHLHRMPDGKSEAAESQLRAVRAEIGLLERDHRIERPRDLDIGFAEASYAWAAGAGLDTVLDDMSAGDFVRRVRQVCDLAGQIAHAGVGENLAHTCRQVVGAMQRGVVTMDREED

SEQ ID NO: 30965 - protein, 453 aa, Synechococcus elongatus PCC 7942
MRRLSASLAGDARLVCEEIALVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 30966 - protein, 231 aa, Streptomyces hygroscopicus
MTSHPISHGAPLSGASTAPVTSVVFDLDGVLVNSFAVMREAFTLAYAEVVGEGEPPFEEYNRHLGRYFPDIMRIMGLPLEMEAPFVRESYRLAHLVEMFDGVPELLSELRHRGLRLAVATGKSGPRARSLLDTLGIRGQFHVVLGSDEVARPKPAPDIVLKAMDLMDADPDRTVMVGDAVTDLASARGAGITAVAAMWGETDEKTLLAAEPDVILHKPAELLALCPEVTAP

SEQ ID NO: 30967 - protein, 114 aa, Oryza sativa
  misc_feature (29)..(29): Xaa can be any naturally occurring amino acid
SGFYSCFLVRTCGYPTSNSREPPDDFDPXSLSGSRCAILEYREHLLRENWIQIETSKIIRDRLRWCYRIEGVNHHQKCRHLVDQYLEATRGVGWGKDARPPELHDPKKVVEADE

SEQ ID NO: 30968 - protein, 130 aa, Coprinopsis cinerea okayama7#130
MPQPSQIVKSEEALPPLPVFSQAIVSKGTVYASGNIGITREWKLVEGGIKAQTRAALENLAKVLKAANSSLEHVVKVNIYITDFAQFSDMNEVYSEFWEKDRFPARTCVGVASLPLGAAVEIEAIADVAE

SEQ ID NO: 30969 - protein, 512 aa, Arabidopsis thaliana
MMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILVKGRYENKFKFTDELVYNHSSCFGFQDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 30970 - protein, 401 aa, Ashbya gossypii ATCC 10895
MALEKAVVLHFGKHSTVAGFSNRDLPQCMLPSAYLMPDGGEPVYGLYELMQAKEHDIYTLFDNRGVPTDWEMLERFCRWIYATQLRVGPEELPVCITVPPDLSATVRSQFHELVLCKLRAPVLQLISEPLAVTLSLGRSTALVVDVGASKVTVTPIVDGSVVKTGILRSRYAGDFLDFQLMKALDDRPDGTSLYHWQQSRTWMRDFKNTMLQVSLMRLSEVEKQLQKQSISFIPIPLEGRKHFLFKRQKTVTWDLKQCYRIPESLFDPSSVSPEFDSADGLSDLVGKAIKKCAASITSSNGSAAQPAAAGLPSATPEQIHAALLTNVVIIGGTSLLQGLEQRLVNDLSLQFPQYKLSTYATPAHVDRQLQSWQGGVNMCHLPDWKLGSWVTKQEYLESLDK

SEQ ID NO: 30971 - protein, 443 aa, Bacillus clausii KSM-K16
MYLHGTMTINEAGHLEIGGVDTVDLAKKYDTPLFVYDTALIKERARAFKQAFEAEGVSYQVAYASKAFSCIAMYQLAASLDLSIDVVSGGELYTALKAGVEPGKIHFHGNNKSHGELEMAIKAGIGCIVADNFYELELLEELAANMEQTVSVLLRLTPGVEAHTHEFIATGQEDSKFGFDIASGQADKAAQIAERSKFIDLLGVHSHIGSQIFETEGFVLAIEKVFNQLQAWQEEFDFVPRVLNFGGGFGIRYVEGDKPLEPETYIREIVKETKKHADRLGLAIPEIWIEPGRSLVGDAATTLYTIGSTKDIPNVRRYLSVDGGMSDNLRPALYDAKYEGLLANRAHDKAEETFSVAGKCCESGDMLVWDMPLPEVQHGDVLAMFCTGAYGYSMANNYNRIPRPAVVFAEDGADQLVIQRESYEDLTKLDLAYQANVKETSDV

SEQ ID NO: 30972 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPPKDDVFKTHPMNFLNEKTLKGTFFGNYKPRTDLPNVVELYMKKELELEKFITHSVPFSEINTAFDLMLKGESLRCVMRMDE

SEQ ID NO: 30973 - protein, 220 aa, Persea borbonia
KRIENKINRQVTFAKRRNGLLKKAYELSVLCDAEVALIVFSTRGKLYEFCSTASMLKTLERYQKCNYGAPETTVSSRELQSSHQEYMKLKARVEALQRSQRNLLGEDLGPLTGKELDTLEKQLDVSLKHIRSTRTQYMLDQLGDLQRREHMLSEANKSLRRRLEEGMQENPNHAWDPNGYVRQQAPPQSDGFFHPIECEPTLQIGYQSSQITIAAPGPNV

SEQ ID NO: 30974 - protein, 1420 aa, Yarrowia lipolytica CLIB122
MKSNEQLNKENAPTNTNEYQRTPANTHSNPVLHTASNAADQTFEVVRKLTPEASTIQIRESADPLAHIVNSPAAADSLLAVVASSHVLVKGLAHLSAFKNRAVVFHVETGSDYNDIAAIRHSQYVMLQSFGLEDVQEVAIKAYEVSKATGQPVIHFYAPVEGEVSLIPGNEIVSKVEKVETDSEKQLEQPIIAPQYIGSSSAPSALIVFGSSTQLFIDNVKAHSQTGLVLVRQYRPWSVQAILNVLPKSVKTLGLAEQIKSRTTAWSPLVLDYVADIHASGIDRDSAPKPVAFHLGQVTEATVNHVFAAISSNLTSASPVQNLTVGSGVTPNETKEEVKAEALTLETAYTKILHELFKEVNIINASDKKDAGLTSPEYGYGAYLAYQEKRKELSERVRTAIRKNELGEELHKLLTMWAINREVDVTDIISKLEAKGAKDLLELKEYFENKSSWLIGSDAWSHDLGNSGVHHVVSSGENLNMLIIDSTPYDTAQSKLPSLRKKDIGLYAMGFGNVYVASTAVYASYTQVLQSLIEAAAFEGPSVVLAYLPYHSESDDPVSILKETKRAVDSGYWPLYRYDPSLEAKGQEPFQLESSRIRQDLQKFLDRENKLTMLSKKDPVLARNLAQGYGSGLRELQQRKAKDAYLQLLDGLSGAPITILFASDGGVAENVAKRLGRRAKGRGLKPLVMAMDDFPLEDLSSETNVVFITATAGQGEFPQNGRNFWEGLKGATDVDLTNTRVSVFALGDSLYWPRKADKHYYNKPGKDLHAKLVLFGAQDLAPLGLGDDQDADGWSTGYNEWEPAVWTALGVDGIGAIDEPPPITNEDIKAASNYLRGTIAEGLKDESTGAISAHDQQLTKFHGIYMQDDRDIRDERKAAGLEPAYSFMARVRLPGCRATPEQWLKIDELSDSRGNGTFKITTRATFQLHGVVKHDLKPAIRGMNAVLIDTVAACGDVNRNVVTAALPENAKVHDQVVKLGTDISEHLLPMTTAYYEIWLEGADESDKQNIGAPEIFDKREGGPKKKPKKIQVGESTLKDMEEIKDTEELYGELYLPRKFKINVAVPPYNDVDVYAHDIGLIAIVENDVIIGCNVLVGGGMGVTHNNTKTYPRTGSNLGFMPYDKIVDTCEKVMLVQRDFGDRTNRKHARLKYTVDDLGVDVFKGKVEEYLGYKFEDARDFEFKSNTDYFGWVKDERGLNHFTSFIENGRVEDTPELQFKTGLREIAKAMTGKAEFRLTGNQHVLISNITDEELPKIKDLLKKFKLDNINFSGLRLSSAACVAFPTCGLAMAESERYLPVLITKLEAALEEYGLRHDSIVMRMTGCPNGCARPWLAEVALVGKAYGAYNLMLGGGYQGQRLNKLYRSSLKEDEILDILKPLFKRWSLERNDGEHFGDFLIRVGVIKETTAGKNFWEGVEEE

SEQ ID NO: 30975 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRDVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGAPRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 30976 - protein, 288 aa, Eucommia ulmoides
MLGKADSVNKALEATVLLRYPIKIHESMRYSILAGGKRVRPLLCIAACELVGGQESTAMPAACAVEMIHTMSLMHDDLPCMDNDDLRRGKPTNHMVFGEDVAVLAGDSLLAFAFELIATSTTGVPADRIVRVIGELAKSIGSEGLVAGQVIDICSEGMTDVGLEHLEFIHVHKTAALLEGSVVLGAILGGATDPEVEKLRKFARCIGFLFQVVDDILDVTKSSQELGKTAGKDLVADKTTYPKLIGLEKSREFAEKLNREAQDQLAAFDIEKAAPLIALANYIAYRNN

SEQ ID NO: 30977 - protein, 105 aa, Glycine max
  misc_feature (40)..(40): Xaa can be any naturally occurring amino acid
AKALKGSTRVYLLDAHGNSAVVCSCSAHMTLWKKDHAAEXRFLRRKAIFKPPKPLLGGRPICVPQFLNLGALDSHRFARDQFWRHDESPPPFSTRAPNKASVDMI

SEQ ID NO: 30978 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 30979 - protein, 188 aa, Neisseria meningitidis serogroup A
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 30980 - protein, 351 aa, Aspergillus oryzae
MEGNLPQQSCHPATTAVDKDDIVIPVIDFGPFLNGTPADKHAVAVSIVEAFKTSGFLYLKEHGLPPSVVSRVFGSSARFFARPQDQKDSLCWTTPQANRGYVKTGQEKLSNVDDPTAPEVLRATPDLKETMEIGRDNLDNQPNRWPDQIDDEGKDFREVMTSFFNMCRSLHTEVMRAIALGMNLPEHYFDSYVDAGDNNLRLLHYPAVSKEVFKKNPSQVRAGEHSDYGSITLLFQDRRGGLQVRSPKDTYVDVTPIADTVVVNAGDLLARWSNDLIKSTRHRVVEPPTPIGEEDNSDTYPDRYSIAYFCNPNNNRLIEAIPGTYGDDIKEAKYPGIVAGDYLVQRLTATY

SEQ ID NO: 30981 - protein, 459 aa, Rickettsia conorii str. Malish 7
MQEFDLVVIGSGPAGYTGSIRAAQLGMKVACIEKSDTLGGTCLNIGCIPSKVLLNSSEKYEVALKHFENIGIIADVKLDLQKMLANKDKVVLDLTQGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDSKSSVVTSNVVLMAVGRKAYTQNLGLESVGIITDKQGSIEINDRFQTAISNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINM

SEQ ID NO: 30982 - protein, 255 aa, Escherichia coli CFT073
MRSKYMAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 30983 - protein, 304 aa, Synechococcus elongatus PCC 6301
MNDFLPYAFFRGQLVPFPEAQLSIATHALHYGTGAFGGLRGIPDPENPDRVLLFRLDRHCQRLSQSAKFLHFELSAEEIFKAIEAFVQKNQPSQSFYIRPFVYTSDLGIAPRLHNIEKDFFIYGLQLGDYLSPEGVSCRISSWYRQEDRSLPLRGKISGAYIASSLAKTEAVASGFDEAILMNSQGKVCEATGMNLFMVRNGRLITPGYDQDILEGITRDSVIRVAQDLGIPVDQRPIDKSELFIADEVFLSGTAAKVTPVKQVENYLTPCDRPITDQIRQQLTLITEGRLAAYQDWVFPIALR

SEQ ID NO: 30984 - protein, 530 aa, Ashbya gossypii ATCC 10895
MSQHIFQTKSLKRKNLKKLTLEAGGSEELEGAARGDILRATEDRLSGAPTLLKAGARPMRSPEPVWGLGSVPGPASVQGVLDMASSQRAAEPATQRPGLFHNGTPDNQLRGGKPCMTLRMKRMQKPLNLNIEPEGVKSKVVIAQPSPTNSDSSTSVSPIVPSKITSNKRDNRLSTKFSRLSIFQDDNNDIQLEDLVQLGKIGAGNSGTVVKTLHVPDSRIIAKKSIPVENSELVKNQLMRELTIMKNVKEQKNIVGFYGAYYTAIKNHEIIILMEYMDCGSLDKISSTYRRYCSRNKVPMNASTSWFTELSLSKISYAVLNGLSYLYQDYKIIHRDIKPSNILINSKGFVKICDFGVSKKMIDSIADTFVGTSTYMSPERIQGSCYNTKGDVWSLGLMIIELVTGEFPLGGHNDTPEGILDLLQRIVNEEPPSLPASGDFSADIMDFVNCCCVKDERKRSSLQELMTHRYITKYNDSDDYQRTFRHWCKKIKKRIKADKMIQREEMERARLVNRQLERSAQAAMAARSGR

SEQ ID NO: 30985 - protein, 444 aa, Ashbya gossypii ATCC 10895
MSGVSGVPQIDLEKVRNESDGSMGGMAKGLFRQVVEGNPYFAAGGGLMVLGTTIAVLRKGVIRLSSLAYHQMLVDLEIPSKDKSYLWFLQWMAQHPSRSSRHLSVETNYMQHNNGSVTTNISFVPGPGTHLIRYKGAFMLVKRERSGQIANFSNGTPFETVKLTTLYRDRGLFTDLLQDAKRLAVKAQTGKTVVYTSWANEWRPFGQPKAKRMLSSVIFDRGVKEAILGDVQEFLKNGSWYHERGIPYRRGYLLYGPPGSGKTSFIQALAGELDYNICIMNLADSNLTDDRLNYLMNNLPERSIMLLEDIDAAFVKRKKNDDGYTNGVTFSGLLNALDGVASSEEMITFMTTNHPEVLDPAVLRPGRIDYKVLVGNATPHQIEQMFLRFYPDDSALCAEFVAKAVALGVPVSTAQLQGLFVLNKNDAASALSMVETLKYPNHAF

SEQ ID NO: 30986 - protein, 636 aa, Vibrio cholerae O139
MCGVAGFISKRLSPVDCLTSMVESIMHRGPNDSGLWVDDDFGVCLAHARLSIQDLSSAGHQPMHSKSERYVMIFNGEIYNHLTLREELIEIVPSYWNGHSDTETLLAGFEVWGIEQTIQKCVGMFAIVLWDKVLKQLILIRDRFGEKPLYYGWQRDTFLFASELKALKAHPSFEGSINRQALSHFFRLNYIPTPLSIYEGIFKLEPGVIAVFSHEGQLLSKQTFWDASHAVSLQNFSDHDAVDKLDDLIKQSIQDQALSDVPLGAFLSGGVDSSTVVGILQSLSTRPVKTFTIGFDHADFNEASEASDVAKHLGTDHVELIVSAEDALAIINQLPVMYDEPFADASQVPTFLVSKLAKKEVTVCLSGDGGDELFCGYNRYHYTAKVWSYLEKIPFPIRKMLSVFLLTLSPSSWDVLSKTLGLNTRLPNLGNKTQKGAQALKARDIEDLYTRVVSNWDLDEPLVKNTAVEKLPFLSDLTELSHLNDLEKMMLWDKQSYLMDDVLVKTDRATMACSLEGRVPLLDHRIAEFAASLPIHLKYRGGKGKWLLREVLYRYVPKKLIERPKKGFSLPIAEWLRGPLKDWANVLLDSDRFDKEGFLSSELVQKKWGEHLAGKRDWSSQLWSVLMFQLWLEKNK

SEQ ID NO: 30987 - protein, 314 aa, Oryza sativa (japonica cultivar-group)
MSMGHYSEQRPGFEVTKDWNGADQVMIRSPRGASVLVSLHGGQVVSWRNDRGEELLFTSSKAIFKPPKAMRGGIPICFPQFGNCGTLEQHGFARNRLWAIDDEAPPLNHNDNNGKVSVDLLLKPSEDDLKCWPHCFEFRLRVSLSTDGDLSLVSRVRNVNGKPFSFSFAYHTYLSVSDISEVRIEGLETLDYLDNLSQRERFTEQGDAITFESEVDRVYVGSPSVIAVLDHEKKRTFIVRKEGLPDVVVWNPWDKKSKTMADFGDEEYKQMLCVDAAAVERAITLKPGEEWTGKLELSAVASTNCSDHLDYPCS

SEQ ID NO: 30988 - protein, 346 aa, Solibacter usitatus Ellin6076
MNNHMMAAVLYGKEHLQVEPVAVPKIDIGDILVRVKVALTCGTDVKVFRRGYHARMIVPPAVFGHELAGDVVAVGEDVRNFSVGQRVVAANSAPCGECFFCKRELENLCEDLLFNNGAYAEYIRIPARIVQRNTYLIPDDVGYQDAALVEPLACVVRGFEESAPRAGDTVAIVGLGPIGLMFVKLAKLYGCRVIAVGRRQTQLDRAEALGADHLIVAGEHSDPVKSSREMTHGRGVDVAIEAVGKPQTWQWAVNMVRRGGTVNFFGGCPNESKVNLDTALLHYSEITCKASFHHTPAYIQKALDLVCAGHITASVFVNKEEPLANLLEVMRHLMSHNGHLKTAIVP

SEQ ID NO: 30989 - protein, 333 aa, Methylobacillus flagellatus KT
MTIKVGINGFGRIGRMAFRAAIKDFTDIEVVAINDLLEPDYLAYMLKYDSVHGRFDGDVSVSGGNLVVNGKTIRLTAERDPANLKWDEVDVDVVVECTGFFLTEETCQKHIDAGAKKVVQSAPSKDDTPMFVYGVNHDTYKGQSIVSAASCTTNGLAPVAKVLQDSFGIKRGLMTTVHAATATQKTVDGPSNKDWRGGRGILENIIPSSTGAAKAVGKVIPELNKKLTGMAFRIPTSDVSVVDLTVELNKETTYEQIVAAMKAASESGPLKGVLGFTDEKVVSTDFRGNAYPSIFDADAGIQLDPTFVKVVAWYDNEYGYTCNMLRLVRHIAS

SEQ ID NO: 30990 - protein, 663 aa, Methylobacillus flagellatus KT
MAASRQELANAIRVLSMDAVQKANSGHPGAPMGMADIAEVLWNHHLRHNPTNPSWADRDRFILSNGHGSMLIYSLLHLTGYDLNMDDIKSFRQLHSRCAGHPEYGYAPGVETTTGPLGQGITNAVGFAMAEKLLAHQFNKPGHEIVDHYTYCFLGDGCMMEGISHEAAALAGTWGLGKLIAFWDDNGISIDGHIEGWYTDDTAKRFEAYGWHVVPNVDGHDFDAVNAAIEAAKKVTDKPTLICCKTIIGKGSPNKCGSHDCHGSALGLEEVAATREALGWKHEPFVIPEEVYAGWDGKEKGAKLESEWNAKFEAYAKAYPAEAAEFKRRMAGELPANWKEVTDAFIKATNEKAESIATRKASQNAIAALAPVLPEFLGGSADLTGSNLTSCASFKHVSGKEPGNYISYGVREFGMFAIMNGMALHGGLLPFGGTFHMFSDYAKNALRMAALMKQRTIAVLTHDSIGQGEDGPTHQPIENTAGLRYIPRMDVWRPADSVETAIAWVAAVERKDGPTSLVLSRQNVPGIKHDEKHFELIRKGGYVFSDVEGKADVILIATGSELDLAIKAAAELNAAGTKVRVVSMPSTNVFDRQDQAYKDSVLTPGVKRVAVEAGVTDFWRKYVGLEGAVVGIDTFGESAPGGVLFKHFGFTVENVVNTVKSVL

SEQ ID NO: 30991 - protein, 1028 aa, Vibrio angustum S14
MLAHNQTVPFWPEEKTAKYPSILPLLYRVENNYLDKNWPDNGESQEAVIKQIRSAQKGWVSSFKPKDTIIVTLLVGKYKVTMNVAKSDDNPRLWLGRIYYANNQDRQRMLENGVLLEFGGVRLLTGREFGVGLENTDYRYSSGKYASELLDVINSPWNVEGEEREQNDITEESLSFEEQEMVDVLRCFIDSEYELERIAAQQCMPFQATSITARSERTTYRLHYEVKFDEFDYSRLVETQPTLLEMLNEMREPTDILMEIADLNPVENEPIIHVSIEKQALDSQIPEQALLNVAALPTLKKVRNAVVDSLESETSKNPWLLSLAAGVYDHSPLTPVKVPVPPSKFPPTPSQVKAIDSGAGSDDYTLVLGPPGTGKTTVILQWVKYFAAQGKRVLVTSQNNKAVDNVLERLAEEDDFECLRIGNENKISSCLEDITLDNKAAKLQERMFSSADETLKVLEQQLEHIKGLLVSKDEIIKQLDEADKAQSDHSHYTNTLLELKDNLVEIERDIVLKNNTLEQLSEQIIETQQKEWPIFKSVSRWLNNKKISLINYRINKVNLKTSELKGQRLQLGNTIEETESKITEAHSLMDSIHCQIEGYFEQVTSLVDDINIPGSSGKKVTKFEMESLDELLVKVSSIHTNLTEWFNKLKTERQQALYKILMENVNVVGATCIGINTKALFRELDFDVVIVDESGQIQLHNLIVPLSRANKAILVGDHKQLPPVVSDEVLEEVEAKDFGDYKDLYRLSWFEHLWNGAPEDRKIMLDTQFRCPSMISDFVSEAFYEGKYFAGVGMDKKKPLLSYCPQPMIWIDTTWLQEKAEKATSEDGRAVVQDNVCETELVIALLKTSIKEMPELAENREIGIIVPYANHVKAIQKAIKREQKRGQLSELTMPLNELVASVDSFQGQERDLIIFTFTRSNRQGKVGFLSDWRRLNVAQTRAKKQLVMIGDSQTLTKGADRQNAHDVEFKKAMVLLKSQCHKKGALLQAAQFLPDAKTAQRPKNSTASNNRKNSNVQTSKKTLVSENG

SEQ ID NO: 30992 - protein, 406 aa, Pseudomonas syringae pv. tomato str. DC3000
MAIDIKAPSFPESVADGTISKWYKKEGDAVKRDEMLVDIETDKVVLEVLAEADGVMGAITKEEGAIVLSNEVLGTLNDGATASAAPAPAAAPASAPAAAPAAAGEEDPIAAPAARQLAEENGINLASVKGTGKDGRITKEDIVAAVEAKKSAPAAAPAAKPVAAAAPVVAAGDRTEKRVPMTRVRATVAKRLVEAQSNMAMLTTFNEVDMTEVMALRSKYKDLFEKSHNGVRLGFMSFFVKAATEALKRFPAVNASIDGSDIVYHGYADVGVAVSSDRGLVVPVLRNAEHMSLAEIEGGIATFGKKARDGKLSIDEMTGGTFTITNGGTFGSMMSTPIVNPPQAAILGMHNILQRPMAVNGQVVIRPMMYLALSYDHRLIDGKEAVTFLVTIKNLLEDPARLLLDI

SEQ ID NO: 30993 - protein, 478 aa, Pseudomonas syringae pv. tomato str. DC3000
MSQKFDVVVIGAGPGGYVAAIKAAQLGLKTACIEKYQDKEGKLALGGTCLNVGCIPSKALLDSSWKFYEAKNGFAVHGISTSEVAIDVPAMIGRKSTIVKGLTGGVASLFKANGVTTLQGHGKLLAGKKVELTAADGTVEIIEADHVILASGSRPIDIPPAPVDQKVIVDSTGALEFQQVPQRLGVIGAGVIGLELGSVWARLGAQVTVLEALDKFIPAADEAVSKEALKTFTKQGLDIKLGARVTGSKVNGEEVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLIPSVIYTHPEIAWVGKTEQTLKAEGVEVNVGTFPFAASGRAMAANDTGGFVKIIADAKTDRVLGVHVIGPSAAELVQQGAIAMEFGSSAEDIGMMVFSHPTLSEALHEAALAVNGGAIHIQNRKKR

SEQ ID NO: 30994 - protein, 978 aa, Candida albicans SC5314
MTSIYTSDLKNHRRAPPPPNGAAGSGSGSSSGSGSGSGSGSGSGSLANIVTSSNSLGVTANQTKPIQLNINSSKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLSSSSVLTGGNSGVSGPINFTHKVHVGFDPASGNFTGLPDTWKSLLQHSKITNEDWKKDPVAVIEVLEFYSDINGGNSAAGTPIGSPMINSKTNNNNNDPNNYSSAKNNVQEANLQEWVKPPAKSTVSQFKPSRAAPKPPTPYHLTQLNGSSHQHTSSSGSLPSSGNNNNNNSTNNNNTKNVSPLNNLMNKSELIPARRAPPPPTSGTSSDTYSNKNHQDRSGYEQQRQQRTDSSQQQQQQQKQHQYQQKSQQQQQQPQQPLSSHQGGTSHIPKQVPPTLPSSGPPTQAASGKSMPSKIHPDLKIQQGTNNYIKSSGTDANQVDGDAKQFIKPFNLQSKKSQQQLASKQPSPPSSQQQQQKPMTSHGLMGTSHSVTKPLNPVNDPIKPLNLKSSKSQEALNETSGVSKTPSPTDKSNKPTAPASGPAVTKTAKQLKKERERLNDLQIIAKLKTVVNNQDPKPLFRIVEKAGQGASGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETSDTGFA

SEQ ID NO: 30995 - protein, 512 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAELNKNHDFDHSLGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNPRVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 30996 - protein, 557 aa, Methylobacillus flagellatus KT
MFSDIEIARQAKLRKISEIAAELGLNEDSITLYGQYKAKIDLNANPQLQAQPDGKLILVTAISPSPAGEGKTTTTVGLGDALQRMGKRAVICLREPSMGPVFGMKGGAAGGGYAQVVPMEDINLHFTGDFASIALAHNLLAAMIDNHIHHGNALQIDPRQVTWKRVIDMNDRALRQVVIGLGGKVNGQPREDGFDIVVASEVMAVFCLADSLKDLRTRLGRIVVGYTYSGQPVTAQDLKAHGAMTVLLKDAIKPNLVQTLEHTPALLHGGPFANIAHGCNSVIATRTALKLGDYVVTEAGFGADLGAEKFIDIKCRKAGLHPDACVIVATIRALKYHGGADVSALSREDMLALDRGIANLEKHVENVTTHYGMPAVIALNRFDHDTEAELALVMKRMGEMGIKVVVAEHWAKGGAGAESLAAHVLQLIEGRSEGVRYVYESSETLWEKVNQVARKIYGAMDVHAPRPVRAMIDRLQDAGYGHYPICIAKTQYSFSTDASRRGVPHEHILTVRAVRLCAGAEFVVIICDDIMTMPGLPEEPCAIRMDIDDDGQVVGLY

SEQ ID NO: 30997 - protein, 262 aa, Synechococcus elongatus PCC 6301
MATPLWQTIYNNAVLLPESPKAIVHFLGGAFIAAAPQVTYRRLLEGLGDRGFAVIATPFINTFDHTTLADEVGRSYRLAYERLLALGLISPELPIFGVGHSMGSKLHLLMGCAQTSDRRGNVLLAFNNYSARRSIPLLGQLAPALDVTVEFSPSPARTLRLIRDRYSVANNLLVKFRNDEIDQTRDLIGALRDRFPETSEWLRLSGNHLTPVGQSLPQQTGLAWLDGVSQLASRELGRDLEVVTTAIADWCDRQLTAPATVV

SEQ ID NO: 30998 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKSRKRQLSNDSTDPIESKTVKKIKCHQWKNLDSMEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 30999 - protein, 506 aa, Bacillus clausii KSM-K16
MAYQQPNTEGALVHFKERYDNFIGGEWVAPVNGRYFENRSPVTGKPFCEVARSSAEDVELALDAAHNAKASWGKMPAAQRANLLNKVADRIEENLEMLAVAETWDNGKPIRETLNADIPLAVDHFRYFAGVIRAQEGTLSQIDENTVAYHFQEPLGVVGQIIPWNFPILMAVWKLAPALAAGNCVVLKPAEQTPASIFVLLELLSDLLPPGVVNVVSGFGLEAGKPLASSPRIAKIAFTGETTTGRLIMEYASANLIPVTLELGGKSPNIFFRDVMEKEDDFLDKAIEGFVLFALNQGEVCTCPSRALIDETIYDAFIEKALQRVAAIKQGNPLDPETMMGAQASEEQLEKILSYLAIGKEEGAEVLAGGNQRQLSGDYSGGYYVEPTVFKGTNNMRIFQEEIFGPVVSVATFKDADEALRIANDSLYGLGAGVWTRNINTAYRFGRQIEAGRVWVNCYHAYPAHAAFGGYKKSGVGRETHLMMLNHYQQTKNMLVSYNDDSQGFF

SEQ ID NO: 31000 - protein, 85 aa, Oryza sativa (japonica cultivar-group)
MENSAEMQRFIEFTADSYLNITLQQEQQKAMVSEMVGKLTSVCWDKCITSTPGSKFSSGETTCLTNCAQRFLDMSVIIAKRFEMQ

SEQ ID NO: 31001 - protein, 469 aa, Vibrio vulnificus CMCP6
MSVENVLSLIQENEVKFVDLRFTDTKGKEQHISIPSHQIDADFFEDGKMFDGSSVAGWKGINESDMVMMPDASSAVLDPFTEEATLNIRCDILEPATMQGYDRDPRSIAKRAEEYMRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARALNALTNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLKQALEYLDNDREFLTAGGVFSDDFIDSYIELKTKEVERVNVAVHPLEFELYYSV

SEQ ID NO: 31002 - protein, 179 aa, Glycine max
MSWCYCAKPMTLQLPKMLQPRASSSFHSHVGGVTVTSSTLSLRLSSTLVFTHNLHFQPKLKRASTTVRCSSALTPQLKSTLDQVIASNKVVVFMKGTKDFPQCGFSNTVVQILKSLNVPFETINVLENDLLRQGLKEYSSWPTFPQVYIEGEFFGGCDITVDAYQKGELQELLEKAMLS

SEQ ID NO: 31003 - protein, 379 aa, Oryza rufipogon
MATAGKVIKCKAAVAWEAGKPLSIEEVEIAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 31004 - protein, 446 aa, Zea mays
MDRQKEFVLRTLEERDIRFVRLWFTDVLGYLKSVAIAPAELEGAFAEGIGFDGSSIEGFSRVSEADTIAKPDPSTFQVLPWTTSQGKHHSARMFCDIAMPDGTPSWADSRHVLRRQLNKAADQGFTCYVHPEIEFFLMKDAPTDGTPPTPADGGGYFDQVVHGSAPNFRRHAIDALESMGISVEFSHHEGAPGQQEIDLRYADALSMADNVMTFRYIVKEVAIGEGVWATFMPKPLSDHAGSAMHTHMSLFEGDTNAFHNPDDPMQLSDTGKQFIAGILQHAPEISAVTNQWVNSYKRLIHGGEAPTAATWGGANRSALIRLPLYTPNKASSRRIEVRSPDSACNPYLTFAVLLAAGLKGIAEKYELPDEAEDDVWALTSAERRTMGYTELPGSLAEALKAMESSELVAEALGEHVFDYFLRNKWTEWNDYRSRVTPFELGRYLSL

SEQ ID NO: 31005 - protein, 304 aa, Medicago truncatula
MNFAVHSRTPVPNLGRSAFHYNLLPVDVVMLLRERERERERERERERERERERELKLKPKPDGGGSDVDRDIFTEREREREREREREREREMSQLGLLLQEPVQSQTESTTILGLLREQMDGVDGVPRRRRSFKERLGFIGCCGANWGFRSSSSSDSQQNQQRILDTDPSEDPNMCVAPVIQTGSSSSSMNLAAALAAERQLRGPAAETSGGGGRMPGTPWRVSLMRLLEETENGDTVVVKAEEKVGTMAGNDSVCCVCMGRNKGAAFIPCGHTFCRVCSRELWLNRGSCPLCNRSIIEILDIF

SEQ ID NO: 31006 - protein, 332 aa, Xanthomonas axonopodis pv. citri str. 306
MTIAEDLPTVLGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGASAQVQQQLYDYGMQLGFAFQIADDVLDYAAEAADLGKNLGDDLAEGKATLPLIHAMAHSDATTRERLRQIVEQGDAAAMPEVLAAIRATGGLDYSRQRAAEYAAAAEQALETLPHSAAVAALRGLARYAVERTH

SEQ ID NO: 31007 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTEHAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 31008 - protein, 345 aa, Glycine max
MAATKPLLTDLASTIDRVPSNFIRPIGDRPKLHQLHSSLASIPIIDLQGLGGSNHSQIIQNIAHACQTYGFFQIVNHGIQEEVVSKMVNVSKEFFGLPESERLKNFSDDPSKTTRLSTSFNVKTEKVSNWRDFLRLHCHPLEDYIQEWPGNPPSFREDVAEYSRKMRGLSLKLLEAISESLGLERDYIDKALGKHGQHLAINYYPPCPEPELTYGLPAHADPNAITILLQNEVPGLQVLYDGKWLTVNPVPNTFIVNIGDQIQVISNDRYKSVLHRALVNCEKERMSIPTFYCPSPDALIKPAPKLVDNEHPAQYTNFTYREYYDKFWNRGLSKETCVDMFKAQD

SEQ ID NO: 31009 - protein, 869 aa, Xanthomonas axonopodis pv. citri str. 306
MSAPHSTDRWIVLKFGGTSVSRRHRWDTIGKLASKRANETGGRVLVVVSALSGVTNELTAIADGAADSAQRVAALDQRHREFLAELELDADAVLGERLAALHALLGDARAATRTLDWQAEVLGQGELLSSTIGAAYLHASGLDMGWLDARQWLSALPPQPNQSEWSKRLSVSCQWQSDADWRTRFAAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGNAELVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDEADADGLLPILHAELIDSGAMPVSEGEVFGPRWRQIIGSVRPRPTPWWHAERAHLLSLSRAGTPRYAYHLPTVRERAHALAQIAAVDQRYYAIKANAHPAILMALEQAGFGLECVSHGELRRVFQALPELSPRRVLFTPSFAPKAEYEAAFALGVTVTVDNVEALRNWPEVFRGRNVWLRIDLGHGDGHHEKVNTGGKASKFGLSSTRVDEFVEVARTLEVTITGVHAHLGSGVETGEHWRMMYDELAGFARRIGTVETIDIGGGLPIPYSAEDEPFDLEVWAKGLAEVKAVHPGYRLAIEPGRYLVAEAGVLLASVTQVIEKDGVHRVGLDAGMNTLIRPALYDAGHDIENLSQLDAPADGTFDIVGPICESSDVFGKRRRLPAATAPGDVVLVADAGAYGYSMASTYNQRELPREEVIDAPTG

SEQ ID NO: 31010 - protein, 367 aa, Nostoc punctiforme PCC 73102
MSLLTLAVGAPEVSPWLLLLNLFSLLLSFLCIRRYRIRRLTSIFSSIGLLICAWVLANIPLTQMQMDKAMKQGLGTDYLEQIPVQVRAKMQTHPFNLVNFFGGIQLGKTRHQKDILFASPAVMPLKMEVYQPPQVGKYPAVVVIYGGAWQYGNPQANSEFNQYIAHQGYTVFAIDYRHAPKYQFPTQLDDVRTALNFIRKNAATYEADPERMVLIGRSAGAHLAMLAAYQPDAPPIRAVINYYGPVNLPEGYKTPPVPDPINTRAVLKAFLGGSLEELPNQYKIASPINYLTHPLPPTLLIYGSRDHLVEARFGRQMYERLHNSGNTAVFLQIPWAEHAFDAVFNGVSNQLALYNTERFLAWALFKK

SEQ ID NO: 31011 - protein, 374 aa, Magnetospirillum magnetotacticum MS-1
MLATPRREVNVAVPLRRDDGRTVLFHGYRVQHNVSRGPGKGGLRYAPSVDIDEVRALAMWMTWKCALVDLPYGGAKGGVAIDPRSYSDAELERVTRRYTSEIMPVIGPERDIMAPDMGTSERTMAWVMDTYSVNQGYTIPAVVTGKPITVGGSLGRTTATSAGVVHVTAAALEEAGVPLSDVRVAVQGFGKVGSHAAAIFAARGARVVAVSDQYGGVHAPDGLDVRALVEHVAATGSVVGFDRADPVDNDALLALDVDVLVPAAVEGVLDGDTARTVRARWVVEGANGPTTAEGDRVLAKNGVTVVPDVLANAGGVVVSYFEWVQANQAYWWTADEIGDKLEHRMLHAYEEVAVSRAARTSACATRRSSSASRT

SEQ ID NO: 31012 - protein, 183 aa, Brassica napus
  misc_feature (137)..(137): Xaa can be any naturally occurring amino acid
  misc_feature (146)..(146): Xaa can be any naturally occurring amino acid
  misc_feature (165)..(165): Xaa can be any naturally occurring amino acid
MSGAVLVAVAAAIGNLLQGWDNATIAGAVLYIKKEFHLESNPSMEGLIVAMSLIGATLITTWSGGVADWLGRRPMLILSSVLYFVGSLVMLWSPNVYVLLLGRLLDGFGVGLVVTLVPIYISETAPPEIRGLLNTLXQFTGSGGMXLCYCMVFGMSLMPSPSWRXAGVLFVPSLCFPPHISSA

SEQ ID NO: 31013 - protein, 115 aa, Aspergillus oryzae
MSTDPKIQDLLNKPKSELTEYEVSLVEEHELTAGPLSLLQTATRTHTQVLIACRSNRRLLARVKAFDRHCNMVLENVKEMWTEKPKGGKGKGVNKDRFISKMFLRGDSVILVLLS

SEQ ID NO: 31014 - protein, 426 aa, Arabidopsis thaliana
MNPSTITNDLTVEILSRLPAKSVARFHCVSKQWGSIFGSPYFKELFLTRSSTKPRLLFAMAEKVNEEKNCVWRFFSTPQLENPYEKSSSTLVAAAEFHVKFSPDKLYICHCYDLKYFSIGYASGLIYLYGDRGEATPLICNPTTGRYAILPNRYTYRKAYSFFGFDPIDKQYKALSIFYPSGPGHSKILTFGAGHMKWRKINCPLRYDRHDIKSEGICINGVLYYLGSTSDCVKDGHGIVSDYVIVCFDIRSEKFTFIDVERFCRLINYKGKLAVIYWEDDVDIYKLYYSDVDEYVEYNINDDDINELRVWVLEDVKKQQWSKYAYTWTDDRFFRRRVSIAGGTASGEIVFSMLKYTPKQPFYVFYFNPERNTLQRVEIQGFGEVLKKTCRVCTFVNHVEDLNVHDFKQLKSVHPPLVDEPDSESD

SEQ ID NO: 31015 - protein, 255 aa, Candida glabrata CBS 138
MLVLALSDAHIPDRAVDLPSKFKKLLSIPDKISQVAVLGNSSNSSEFLKFVTDITPNVHIVRGEFDRATIPAIHTDKVPVVKTPGQERTIKSNRVELPMNAVITQGEFRIGCCSGYTVVPKNDPVSLLTLARQLDVDILLWGGTYNVEAYTLEGKFFINPGSCTGAFNTDWPVFSDILGNTDVKKEETKTDDSSSKSKDAKNGPDHLYVSDLDINGANVPSFCLLDIQGSTCTLYIYLYVDGEVKVDKVIFEKQR

SEQ ID NO: 31016 - protein, 292 aa, Brassica napus
  misc_feature (240)..(240): Xaa can be any naturally occurring amino acid
  misc_feature (262)..(263): Xaa can be any naturally occurring amino acid
  misc_feature (283)..(283): Xaa can be any naturally occurring amino acid
MAGKSKNNLRYQPRKSASRSTQAFTVLIGLLVVIMILLGLGILSLPNANRNSSKPNDLTNIVRKSQEESNGGDEEGNGERWVEVISWEPRAVVYHNFLTNDECEHLISLAKPNMVKSAVVDEKTGGSKDSRVRTSSGTFLKRGHDEVVERIEQRISDFTFIPVENGEGLQVLHYQVGQKYEPHYDYFLDEFNTKNGGQRIATVLMYLSDVDDGGETVFPAAKGNISAVPWWNELSKCGKXGLSVLPKKRDALLFWNMRPDAXXDPSSLHGGCPVVKGNKWSSXKWFHVHEFK

SEQ ID NO: 31017 - protein, 466 aa, Escherichia coli CFT073
MSSVGGEPWGFSKTCFLLLIRCRLVNLNLFNLVYKSIMTTDDLTFDQRHIWHPYTSMTSPLPVYPVASAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEHAEIAPDILCLGKALTGGTMTLSATLTTREVAETISNGEAGCFMHGPTFMGNPLACAAANASLAILESGDWQHQVAAIEAQLREQLAPACDAEMVADVRVLGAIGVVETTRPVNMAALQKFFVEQGVWIRPFGKLIYLMPPYIILPQQLQRLTAAVNRAVQDETFFCQ

SEQ ID NO: 31018 - protein, 133 aa, Brassica napus
MMMENKRCVCSFEESSMKRHKSDSSFSSKERKDKVGERVSALQQLVSPYGKTDTASVLLETMQYIQFLQEQVKVLSAPYLQTSPTITQEEMVDHSLRSRGLCLVPMEYTLGVAQSNGADIWAPVKTPTSPAFQ

SEQ ID NO: 31019 - protein, 399 aa, Arabidopsis thaliana
  misc_feature (132)..(132): Xaa can be any naturally occurring amino acid
  misc_feature (207)..(207): Xaa can be any naturally occurring amino acid
  misc_feature (229)..(229): Xaa can be any naturally occurring amino acid
  misc_feature (237)..(237): Xaa can be any naturally occurring amino acid
  misc_feature (242)..(242): Xaa can be any naturally occurring amino acid
MYSEDKKSKSYGSIFVYCFFCFVLIVEVARFAKPYINHQNLMETEAVVEEGFLPVANSGNLPCGLSKPRSASVRAHDQQKLSQAVTSDTRTRPPNSYCVKFQSFVTMAKQLKENGGKYESRPFSVGGYNWTXIYPVSSIPTDSGGYVSVFVRIDNSSLITNPKDVFAEITFLAYKSSTDKYQINQETEAQRFHLFNHQWGIFPYFPXFYYFKIRQYGYLCRRPKAVVLXVDITIVNXFENWXVFSNEQNIRDPIFEWRLTKYSTRFLDSYTSDPFSSGGRSWSLKVYPNGVGNATGNSLSLYLLSDQSTDKGYLEAKLQITDQIQSNHFVKKVAAWPNATENGWGFDRFLSFSDLKNASKGYLVNDTLKFQVQILSFSKTEYYSHKSSVALPISNGDST

SEQ ID NO: 31020 - protein, 220 aa, Vibrio vulnificus CMCP6
MELTVSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLLEDEEGSNSAE

SEQ ID NO: 31021 - protein, 390 aa, Zea mays
MAEQWWGSASHRSHGTSACSAAAPPPLTVTGRVACGSTFPTAAVESTSSVTFQDPYRSSTHQPLSDAASSLGDPHLDWTQTFLSGRSDASFQAVLQEPSATNDPLIRDHMDMGAGFLADQAQLAPSPYGDTEPSQAQALFDATAAVHNILMYGDSESSVSYDAGAASMQFSQLLRTSVPASTPTPTQGDGVSVGVGAPMQYLSGSSYLPFGGPLPSHLLLQALQAAKPNSRSSNANSPSAKDDCSPPPAATRKSVSEPPAAAKRPRIEAPSPLPTFKVRKEKLGDRITALQQLVSPFGKTDTASVLHEAIEYIKFLHDQVASLSSPYLKNGIPMKQFQHKGSEDSKDNGDTKQADLRSRGLCLVPVASTYTVAAETPEFWHPTFGGTFRW

SEQ ID NO: 31022 - protein, 388 aa, Nicotiana attenuata
MEVISTNTNGSTIFKNGAIPMNGYQNGTSKHQNGHQNGTSEHRNGHQNGISEHQNGHKNGTSEHQNGHQNGTSEQQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNFDIHKAAFILPSFARSMIES

SEQ ID NO: 31023 - protein, 550 aa, Vibrio parahaemolyticus RIMD 2210633
MLKNINPTQTQAWKALTAHFESAQDMDLKELFAQDAARFDKYSARFGSDILVDYSKNLINEETLKHLFALANETELKSAIEAMFSGEAINQTEGRAVLHTALRNRTNTPVMVDGEDVMPAVNAVLEKMKSFTDRVIGGEWKGYTGKAITDIVNIGIGGSDLGPYMVTEALAPYKNHLNLHFVSNVDGTHIVETLKKVNPETTLFLIASKTFTTQETMTNAHTARDWFLESAGDQAHVAKHFAALSTNATAVSEFGIDTANMFEFWDWVGGRYSLWSAIGLSIALAVGYDNFVELLDGAHEMDKHFVSTDLESNIPVILALIGIWYNNFHGAESEAILPYDQYMHRFAAYFQQGNMESNGKYVDREGNAVTYQTGPIIWGEPGTNGQHAFYQLIHQGTKLIPCDFIAPAISHNPAGDHHQKLMSNFFAQTEALAFGKSEETVKEELVKAGKNAEEVAAIAPFKVFEGNRPTNSILVKQITPRTLGNLIAMYEHKIFVQGVIWNIFSFDQWGVELGKQLANQILPELADASQINSHDSSTNGLINAFKAFKA

SEQ ID NO: 31024 - protein, 777 aa, Neurospora crassa
MAQAYDDEELSISLSPSQIRSRNKRSGDGASGFGPSTGNLHEYGQHGQQLHPNINAVMADAPLRDKMRTEQRIGAYNIVKTLGEGSFGKVKLAVHRMTGQQVALKIIARKKLISRDMQGRVEREIEYLQLLRHPHIIKLYTVIKTPTEIIMVLEYAGGELFDYIVQHGKMKEDEARRFFQQMLCAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGSYMVPTWMSPGAASLIKKMLVVNPVQRATIDEIRQDPWFLKDLPAYLHPPVEEFLNTGVDPNKAIKVSDIAPNAPPQEQEKLHNEVTEKISKTMGYGKRDVEEALEADEPSAIKDAYMIVRENKLMQSNLDFATSHPPSASILHLPSGEHRLTQKKSKSLSLRPSSFWSNTNEEYQDTLLKTDEEIPGLTTEESVPSPLHDPNMSSARSIASVSTATSPRPYVSKIGILPSSLPTYHRVFMEREKAKAEGLEPPDAIPTIVEPANQPRSQAEQEETIRRLKPHSRSQLRLDEANKRPQGLTPVHPPKKNKPARWQFGIRSRNAPWEALVCIYKALNKLGAGWIVDEDYERAHRDDDDTDDYDGPSIGSRKKSSSSMDPTKTYRLPADPWHIKIRWTTDKLKKHSVASGLSEAGENTHVSRDGSDSKYQVVAMRMEIQIYEMEHGVYLVDFKVDGYETPDGKLLEDKEVTSPFPFLDMAAKLIMQLADAD

SEQ ID NO: 31025 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLGRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 31026 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGRTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 31027 - protein, 107 aa, Synechococcus elongatus PCC 7942
MSIYVGNLSYEVTEADLTAVFTEYGAVKRVQLPIDRETGRMRGFGFVEMSADAEEDAAIAALDGAEWMGRGLRVNKAKPREERSGGGSFGGGGGRRGGGGGGGYRNY

SEQ ID NO: 31028 - protein, 379 aa, Oryza sativa (indica cultivar-group)
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILGCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 31029 - protein, 158 aa, Triticum turgidum subsp. durum
MEYQGQQQHGQAATNRFAEYGNLVAGHGAGTGMAAHGGVGTGAVAAAGGHFQPTREEHKAGGILQRSGSSSSSSSSEDDGMGGRKKKGIKDKIKEKLPGGHGDQQQTAGTYGQQGHTGTAGTGGTYGQPGHTGMAGTDSTGEKKGIMDKIKEKLPGQH

SEQ ID NO: 31030 - protein, 648 aa, Oryza sativa (indica cultivar-group)
MRSSWADSAANAEESAPAAAANHGNSRLPRSSYVPPHLRGQAAPAAPAQAGALPSAAAPAAQPSVGQPGVVGGPRWAGIVNGGGGGGGGSVGGSRQGFGVGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQGISKYVMKKEREYALRSFKSGATPILVATDVAARGLDIPHVAHVINFDLPNDIDDYVHRIGRTGRAGKSGLATAFFNESNTPLARPLSELMQEANQEVPQWLERYAARSSFGGGGGRNRRSGGGARFGGRDFRRDRGSGGGGYGGGGGGYGGGGYGGGGGGGGYGGGSSYGGGGQGFSSAWD

SEQ ID NO: 31031 - protein, 150 aa, Triticum turgidum subsp. durum
MEFQGQHDNPANRVDEYGNPFPLAGGVGGGHAAPGTGGQLQARRGEHKTGGILHRSGSSSSSSSSEDDGMGGRRKKGMKEKIKEKLPGGHKDNQQHMATGTGTGGAYGPGTGTGGAYGQQGHAGMAGAGTGTGEKKGIMDKIKEKLPGQH

SEQ ID NO: 31032 - protein, 187 aa, Glycine max
MSLRAQSSALVTLVLVLLLIKIEGNPTPKEVHENGTDASSSSTSLMEKDENQIIGCRGRPLICSRGEFPPRSICCGDRCVDVTRDRENCGVCGVRCTFNRQCCNRLCLNTNVNIFNCGRCGRVCPLGRLCVFGLCAFEQAVPTPTPVSPLPPSPPVSPSPPVSVSPLFPPVPPAKSPQPLDYQPEMG

SEQ ID NO: 31033 - protein, 220 aa, Brassica napus
MLTCIARSKRAGDESTGQPDDPDSKHAKSLTSQLKDMALKASGAYRHCTPCTASQPQGQLIKNNPATTTAKSDTESDQRFKTLYGRSNSSITAAAAMQQQQPRVWGKEMEARLKGISSGEATPKSASGRNRVDPIVFVEEKEPKEWVAQVEPGVLITFVSLPGGGNDLKRIRFSRDMFNKLQAQRWWADNYDKVKELYNVQKLSRNAFPLPTPPRSEDEK

SEQ ID NO: 31034 - protein, 366 aa, Arabidopsis thaliana
MTNHNALISDAKGSIGVAVRVPNQSLFSPGGGRYISIPRKKLVQKLEADPSQTRIHTWIEAMRASSPTRTRPGNISPLPESDEEDEYSSWMAQHPSALTMFEEIAEASKGKQIVMFLDYDGTLSPIVENPDRAYMSEEAVKGVARYFPTAIVTGRCRDKVRRFVKLPGLYYAGSHGMDIKGPSKRNKHNKNNKGVLFQAANEFLPMIDKVSKCLVEKMRDIEGANVENNKFCVSVHYRCVDQKDWGLVAEHVTSILSEYPKLRLTQGRKVLEIRPTIKWDKGKALEFLLESLGFANSNDVLPIYIGDDRTDEDAFKVLRNKGQGFGILVSKIPKETSATYSLQEPSEVGEFLQRLVEWKQMSLRGR

SEQ ID NO: 31035 - protein, 371 aa, Rickettsia conorii str. Malish 7
MNFVNHHCKQLKGAWQSQGFGMRLLSQNFQFFLAMTEQPIKIPTMNIIVKIQQDLKDEVTKLNNLIISCLKSDEELIEKVGKYLLEAGGKRIRPLLTIITAKMFDYKGDNHIKLASAVEFIHTATLLHDDVVDDSTLRRFKPTANVIWGSKTSILVGDFLFSQSFKLMVASGSIKAMNVLAKASAIISAGEVVQLVKLNERRIITIDEYQQIVKSKTAELFGTACAVGAIIAEQVDHISKDMQDFGKLLGTIFQVIDDLLDYLGNDKQVGKNIGDDFLEGKVTLPLIFLYNKLAQDKQLWLENIIKCDKRTKDDFVKIHDLMVKHEIYNETVNYLSNLENAASKLLNKIPVQNIYKDYLFSIIKFILERSY

SEQ ID NO: 31036 - protein, 481 aa, Triticum aestivum
  misc_feature (395)..(395): Xaa can be any naturally occurring amino acid
  misc_feature (408)..(408): Xaa can be any naturally occurring amino acid
MGISAKWIKSLVRIRKQDKGRSSENQEKAQNAESSEASSSARQLHKRKHSLDPALEELAVPSETSTDGTNTQLGSNSISSESASRDVHVSQTEELPREGDLAATVIQSAFRAFLARRALRALKGIVLLQALVRGYIVRKQTAETLQCMHELVRAEARVRARQAGVALENQVARKKVPGQDDCENHVREIEEGWCGGIGSVAEMQAKVLKRQEAAAKRERAMAYALTHQRQAGLRQQKPTNLQGSELDDDHWGSNWVERWVAARPWENRLLDNNAKESMPVCDDNQDEEIKSQVTPKGKAPTSSTPPNGLSKKKGASHRKSYSDINFTSFGRSSSVLPSTSLGTSKQKPKLEDEAFEEVSSQPTDVASLAVPNQKERRGQLNTSAKKRLSLPNNVXGEQRRGQPTEIRXTDPAVPSLTQNHRQTRPTKPGSKSSCRPDCTYYRFESDLGRSVPFRSWCVISPAVQASSPFIIFSGTRIVHLG

SEQ ID NO: 31037 - protein, 184 aa, Physcomitrella patens subsp. patens
MASAVASTVVAPVSVTVASSSVAASRESSSVKAFSGLKSATLFTSKSQQLSSVQNGSRVQCMQVWNPIGQPKFETFSYLPPLSDDQIARQVDYMIQQNLIPCIEFDTVGAVSRTNFSGSGSSGYYDGRYWTMWKLPMFGCTDSSQVLREIQECKTSYPSCWVRVLGFDSKKQVQICGFLVARPN

SEQ ID NO: 31038 - protein, 446 aa, Oryza sativa
  misc_feature (421)..(421): Xaa can be any naturally occurring amino acid
TSNVILHLFWDNIKCSTILLLLIKFVVIAGTKKTGRKIILIVLTAAAAGLLLPCLYVLIWHRKGKKLRHLLCTKTSSTSERNIEALIESYGSIAPTRYKYSEVTKITSFLNYKLGEGGYGVVFKGRLQDGRMVAVKFLHDSKGNGEEFVNEVMSIGRTSHINIVSLFGFCLEGSKRALVYEYMPNGSLDNYIYSENPKEILGWEKLYGIAIRVARGLEYLHHSCNTRIIHFDIKPQNILLDQDFCPKIADFGLAKLCRTKESKLSMTGARGTIGFIAPEVIYRTFGVVSTKSDVYSYGMMLLEMVGGRKNAKQMVENSSEKYFPDWIYDHFALDDGLQACQVTSEVEQIAKKMTLIGLWCVQVLPMHRPTITQVLDMFERGLDELEMPPKQNFSELLDHSVHELNTESKSSTGNTKAAQAXGVLKVEETSLVNSKDPTVTTNYATR

SEQ ID NO: 31039 - protein, 402 aa, Physcomitrella patens subsp. patens
MSTCAVAALSSPPTSFTSERVTSGITASVQPSAFLGTKISVCKGASVLSRAVSASISRQPLVAPIRAQGVAAPADTKAPTTTKKTDTKSTVIITGASSGLGLATAKVLADSGEWHVIMACRDFLKAERAARAVGMPKDSYTVIHCDLSSLNSVKQFVDNVRQSGRPLDVLVCNAAVYLPTAKEPRYTADGFELSVGTNHLGHFLLANMLMEDIQHKENDTNRRVIIVGSITGNTNTIAGNVPPKANLGDLRGLAGGLDGVRSSVMIVGGEFDGAKAYKDSKVCNMLTMQEMHRRFHEKTGVTFASLYPGCIATTGLFREHYQLFRTLFPPFQKYITKGYVSEEEAGKRLAQVVSDPTLNKSGVYWSWNNQSNSFENELSQEASDAEKAKKLWEISEKLVNLS

SEQ ID NO: 31040 - protein, 272 aa, Medicago truncatula
MNQLKEKPIIIRQVWASNLEVEFALIRQVINQYPFISMDTEFPGVIYSPNVDRRLLKPSDHYRYLKVNVDALKLIQVGITLSDGNGNLPHFGTNNSYIWEFNFCDFDFERDLYNQDSIDMLCRQGIDFKRNLCHGVDSSRFAEFMLTSGLVFNKSVVWVTFHSAYDFGYLVKILTRRNLPNRLEDFLNILTILFGKNVYDMKHMMRFCNALYGGLERVATTLNVGRVAGKSHQAGSDSLLTWHAFKKMMDTYFMNNEAQKHAGVLFGLEIAT

SEQ ID NO: 31041 - protein, 371 aa, Nicotiana attenuata
MEVISTNTNGSTIFKNGAIPMNGHQNGTSKHQNGTSEHPNGHQNGTSEHQNGHQNGTSEQQNGTISHDNGNKLVGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKPKLAPLKFYNSDIHKAAFILPSFARSMIES

SEQ ID NO: 31042 - protein, 328 aa, Synechococcus elongatus PCC 6301
MLTDDTLQVVAQHWQLAATALMVSDRPDMDWLVQAEWLRAAWFPLCNCFPALPAGAPPFWKTLWRLWLPLAQHLAQQIQQQTSPFILGILGGQGCGKTTLGQVLALLLQQQGYRVCSLSLDDGYLSFRDRCQLQTQDPRLIWRGPPGTHDLPVLQQTLTDLRAGQPTLLPRFDKSLQAGAGDRIAPVPMGRVDLVIFEGWFVGCQRVRHWPPSAWPWPIETTADQGFATDCNRRLVDYEPLWAFIDQLLILRPQDFRWSYDWRLQAEQELQRQRGQAMSPEAIADFVQYFWKALHPQLFIEPISQPTAGSKNWVAAIGADHAVTQVLT

SEQ ID NO: 31043 - protein, 272 aa, Medicago truncatula
MNQLKEKPIIIRQVWASNLEVEFDLIRQVVNQYPFISMDTEFPGVIYSPKVDRCNLKPSDHYRYLKVNVDALKLIQVGITLSNGNGNLPHFGTNNRYIWEFNFCDFDFEHDLYNQDSIDMLCRQGIDFKRNFSHGVNSSRFAEFMLTSGLVFNKSVVWVTFHSAYDFGYLVKILTRRNLPNRLEDFLNILTILFGKNVYDMKHMMRFCNALYGGLERVASTLNVCRAVGKSHQAGSDSLLTWHAFKKMMDTHFLNNEAQKHAGVLFGLEIAT

SEQ ID NO: 31044 - protein, 544 aa, Vibrio vulnificus CMCP6
MTPTELKRLYRIIKVQLEYGLDDLLPDHQLAKAPRWMRKSLFWLKNQHPEKPLGDRLRLALQELGPVWIKFGQMLSTRRDLFPPHIADPLALLQDQVSPFDGALAKAQMEQALGGPLETWFSDFDLVPLASASIAQVHTAKLKTTNQEVVLKVIRPDIRPIIDADLKLMRRMARIVAKAMPEARRLKPIEVVREYEKTLLDELDLRREAANAIQLRRNFTDSEELYVPEVYPDFSNETVMVSERIYGIQVSDIAGLKANGTNMKLLAERGVSVFFTQVFRDSFFHADMHPGNVFVNPEHPENPQWIGLDCGIVGTLNSEDKRYLAENFLAFFNRDYRRVAELHVDSGWVPADTNIDEFEFAIRIVCEPIFAKPLCEISFGHVLLNLFNTARRFNMEVQPQLVLLQKTLLYVEGLGRQLYPQLDLWETAKPFLEEWMMNQVGPKALINAIKDRAPYWAEKLPELPELLYDSLKQGKAMNQRMDQLYQGYRASKRQQATGKFLFGVGATLVVCSAILVDHTYEQLSLATAIAGVTFWLFSWRAYRR

SEQ ID NO: 31045 - protein, 116 aa, Brassica oleracea var. capitata
PQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAVVDLYRTKYKFQKGKIGPVMIT

SEQ ID NO: 31046 - protein, 432 aa, Listeria monocytogenes str. 1/2a F6854
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLASFKEALAVWGDQVAAVLVEPIVGNFGMVAPEDGFLEAVNELAHVNGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAAAKHNIAVTVNQIVGALTVYFTEDTVTNYAEAGATNGELFGRFFKGMLEEGINLAPSKYEAWFITSAHSEADILETIQAVDTVFGKMVQDN

SEQ ID NO: 31047 - protein, 267 aa, Glycine max
NQQPGLNIITEYIIGYMYPERPVANMCFKVYGYISMVQALTFLQDFKLGHYMKIPPRTMFMAQVVGTILSVFIYTVTAWWLMRTIPHLCDTTMLDPDSPWTCPMDNVFFDASVIWGLLGPRRIFGDLGEYAKVNLFFLGGAIAPFLVWLAHKAFPEQRWITLIHMPVLLGATSMMPPATAVNFTSWILVGFLSGYIAYRYRQEWWKRCNYVLSGGLDAGTAFMTILLFLALNNNNIMLNWWGNNPEGCPLANCPTEKGIVVKGCPVH

SEQ ID NO: 31048 - protein, 379 aa, Oryza sativa (japonica cultivar-group)
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVVLYMKKELELEKFITHSVPFSEINTAFDLMLKGESLRCVMRMDE

SEQ ID NO: 31049 - protein, 252 aa, Triticum aestivum
  misc_feature (91)..(91): Xaa can be any naturally occurring amino acid
MVAAAPCATRRSFRDSLKVLEADIQHANTLASECSRDYDGACVQMRMSYSPAARLFLFLLQWTDCSLAGALGLLRILIYKVYVDGTTTMSXHERKASIREFYAVIFPSLMQLEHGISDSDDRRQRAACSERYRRRDEPEDSKRPVSEIDAEIEEECGICMELNSRVVLPNCSHDMCIKCYHQWRTRSQSCPFCRDSLKRVNSGDLWMLTDQRDVVDMATVTRENIRRLFAYIEKLPLVTLDNIFDAYDSHVK

SEQ ID NO: 31050 - protein, 600 aa, Oryza sativa (indica cultivar-group)
MAAGAPPLAGVGDRGSSSSSSHPPPPPPPKILLAKPPLPPPSSSGADDDGGGGGGAGRSRQATQPGSLSLVSDAWEVHTDKILPYLTENNDFMVIGVIGPTGVGKSTIMNELYGYDGSSPGMLPPFATQTEEIKAMAKHCTAGIDIRISNERVILLDTQPVFSPSVLIDMMKPDGSSAIPILSGDPLSADLAHELMGIQGINDLSMWDLILTVDLLKHNIPDPSLLTSSTTQDKENKNDNQSGIEDYIADLCFVHARLREQDFSPSKLMVLKRVLEKHFKSSSFSIGSSGATPQVSDSSVPSSMKIEDLSSNQQDIYLLPLRTPDNSTNFEYRTCPSMLGMLRDQILSRPSRSFSKNLTERDWLRSSAKIWDMKPEAMLKDSETRNKFSRNHQGTDRDEPPSSSMAASDLTHRPGLAIVIMGVSGCGKSTVAALLAETLGCSFIEADDYHSQANKAKMSKGIPLTDGDRIPWLEALRDAVRERLDHGEDVAVSCSALQQKYREILREGDCSFRSGSGSYSSCRVKFVCLEASAEVIADRIRRRSMEGEHFMPASLLQSQLDLLQIDEAEGITVVDATVRPNAIVHDTIARFREQLASTVC

SEQ ID NO: 31051 - protein, 379 aa, Oryza glumipatula
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLSPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 31052 - protein, 379 aa, Oryza barthii
MATAGKVIKCKAAVAWEAGKPLSIEEVEVAPPQAMEVRVKILYTALCHTDVYFWEAKGQTPVFPRILGHEAGGIVESVGEGVTELAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHTVPFSEINTAFDLMLKGESLRCVMRMDE

SEQ ID NO: 31053 - protein, 453 aa, Zea mays
  misc_feature (405)..(405): Xaa can be any naturally occurring amino acid
MAKWNGYWYWWSDGHTHFTKLLCLDAPFVMAPRGGIGYEYRQERNEWGLSSNSDLLAGAVSLAEFEGATATAGSFQAIKREPAALAARRFIGDHREESTNWATHRHSMGRRFNLTMSLLAVVVLALLAAPCASAAQVKTTDTRWSFQLPLPSGVSGAESLAFDGKGEGPYAGVSDGRVLKWGGSAVGWTTFAHSANYRKIPLCTAGVVPSAETESMCGRPLGLQFHAKTGDLYIADAYLGLTRVGPGGGEAEVLATGADDGVPFNFVNGLDVDEATGDVYFTDSSATYPRRFNTEIMMNADATGRLLRYDARTRSVSVLKAGLPYPNGVAVSPDGEQVVVAHTVPCQAFRYFLRGARKGQYELLADLPGYPDNVRRDGRGGYWVALNQEKQRLDATPATGPVKHXLVGVRLDAHGVEVEELTAAKGVTLSDVAETKGKLWLGSIELEYVGLVA

SEQ ID NO: 31054 - protein, 611 aa, Cryptococcus neoformans var. neoformans B-3501A
MENPSGPPKVPAEANREIIVCINTQVSQTEPSSLATYAKQIKMNSDEIAPVATLSSSSLPPSEMKAEATSSGLTHEGQLIDEAVIQAENEDKMTPYLVFLIGSAALGGFLYGYDTGVVGIALPYVGTDLGHALSSPEQEIATAATTIGAIFGAAILGYFADKWGRKWCLLISDLFFTAGAIIIASSFSLGQLTAGRLVLGVGVGGAAIICPLYITELAPTAVRGRCVGTNGFFIPFGQTVSVAIGAGLKDVKYNWRILFGLGVVPSLLQLCLMHKLPESPRVLILRGQDDRAREVLKQIYRYASHEVIELKLEIVKAHVQATTVLERSTTWAQRAKKLWCHKPYRRSILTVCMIQVFGQFTGYNTLLYYAGTLFGLVGLSNASLGGLIPSITNTFFLLVGMLFVDRIGRRGLLMKFGPLMIIGLIWCLIAFYFMCKETGGFLVEGFVYNQRDVGLVIAGIVIFVMGFGSTYAHICWYQSEYLALEIRAIGSAISTTASFSANLVVAVSFLSELETLTPSGTYGLYLGFVVIGYVLAYYCYPETKGLSIDEAFSLFDDDFGVKKSVKMRREKAEAQKRYNAEGGESGQVVDYLGAKPETSHIERVEPVASGL

SEQ ID NO: 31055 - protein, 379 aa, Oryza meridionalis
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHTVPFSEINTAFDLMLKGESLRCVMRMDE

SEQ ID NO: 31056 - protein, 381 aa, Medicago sativa
MSCSVAVSNSPVFSPSSSLFCNKSETLTLSLSHLKPSSTTTTTTTSSSSSSSSPSPCSSPSSPFCLRLPKLPLVFTSNKDSGSQNDAVLKRKRPTRLNIPVSEHAFCVPATPSAVARDVVEAEGDGYSVYCKRGRREYMEDRYTAGVNLRGENNLAFFGVFDGHGGAKAAEFARNNLEKNILDEVIMTDEDDVEEAVKRGYLNTDSEFMKKDLHGGSCCVTAFIRNGNLVVSNAGDCRAVISRGGVAEALTSDHRPSREDEKDRIETLGGYVDLCRGVWRIQGSLAVSRGIGDRHLKQWVTAEPETKVIRIEPEHDLLILASDGLWDKVSNQEAVDIARQFCVGNNNQQPLMACKKLAQLSVSRGSLDDTSVMIIKFKHYV

SEQ ID NO: 31057 - protein, 795 aa, Vibrio angustum S14
MKFSESWLREWVNPAVNSEELAHQITMAGLEVDGIEAVAGEFTGVKVGQVVECAQHPDADKLRVTKVDVGAEELLDIVCGASNCRQGIKVAVATVGAVLPGDFKIKKAKLRGQPSHGMLCSFTELGIDVESDGIMELAEDAVLGTDFREFLGLDDVTIDVDLTANRADCLSIAGLAREVGVLNRAEVTEPQFEIVAPTAADTIAIDVKAPAACPRYLGRIVRNVNVQAETPLWMQEKLRRCGTRSIDPIVDITNYVLLEMGQPMHAFDLAKIDGGIVVRMAEQGEKLTLLDGNEAELNDNTLVIADNKQALAIAGIFGGEFSGVNTETKDVLLECAFFAPDAIRGRARSYGLHTDSSHRFERGVDATLQMKAMERATALIVEICGGEVAPIVEAESEADLPKAATIELRRTKLDRLLGHSIASEEVVEILTRLGCDVETTDAGWKATAPAWRFDMAIEEDLVEEVGRIFGYNNIPNQSPVAALSMNLHKEANLPLKRVRDLLVDRGYQEAITYSFVEPEQQKLIVPEIEPLILPFPISADMSAMRLSLWTGLLNTVVFNQKRQQPRVRLFEAGLRFVPEQSAENGMRQEMMLAGVIAGNRSDEHWDIATNTVDFFDLKGDLEAVLELTANEAAFSFKAAKHPALHPGQSAAIVVDGKEVGFIGTVHPELERKFGLNGRTIMFEIEWAAINSRMLPEAVVVSKFPANRRDIAVVVNEDVLAGDVVAACRENGGELLTDVNLFDVYTGKGVEEGNKSLAIALTLQSAERTLEEADIASAVEAIVAALAEKFGASLRD

SEQ ID NO: 31058 - protein, 402 aa, Physcomitrella patens subsp. patens
MATCVAAAVSSSLTALTSERATTGITASVQSSAFVGIKVSVCKDASALLKAVNAGTSRQPLVEPVRAQSVAAPASTNASTSSKKTDTKSTVIITGASSGLGLATAKVLADSGEWHVIMACRDFLKAERAAKSVGMPKENYTVMHCDLSSLNSVKQFVDNFRRSGRPLDVLVCNAAVYLPTAKEPRYTADGFELSVGTNHLGHFLLANLLMEDIQHKENNNSRRVIIVGSITGNTNTVAGNVPPKANLGDLRGLAGGLDGVRSSVMIDGGEFDGAKAYKDSKVCNMLTMQEMHRRFHEKTGVTFASLYPGCIATTGLFREHYSLFRTLFPPFQKYITKGYVSEEESGRRLAQVVSDPSMNKSGVYWSWNNQSGSFENELSQEASDAEKAKKLWEVSEKLVGLA

SEQ ID NO: 31059 - protein, 377 aa, Aspergillus oryzae
MSAASEPTVPAASAHSGEAVDSQTSPPSAAAENSSNTVDQAQPATNGRDIESELPSSAADGLIQKPFPRPLDSAKPTPPAELTSDQQEKYNSVLKAVSAWTTVPTTSAKNAPTEPLTDNERMFLTRECLLRYLRATKWNVSEAIARLERTLTWRREYGVEKLTADFISVENETGKQVILGYDIHARPCLYLLPSNQNTEKSDRQIQHLVFMLERVIDLMGPDQETLALIVNYNETKSGQNASVGQAKQTLNFLQNHYPERMGRALVINMPFMIMGFFKLITPFIDPLTRQKLKFNEDLRQHVPAAQLMKSMGGDVEFRYDHATYWPTLNQLADQRKAAYRERWIQGGKRIGEYENYLKTGTSPSLAQTEASNGAPAE

SEQ ID NO: 31060 - protein, 1384 aa, Trichoderma atroviride
MKPEITAINDRDKASGFQARELGVTFQNLTVEAISADAAIHENVVSQFNIPKLIKESRQKPPLKKILDNAHGCVKPGEMLLVLGRPGSGCTTLLNMLANRRNGYAQISGDVSFGSMKAEEAKRYRGQIIMNTEEEIFFPSLTVGQTMDFATRLKVPYNLPNGMTSQEEIRLETRKFLLKSMGIEHTEDTKVGDAFVRGVSGGERKRVSIIECLASKGSVFCWDNSTRGLDASTALEWAKAVRAMTDVLGLASIVTLYQAGNGIYNLFDKVLVLDEGKEIYYGPMREARPFMENLGFICDDGANVADFLTGVTVPTERKVRDEMKLKFPRTAGAIRSEYEQTAVHDQAITEYNYPTTEEAQTKTKLFQEGIAHEKDKGLPASSSFTVSFWTQVRTCIKRQYQIIWGDKATFFIKQFSTIVQALIAGSLFYNAPDTTGGLFVKSGACFFALLFNALLSMSEVTESFKGRPVLIKHKSFAYFHPAAFCIAQIAADIPVILVQVSAFSLILYFMVGLTMSAGHFFTFWIIVVATTFCMTALFRAIGAAFSTFDGASKVSGLIISATIMYNGYMIQKPRMHPWFVWLFWIDPMAYGFDAILSNEFHGKIIPCVGPNIVPNGPGFTDSGAQACAGVGGAVPGQTFVDGDLYLASLSYSHSHVWRNFGIIWAWWALFVAITIYFTTKWKLSSENGPSLLIPREQSKLVNAVRQVDEEGQVSSESGHVSEKDDATVNAQSDNNSTDDTAAQGNLIRNSSVFTWKNLCYTVKTPSGDRLLLDNVQGWVKPGNLTALMGSSGAGKTTLLDVLAQRKTEGTIRGSIQVDGRPLPVSFQRSAGYCEQLDVHEAYATVREALEFSALLRQSRDTPREEKLAYVNTIIDLLELHDIADTLIGEVGAGLSVEQRKRVTIGVELVSKPSILIFLDEPTSGLDGQSAYHTVRFLRKLAAVGQAVLVTIHQPSAQLFAQFDTLLLLAKGGKTVYFGEIGDQAKVVKEYFARYDAACPTEVNPAEHMIDVVSGQLSQGKDWNDVWLASPEYANMTTELDRIIDEAASKPPGTVDDGNEFATTLWEQTKLVTQRMNVSLYRNADYVNNKFALHIFSALFNGFSFWMVKDSIGDLQLKLFTIFNFIFVAPGVLAQLQPLFIHRRNIFETREKKSKMYSWIAFVTALIVSEIPYLIVCAVLYFVCWYYTVGFPGDSHRAGGTFFVMLCYEFLYTGMGQFIAAYAPNEVFAVLANPVVIGTLVSFCGVLVPYAQIQEFWRYWIYYLNPFNYLMGSMLVFNLWGAEIKCSEHEFATFNPPNGTTCGDYLKDYLAAGPGAVADLINPSATANCQVCSYSKGQDYLRTLNLKEYYYGWRDAGIVVLMVFSSYALVYLLMKLRTKMSKKAE

SEQ ID NO: 31061 - protein, 169 aa, Saccharomyces cerevisiae
  misc_feature (4)..(4): Xaa can be any naturally occurring amino acid
  misc_feature (39)..(39): Xaa can be any naturally occurring amino acid
  misc_feature (52)..(52): Xaa can be any naturally occurring amino acid
  misc_feature (105)..(105): Xaa can be any naturally occurring amino acid
  misc_feature (132)..(132): Xaa can be any naturally occurring amino acid
GAHXVTSNVVLVSGEGERFTVDKKIAERSLLLKNYLNDXGDDDDEDDDEIVXPVPNVRSSVLQKVIEWAEHHRDSNFPDEDDDDSRKSAPVDSWDREFLKVDQEXLYEIILAANYLNIKPLLDAGCKVVAEXIRGRSPEEIRRTFNIVNDFTPEEEAAIRRENEWAEDR

SEQ ID NO: 31062 - protein, 242 aa, Oryza sativa
MACRSAVCSPSALAPPRHRLLSLGCARTAAPSGGLPLRLRLRLRLRSSPAPRGHGADLVVRAAAAEGAVELQAKVTSKCFFDVEVGGEPAGRIVIGLFGEVVPKTVDNFRALCTGDKGYGYKGCSFHRIIKDFMIQGGDFQNNNGTGGRSIYGECFDDENFTLKHTGPGVLSMANAGPDTNGSQFFICTVKTPWLDNRHVVFGHVLEGMDVVKNLESQETSRSDIPKQPCRIVNCGELPVDG

SEQ ID NO: 31063 - protein, 42 aa, Glycine max
FHFYRWAMFGFAVGLLTEYATGSDFVDQVKILLSNFGIVDLE

SEQ ID NO: 31064 - protein, 452 aa, marine gamma proteobacterium HTCC2207
MTMEFDYDLFVIGAGSGGVRAARMAASKGKKVAVAEERYLGGTCVNVGCVPKKLFVYASQFPELFHASKGFGWSGVEAPTLDWRLLRDNKTAEIERLNSIYNNMINNSGADLFDGRATVTGPHQVEVNGKGYSANVILIATGGWPYIPEFPGSDLAISSNEMFFLDDLPKTAVVVGGGYIAVEFAGILNGLGVETHLVYRGANLLKSFDREMSDKVTEGMVAKGVHMHLSTEINEIIKTDSGLSVVLNNGSSLDAGLALYATGRQANTAGLGLEHTNTVLRPNGSIVVDDNFATADPSIYALGDVIDRVQLTPVAIQEAMVLVDHLYGHGVATIDYADIPTAVFCQPELGTVGLGEEQARAEYTEVDVYVSDFKPMLQTLGGGSDRITMKLVVDSASDRVVGCHMVGEHAAEIIQGLGIALKAGATKAHFDATVGIHPSAAEEFVTMREKSR

SEQ ID NO: 31065 - protein, 602 aa, Methanocaldococcus jannaschii DSM 2661
MINMCYNFENVKKAYEDQLKNYIKNSLIPNLSSHANNEVVKISMKKLANLGFGYLVDSTLSSITGYYKVRDWIEELLKEELQKSGENKCCNIVLCDYPEEFEISMREIPYYVNKVVKFNGVIISASYPCVLSKKHLYICPKCGRIKEVYFSELFWDDKVFCEFCGGKMEFANVMDYENFQELVVQDLSDESEYYGIEKNPIVWYCGAKPYYFGHVKITGIVREVPRSSKSRIYELIVQAINVEKLGVEKSLINLTEEDVKNIKKVAKRGDIIDILADILIPPLLCDDAIVRKAILIQQIAPYLEDIGKINILLVTEVGIDKTAILKRIGNIPGNNFINIAALKEEELATPYDKRSNILGKFYTVCGGVIPRTLGVLCIDDFNENNKLSTKLSEAFERNVLTTNKGSFYCVPAECSFLCACYPKTKFRKFDQKKSIIKQIGISSILLKNFDLIFPIRDIPDKDRDEEVAKYIFLKYINSDNEEIEGYDYVFVDVGGEKIKIDFEFLKKYVVYSRQITPKITDEVIEKISNWYDEMRKNHYITAKQLNTVIKLSIAVARAKLKECVDEDDVKEAIDIIMHYLKQVVYNPKKGIIDVILLYKNKT

SEQ ID NO: 31066 - protein, 258 aa, Nostoc punctiforme PCC 73102
MPTALITGASSGIGKAFAQELAARNTNLVLVARSKEKLSQLAKQLQEQHKIQVDVIIQDLTEPNAAATVFDATKAKGLTIDLLINNAGFGYYGDFAEGDGERQIKIVQLNILALVDLTHKFLPLMRQRRSGSIINVSSITAFQPIPYLSVYAASKAFILSFSEALWAENRQYGVRILVTCPGPIETNFFAEANFPPALASSTDKVYSSEKVVWECLDALEKGYPTVISSDTSTQIRSKLSRLVPRKLLLNILAKHFKA

SEQ ID NO: 31067 - protein, 320 aa, Oryza australiensis
MATTGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGT

SEQ ID NO: 31068 - protein, 390 aa, Prochlorococcus marinus str. MIT 9303
MATLLEQLSTMTVVVADTGDLDAIRKFTPRDATTNPSLILAAAQIPAYQSLIDEALHSSRQLLGSSAAVEEVVHEALDEICVIFGKEILKIVPGRVSTEVDARLSFNTEATIAKAHKLIGLYNDAGITNDRVLIKIASTWEGIKAAEVLEKDGIHCNLTLLFGFSQAVACAEAGVTLISPFVGRILDWYKASTGRDSYTGPEDPGVISVTKIFNYFKTYDYKTEIMGASFRNLDEIIELAGCDLLTISPKLLDQLRSTEAPLMRKLDAVNPVAAESQIHVDKESFESMMRADRMAFEKLDEGIRGFSKAIETLEAQLAHRLAVLEGGAAFCHVVQEIFMLNDLDGDGCITREEWLGSDAVFDALDHDHDGRLLQEDVRSGLGAALALTTA

SEQ ID NO: 31069 - protein, 100 aa, Zea mays
NFSFSRELADYIISIMDVFGGDKIPRKGGPGITQADLLVINKTDLAPVVGADLFVREGDAFRMREGGPFVFAQVKHGVGVEGIVNHFLQGGEIGTGNKGG

SEQ ID NO: 31070 - protein, 145 aa, Triticum aestivum
  misc_feature (106)..(106): Xaa can be any naturally occurring amino acid
MASLSVATLPQLAGAPAAAAAKKRSGVTYVEGMNAYSGLKGLNKVTMLGVRKSADYKFARIVASLSPAGKRRGGSFGAQCNAAGEIFQIAVVMNALTLVGVAVGFXLLRAEAAFKRSRRSNETNQRRVPALTSRFGSGQAVGRKP

SEQ ID NO: 31071 - protein, 241 aa, Aspergillus nidulans FGSC A4
MSTRQQALATAQVYIKRYYTKNEIRNTNPYLVLTTAFYLACKMEECPQHIRFVVSEARALWPEFIVPDVSKVGECEFSLISEMQAQLIVHHPYRTLSELQPELSLTSDEVALAWSVINDHYLTDLSLLYPPHIIAVMAIIVAVVFKPSSQTAFHGSAAPIAGAMRDGGMNILAALSDKGGAGPPPRIQKLIAWLAESEVDIKAVIESTQELVSLYEVWEQYSEKNCKELLGRMIRSKSLDK

SEQ ID NO: 31072 - protein, 950 aa, Methylobacterium extorquens
MTLIKEIDYGTPIRLNEQTVTLTIDGESVTVPAGTSVMAAAMHMGTKIPKLCATDSLEPFGSCRMCLVEIDGRRGAPASCTTPAENGMVVHTQTDKLHRLRKGVMELYISDHPFDCLTCAANGDCELQDTAGQVGLREVRYGYDGDNHVKPASDRYLPKDESNPYFTYDPSKCIVCNRCVRACEETQGTFALTIEGRGFDSRVAAGPTNFMQSECVSCGACVQALPTATLQEKTIHQYGQPDHSEVTTCAYCGVGCAFKAEMQGDKVVRMVPYKGGKANEGHSCVKGRFAYGYATHKDRITKPMIREKITDPWREVSWEEAINHAASEFKRIQATYGRDSVGGITSSRCTNEEAYLVQKLVRAAFGNNNVDTCARVCHSPTGYGLMSTLGTSAGTQDFKSVEESDVILVIGANPTDGHPVFGSRMKKRLREGARLIVADPRKIDLVKSPHIRADHHLPLKPGSNVAFINAFAHVIVTEGLIAEDYVRERCDLAEFESWARFIAEERNSPEAAQAITGVDPQEIRAAARLYATGGKAAIYYGLGVTEHSQGSTMVMGMANIAMATGNIGMVGAGVNPLRGQNNVQGSCDMGSFPHELPGYRHVSDDATRESFEAIWGAKLDNAPGLRITNMLDEAVGGSFKGMYIQGEDIAQSDPDTHHVTSGLKAMECIVIQDLFLNETAKYAHVFLPGASFLEKDGTFTNAERRISRVRKVMAPMGGYGDWEGTVLLANALGYKMEYTHPSEIMDEIAALTPSFAGVSYDKLEELGSIQWPCNEKAPLGTPMMHVDRFVRGKGRFMITEYVPTDERTTGKFPLILTTGRILSQYNVGAQTRRTENSRWHEEDVLEIHPFDAEMRGIVDGDLVALESRSGDIALKAKVTERMQPGIVYTTFHHAKTGANVITTDYSDWATNCPEYKVTAVQVRRTNRPSDWQAKFYEEDFSLTRIAEAAE

SEQ ID NO: 31073 - protein, 279 aa, Cryptococcus neoformans var. neoformans B-3501A
MMSSSPTSTPHQVPSFLANILLSHISPLDPPSTSSTTFDHHRSPTTQNPSHPQALQTAEPPPNPLYLPPPALPKVEEDLVPPENFALVSSGVYRCGFPKKRNFKFMETLRLKTVLTLVLEEYPKANLEWCQSQDIQFMQFGIPGNKEPFDNIPEDVICAALVAILDRRNHPILIHCNKGKHRTGCLIGCIRRLQAWSLTSIFDEYRRFSAPKSRAVDQQFIDLFDIMPVWEAVCRPKGGGLGNLPDWGMLVLPKGVVEVGRDGKEKKRVERDIFHMRGL

SEQ ID NO: 31074 - protein, 204 aa, Oryza sativa (japonica cultivar-group)
MASFRHRLPPPYRHKLKERGIIVLINRLMVVKLDCFKVSVQYLYIEVGLCMLQDGVLVSDSDRLSMTRDNVKKIMRIVEALENRGYRIPLTKEEADLYERLAVIAKQLKGPTGDLHRRVYNLLSTSRLLASAGGTAGPIYIPSSAKVDEQSVAELLEALQQQTEAVAKLGNVMKRDTRDLEIILSEDTDMAEDSVGRRALKMYN

SEQ ID NO: 31075 - protein, 453 aa, Escherichia coli CFT073
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGRGQGGGRGQQQPRRAESGAKSGNAKPAEKPSRRLGDAKPAGEQQRRRRPRKPAAAQ

SEQ ID NO: 31076 - protein, 458 aa, Ralstonia eutropha JMP134
MSDKQKINVVSFIDERPVGRYQIFIIILVFLVVAFDGMDVAIMGFAAPEIIRTWGITKSQMGSILGAVFFGVAVGALIAGPIGDRYGRKLILTASVFWFGVLTLISSQATDVNTLITLRILTGLGLGAALPNAVTLISEYVPVRKRSLIVTIVYSGFTGGAAVAGLIAAWLLQAFGWRVMIAIGGLLPIVLALILAIWLPESVAFLTLKGKRLAAIPKILRKIDRGSSVLSDATFWIPTPVDQSKGSVAILFTKAYAMGTFLLCVAYFMGVCATYVMVNWLPVIAKDAGFTLGQGVVITTLITLGGPIGSICIGAIMDRVRPHWVLVPTFLIAGAFLASLSVAPRDFGALCVLMFALGCFFHGSMTGLQALSAMSFPTAARSTGISWMHGFGRLGAIASGFIGATMMGWGWGLGQIFLALAVPMVVAACAVAVLGMRNERTRIEHSEIGSSQALSLRT

SEQ ID NO: 31077 - protein, 382 aa, Oryza sativa (indica cultivar-group)
MSSTSRAPRGIREETLLRVPGASVHLLDGAEGPVELARGDLAVVRIAKDGVAVATVARVGRGLGWPITRDEPVVRLDRMHYLFTLPDSTGGGGGGALFLNYGVSFAAPDDALLASLDALLKANACFSTPSSPAPSRSSATTTTRPAPTTTATADGYWNDFAPRMDSYNNVLAKAIAAGTGQLVRGIFMCSEAYATQVRASDRSLTFNLFSVQSVDFDSASRAGSTRSRPDSSSSCRQRDQTIRRRRVRKLSEMTEKMSQSLLDTVIAVTGSMAAPLLRSKQGKAFLATVPGEVILASLDAINKVMDAVEAAERRSLAATSNVVSGAVSRRYGESAGEATEDAFATAGHAVGTAWNLFKIRKAVTPSSSLPGNMVKSAVRNRK

SEQ ID NO: 31078 - protein, 140 aa, Brassica napus
QVCGQTDMEDAEMRKARRMKVAVVREDYLVDCFTKQRKLPFDKYKIEDAGEGMVTVKVKGRSAVHEASGLQEHCHILEDGNSIYNTTLSMSDLSTGINSYYILQIIQEDKGSDCYVFRKWGRVGNEKIGGNKLEEMEKSD

SEQ ID NO: 31079 - protein, 314 aa, Methanosarcina mazei Go1
MKKEWKGEKGAIKPIRALTFGEALFDTIKGTAHLGGAPLNLAAHLAKLGARTAVLTAVGKDELGKILLSRAEEMGVDTSYILIDEKRPTGTVTVELKYEGIPVFSINEGVAWDVITPDEKQFEALAGDEWDVFCFGTLAQRSEENRKTLKRLFQEIKTKHFFYDVNLRAEYYTEEWILSSLEHCTILKMNEEEAEAISGMLFDTIYKFRTLCRLLTDRYPEMSVICITKGPDGAAVYHDGVYEEVSASPIEVADTVGAGDAFSAGFLYAYLSGNGASKALSIATTLGTYVASKPGAVPEYSEELIEELKRYNKT

SEQ ID NO: 31080 - protein, 630 aa, Arabidopsis thaliana
MDICCKDIISDHSKKDIISDLPEALICHILSFLPIEDSALTSVLSKKWQHLFAFRPNLEFDDAVVYLNPDGERNETIFENFVDRVLSLQGDYPINKFSLTCRDFTDPTCVSRWISNVMERGVSDLDLRCIVYWDNGTMPPDIFVSKALVHLRIETGNGAFIDVEDVFLPNLKTLYLNKVLLRHSDNGFVKLITSCHVLEDLFIMNICWDGYLKRSLSSKTLKRLTFFCEDVHAVNPESVSFDTPNLVYFVYHDCVADKYKNMNFDSLVYASICLQMTSHQRTHASYEHLVGNATDFLLGISNVQILELFANTIEVCIVIPSSSFLATLKQKEDKQTDQKAGWESLPVLLKNCPDLESLIFDGLHHNDTIKCEDVDGCLCKSSRGIPSCLSSSPVQFLTIWKFGEICDDYDDMEKQIELVMYFLETMPNLEEMKLFYDTQIYEDVISKLQMDLRRTLSLRSLFNARCYQPSCSGIIQRDDVHEEKPHYGSFLHQRSFSSSMILSQQHMMRSPSHFPLCSPFGVSTYRPMSTSHISGSDESGDVKLTSPPPPHLVQQDTVIEVADAAIDSSIQLDFVQQIVHNVHSLTGLNWWASIVFTTFLIRGVTIPLMIECERWFSKRMVIKQCSFVNT

SEQ ID NO: 31081 - protein, 427 aa, Yarrowia lipolytica CLIB122
MSSVINLVNTIVGAGILAMPFALRQNSLFLGVFLIIMSGSLSGFGLFLQGRCAFYAPARQASFFALASQTYPSLSVIFDIAIAVKCFGVGVSYLIIVGDLMPQVVQSLFNPGDNTQFIVSREFWILASVAIVVPLSYLRKIDSLKYTSLVALISVGYLIVLVVAYYLFSDISSTRAPISLFKPAKISNVLSCFPIIVFAFTCHQNMFSIVNELQHRTAANINRVVATSISFSAFCYCLVGVTGYLSFGNIVSGNIVSMYPSSVATEIARFCIAFMVVLSYPLQCHPCRASLDHTYSWFQSSGFVKSLAHKVSWSRLPSSEEEMVHPTSGGQPGSMTTARFGIVTTIIVVASYITALTVESLELMLAFVGSTGSTSISFILPGLFAYKLIGADASNSEDWLKWSGLALCLYGVLVMIVSLGINIYLLL

SEQ ID NO: 31082 - protein, 360 aa, Triticum aestivum
MDRDALRMVCSPQFWRMGVLWTLSLLYSYLLLFLRGRTAAPRRREDVGRGGRPICVVTGATSGLGRAAAAALAREGYHVVLAGRSAQLLSETAKEIHRQQPDACLEAFQVDLSSHRSIKKFEASLNQWIRDSNLEPSIQLLINNAGMLAKSHRVTEDGIDEVMQTNYIGPFILTSILLPLLKNSPVPSRVVNLTSFTHRCVSEIDVSEEALQGVKFGQHSVGGSYPLASTYEYTKFCLLVFSYELHRQLHISSGISVMAADPGVVETRIMRELPPCLSRFAFFILRTLNLLQQPDTGIDAVLDAALAPREASGKYFFGGKGRTIRSSVLSYDIEIAKKLWAASSALLRELRLRDCESRTG

SEQ ID NO: 31083 - protein, 256 aa, Triticum aestivum
KPREIHNLFSHRPAFDHCLLEYTGRANQVVAFVTFFTHEAALSAMTSLNGTIFDPETGYRLHIELAKSTSRRPRGGGEVYRVIDKRTNKTEGNADENVGDEVDEEVWGGDEDGANDDNGDGESDEPSGTENENSSDKNELPADQSDQPRHKKQNGKSLSNDGRDKSSNDIPPCSTLFIANLGDTCTKDELNEVLSKEPGFDVLKMRRRGGMPVAFADFTDIESSTAAMNSLQGTVLASSDSDGLHIEYARSKMRKS

SEQ ID NO: 31084 - protein, 838 aa, Oryza sativa (indica cultivar-group)
MAGGFAVEAKVAGGGERREFKGKITWYVWLCGIIAATSGLMFGYDVGISGGVTAMDGFLIKFFPSVYARKHRARENNYCKFDDQRLQLFTSSLYLAALAASFAASRLCTRLGRRRTMQLASVFFLGGTALCAGAANLAMLIVGRICLGVGVGFGNQAAPLFLSEIAPAHIRGALNILFQLDVTIGILIANVVNYFTSSAHPSTGWRYSLGGAGVPAAVLFLGSLVITETPTSLVERGRRDAGRATLERIRGTRDVGDELDEIARACEAAAALSAEESAYRRLRRRESRPPLVIAVAMQVFQQFTGINAIMFYAPVLFQTMGFKSNGSLLSAVVTGGVNVVSTLVSIVAVDKIGRRRLLLQACGQMLIAQANGNPGEKWAVAIVVLICVYVSSFAWSWGPLGWLIPSETFPLATRTTGFSFAVSSNMLFTFLIAQAFLSMMCSMKAFIFFFFAIWIVIMAAFVFWLLPETKGVPIDEMVDTVWRRHWFWKRFFTDAGDGRIVDAVFPAEASPTWKGIEHGLQLLKTGLIWRIGDGTKVRIWRDKWIPRASSLMLMGRSGRCRLRWVSQLLKQGEKSWDVDLIKHVCHPLDVEEILKINLSPYQDEDFLAWHYEKSGIFSVRSAYRLAWLNKFHPDGEGSSRETDGDRSIWRRIWSTPVPPKVRIFAWRLARNYLATQKNRCKRKLQAVATCTICGQGEEDEFHAVISCTRPRALRETLRASWRLPDKRSLSKLGPGWLLGGLDKLSENERAQFLLVLWRAWYLRNDCVFGSGQATVKGSASFLLNLWNSLCPSGSATLENEKGKIVSEGRQSDVNGCGERTQVAGVWQAPAMGWVKINW

SEQ ID NO: 31085 - protein, 149 aa, Staphylococcus epidermidis RP62A
MERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 31086 - protein, 217 aa, Arabidopsis thaliana
MDSNWINCPSVFSSSSSSSRRCQSRSDLYLGGGYEDLEGEDDLKAEFICPFCAEDFDIVGLCCHIDEEHPVEAKNGVCPVCTKRNLCLFLDERFYVQRRRRLRRGGYSSTYLALKKELREANLQSLLGGSSSFTSSTNIDSDPLLSSFMFNSPSVNQSANKSATPVTVGNAATKVSIKESLKRDIQEAPLSGEDQEKAKKSEFVRGLLLSTMLEDDF

SEQ ID NO: 31087 - protein, 319 aa, Staphylococcus epidermidis RP62A
MAKLNINNEIKKVEKRLEEAIISSDQTLQEASFHLLSSGGKRVRPAFVILSGQFGSNNKPSEDTYRVAVALELIHMATLVHDDVIDKSDKRRGRLTISKKWDQSTAILTGNFLLAMGLKHLSEISDTRVHSTISKSIVDVCRGELFQFQDQFNSNQTITNYLRRINRKTALLIQLSTQVGAITSNASNDVIRKLKMIGHYIGMSFQIIDDVLDFTSSEKKLGKPVGSDLMNGHITLPVLLEMRKNKTFKDKISQLNPDSPQHAFETCITIIRQSESIEQSKQISEKYLNKAINLIDELEDGPNKELFRKLIKKMGSRNK

SEQ ID NO: 31088 - protein, 333 aa, Cryptococcus neoformans var. neoformans B-3501A
MNFFNRQKTRTPADTVKSLKDNITRLDNAPAGEASRKINEDISRQLSIVKILLSGEGDTEPNPDAVAQVANEVYAQDLLSSMVVHLGKFDFEARKDVCNIYGVLLRRQLGSRSPTVDTIATRPDIIFNTLKGYANQDIALNTGMILKEMLRYEPLARILLYSDQFYTFPSYIENTSFGISCDALANMKVCETLTRHKPMVAQYIEANYDRFFNMYNTLILSSNYVTKRQSLKLLGEILLDRANYNIMTRYIASEANLKMMMNFLRDKSRNIQFEAFHVFKVFVANPNKPPQIASILRRNKEKLLVFLREFHNDKDDEQFNDEKQFLIHQIQQL

SEQ ID NO: 31089 - protein, 383 aa, Arabidopsis thaliana
  misc_feature (30)..(30): Xaa can be any naturally occurring amino acid
  misc_feature (98)..(98): Xaa can be any naturally occurring amino acid
  misc_feature (137)..(137): Xaa can be any naturally occurring amino acid
  misc_feature (163)..(163): Xaa can be any naturally occurring amino acid
MATQGQVITCKAAVAYEPNKPLVIEDVQVXAPPQAGEVRIKILYTALCHTDAYTWSGKDPEGLFPCILGHEAAGIVESVGEGVTEVQAGDHVIPCYQXAECRECKFCKSGKTNLCGKVRSATGVGIMMNDRKSRFSXLMGKPIYHFMGTSTFSQYTVVHDVSXVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 31090 - protein, 130 aa, Synechococcus elongatus PCC 6301
MTREVFYTDQAPAPVGPYSQAIAASGRMLFVSGQIALDPATGTMVGGDDVEVQTHQVLSNLKAVLAAAGASFGDVVRTTVFLADMEDFARVNAIYATVFDEATAPARACVQAARLPKDAKVEIDCIAVLP

SEQ ID NO: 31091 - protein, 246 aa, Oryza sativa (japonica cultivar-group)
MDSEHWISSLAAAKRFYAAQLGHVDDMAGIGMEEVEMEMEDDGEGMELELEMQLEEATWPDVACPYCYEDHDIASLCAHLEEDHPYEPHTSPCPICFEKITRDMLNHITMQHGYLFKSGRRMRRFDIPESQALSLLSRDLRDAQLQALLGGGHRQRRSNTTATNISADPLLSSFGLGFSTLDSEERSKAPVPIPDDTSIHKDTPAQPWESRIDSSLTSEEREQKRKQATDRATFVQGLVLSTLFED

SEQ ID NO: 31092 - protein, 426 aa, Glycine max
MNQLCGVILLVHSVLCFHARAQTAAPSGDAVSNFQPSLAVVIGILGVMFLLTFFLLMYAKFCQRCASSPVGDTENQLPFVRSRSRFSGIDKNVIESLPFFRFSSLKGSKEGLECAVCLSKFEDVEILRLLPKCKHAFHIDCIDHWLEKHSSCPICRHRVNPEDHTTFTYSNSLRRLANQSEVGEESNIEIFVQREEEHHGSSRFSFGSSFRKTGKYVKEEEFLIEKGAEDSDGNQKGYHKHNHRITISDVVFKHRWSNVSSSDLMFLNSEMLNDASSNRFSNLESNADMMSSTRGVVENEQIMNIKEEMERKISFESKVGVLNNIKSVSDKHLLFTSDSAGKSTHAPKYANPGEKRSMSEITAVSRFGDLGMKMRVFKDSSSLQNNLKEERMRQIWFPIARRTAQWFVNRERRSQQSQNKQQPLDV

SEQ ID NO: 31093 - protein, 361 aa, Candida glabrata CBS 138
MVVHNPNNWHWVDKNCLGWAREYFQEKLVGLAAQEGDCQLSVTSVKTVDGDCEVSQRKGKVISLFDLKIVLAYDGELAGDKFEGTVSVPEVAFDSDPEDYQFVVTIFQETSKLNERVKPLIRERLVPQLRSAFQQFGPDLLTTHSSDIQVGADQVSSTFTRANQEASVPVAGASQAKAPASAQSTAKSSTQVQKPVEKATSGASASKPGTTSRVVNTSSMHLEPSFNVPAAELQRTFLDRMRLQQFSRSELRMLHSGSGSGAGGETLGEGDEYELFGGNVRTRVVSVGDSSIKLQWRLSDWTPEWFSELSIEFHESQEYHETKLKITWDKIPVGQEDRVRQNFEEYYVRAIKLTFGFGAVL

SEQ ID NO: 31094 - protein, 163 aa, Triticum aestivum
VTSRTEVEKKQSRTGPEFPGYPADLCYSLQETLFAMLVEITERAMAHCDSKDVLIVGGVGCNERLQEMMRIMCSERGGRLFATDDRYCIDNGAMIAYTGLLAYAHGVTTPLEDSTFTQRFRTDEVHAIWREKEVPVLNNTDSDAAAEVSIDGTSGPTPIAVDS

SEQ ID NO: 31095 - protein, 405 aa, Synechococcus elongatus PCC 6301
MTELVYGCVRRQRTLDALIDLLAQRPAAQQPPVLRTVLQLGLYQLRYLEQIPTAAAVAETVQLAKQLGLGGLSGAVNAILRQYLRQSEERDPLPLPSDPIAALAIHQSFPDWLVQLWSDRLGLDEAEFLCHWFNQPPSNDLRINPLRTERSQVQAALEAVGIRSTPDPQLPQALRLIDPPGPIRQLPGFDEGWWMVQDSSAQLIAHLVDPQPGETVLDVCAAPGGKSTHLAELMGDRGQVIACDSSAKRLRKVQENAQRLQLSSITTRAIDGRQIKGIQADRILVDAPCSGLGILHRHADGRWRQSPDSVAELAQLQSEILDAAAACLKPAGTLVYATCTLHPAENEAVIEQFLQRHPDWQMAPLAADSPFQAWAEANGTLRIWPHRHDRDGFFGARLQRSPARD

SEQ ID NO: 31096 - protein, 1509 aa, Oryza sativa (indica cultivar-group)
MADPQHVQEEAAGAEAVHAHAARHDGAVVMEILSRSLQSMPASPDVSAYFSGASSRRPSAADEVDDEEALRWAALERLPSFDRLRTGLMRADADSSGVGVGAVGRGRRWYAHREVDVRTLELAQRQAFVERVFHVAEEDNERFLKKLRARIDRAGIQMPTVEVRFRNVNVQAECHVGTRALPTLANVSRDVGESLLGLVGLNFAKRKALHILKDVSGIVRPSRMTLLLGPPSSGKTTLLLALAGKLDPTLETSGEVTYNGYGLDEFVPQKTAAYISQHDVHAGEMTIKETLDFSAKCQGVGQRYELLKELAKKERQLGIYPDPEVDLFMKATSVEGSTLQTDYILRILGLDMCADVIVGDELRRGISGGQKKRLTTAEMLVGPTKVLFMDEISTGLDSSTTFQIIRCIQQIVHMGEATVLVSLLQPAPEIFELFDDVMLLSEGQIVYQGPREHVLEFFERCGFRCPERKGVADFLQEVTSKKDQEQYWIQSEKPYRYVSVPEFVAKFKKFHMGKSLKKQLSVPFNKGKIHKSALVFSKQSVSTLELLKTSCSKEWLLMKRNSFVYIFKTVQGILVALIASTVFLRTQLNTRDEDDGQIYIGALIFVMITNMFSGFADLSLTLARLPVFYKHRDFLFYRPWTFALPNVLVRIPSSLFESIIWVAITYYTMGFAPEASRFFKHLLVVFMLQQMAAGLFRVTAGLCRTVVVTNTAGSLAVLIMFVLGGFILPKDAIPKWWVWAYWCSPLTYAYIAFSSNEMHSPRWMDKFVPDGKRLGVAVLENSGVFTNKEWYWIATGALLGFTILFNVLFSLSLMYLNPVGKPQSILPEETDSQENIQEGKNKAHIKQIITVETPEPVSPNSIITLDKVIQQLRGYSANTSDRSHSYINAAGRTAPGRGMVLPFEPLYMSFNEINYYVDMPLEMKSQGVTADKLQLLSGISGAFRPGVLTALMGVSGAGKTTLMDVLSGRKTGGYIEGEIYISGYPKNQATFARISGYCEQNDIHSPQITVRESLLFSAFLRLPKEVNDQEKKIFVDEVMELVELTGLKDAIVGLPGVNGLSTEQRKRLTIAVELVANPSIIFMDEPTSGLDARAAAIVMRTVRNTVNTGRTVVCTIHQPSIDIFEAFDELLLLKRGGQVIYSGPLGTNSHKVVEYFEAIPGVPKIEENRNPATWMLDVSSAASEVRLEIDFAEYYRSSTMHQRTKALVKELSNPPPGSDDLYFPSQYSQSTFNQFKLCLWKQWWTYWRSPDYNLVRIFFALFTALMLGTIFWRVGHKMESSKDLLVIIGSMYAAVLFVGFENSVTVQPVVAVERTVFYRERAAGMYSAIPYALAQVVVEIPYVFVETVIYTLIVYPMMSFQWTPAKFFWFFYVSFFTFLYFTYYGMMNVSVSPNLQVASILGAAFYTLFNLFSGFFIPRPKIPKWWVWYYWLCPVAWTVYGLIVSQYGDVEDFITVPGQSDQQVRPFIKDYFGYDPDFMGVVAAVLAGFTVFFAFTYAYSIRTLNFQQR

SEQ ID NO: 31097 - protein, 477 aa, Oryza sativa (japonica cultivar-group)
MNTNYSSLPLTSIELQSNQRTSEVANGVGYNGHAKISKQDSFLVDGENDDLPLIGDGPAGPPEGSGVPAAVFNLATSIIGAGIMALPATMKVLGVAVGLVSILVMGILSEVTIELLVRFAVYCRALSYGEVVHKALGRPASIVAQMCVIINNAGVLIVYLIIIGDVMSGSLKHIGVMDQLIGHGEWDNRRLLILVVLVIFLSPLCALEKIDSLSLSSAASVALAVVFVVVSCIIALVKVVEGKISMPRMGPDFSSRAAMLDLLVVIPIMTNAYICHFNVQPIYNELKEKTPHNMYKIGRITTVLCVVVYALTAVSGYLLFGEDTESDVLTNFDKDLGIRFSSILNFIVRIGYVIHLVLVFPVVHFSLRQTVDSLIFGELAPHSRKKMLTLTVVLLALIYLGSTMIPNIWVAFKFTGATTGLALGFIFPALIALRLDKEGKSLGKGERLLSIVMLGLAMVVSIIGVIGNVYSLRSKSA

SEQ ID NO: 31098 - protein, 607 aa, Bacillus cereus G9241
MCGITGWVDWKEDLSNQHVILEKMANRIQHRGPDAEGFWFSPRAAFAHRRLIVIDPEGGTQPKTFRAGDYTYALTYNGEIYNFRELREQLRKCGHAFETHSDTEVLLHAYLEWKEDCVQHLNGIFAFALWDDQKQQLFLARDHLGVKPLFYTERNDSIIFGSEIKALLAHPSVPAEIDADGINEIFGLGLFRTPGCGVFKHIQEVRAGHSITFTRDKKVVQKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLHAKDLPSAGEMETSLYLLFCEMKKDATVALSGESADEVFGGYPWFHQEELLYVDKFPWLTNWKNTSPLLLNEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDIRNRRKSAYPTSQDPHYLQTIRHLSLDMCSNKNNPIFSLINHSTLLAIANQSNKEINNFEARSAMEYMLQVNEWLKTYHIHIA

SEQ ID NO: 31099 - protein, 425 aa, Vibrio parahaemolyticus RIMD 2210633
MSEDNRQAATPEEEHRQKALDYHAYPTPGKIAVELTKPAETAGDLALAYSPGVAEPVREIAQNPDNVYKYTAKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLEDSTIVCLGAGAAAVACMELLIKCGAMREKIYMLDRKGVIHTRRDDLNEYKQLFANNTDKRTLEDVIEGADLFLGVSGPNLLPPEALKLMADKPVVFACSNPDPEIKPELAHAVRDDLIMGTGRSDYPNQVNNVLCFPFIFRGALDVRASEINDDMKLAAVDAIRALAKEPVPESVLKAAGVEKLEFGSDYIIPKPMDPRLLPRVAKAVAQAAVDSGVARIEMPENYMAE

SEQ ID NO: 31100 - protein, 209 aa, Magnetospirillum magnetotacticum MS-1
MGDLIQAERDQLSRNEHIKEASGYLRGKLAEALLMPASGAVSDDDGQLVKFHGMYLQDDRDLRPERMRKKLDRAYAFMIRLRIPGGVLTSKQWLVLDEIARSYANGSLRATTRQTFQYHGVIKSNLKRTMKAIDGALLDTIAACGDVNRNVLSASNPYQSKAHAAAYDLAKAISDHLLPRTGAWREIWLDGEKVVGGEDETVEPIYGKT

SEQ ID NO: 31101 - protein, 147 aa, Glycine max
  misc_feature (10)..(10): Xaa can be any naturally occurring amino acid
  misc_feature (31)..(31): Xaa can be any naturally occurring amino acid
  misc_feature (34)..(35): Xaa can be any naturally occurring amino acid
  misc_feature (43)..(43): Xaa can be any naturally occurring amino acid
  misc_feature (46)..(46): Xaa can be any naturally occurring amino acid
  misc_feature (48)..(49): Xaa can be any naturally occurring amino acid
  misc_feature (52)..(52): Xaa can be any naturally occurring amino acid
  misc_feature (58)..(60): Xaa can be any naturally occurring amino acid
  misc_feature (64)..(65): Xaa can be any naturally occurring amino acid
  misc_feature (108)..(108): Xaa can be any naturally occurring amino acid
  misc_feature (114)..(114): Xaa can be any naturally occurring amino acid
  misc_feature (117)..(117): Xaa can be any naturally occurring amino acid
  misc_feature (120)..(122): Xaa can be any naturally occurring amino acid
  misc_feature (134)..(137): Xaa can be any naturally occurring amino acid
  misc_feature (142)..(142): Xaa can be any naturally occurring amino acid
  misc_feature (144)..(144): Xaa can be any naturally occurring amino acid
QTWHAFATIXAVQPSSAVKGLGGSSLSGAKXFIXXSRQSFKPXSTXAXXGVXKYGDKXXXFDLXXLGNTTGQWDLYGSDAPSPYNPLQSKVFETFAAPFTKRGLLLKXLILGGXSLXTYXXXSSTGDVLPIKRXXXXKPKIXPXGKL

SEQ ID NO: 31102 - protein, 375 aa, Glycine max
MVATSTNQSELETSKKDSTYDRIAEVKAFDETKLGVKGLFDSGITKIPRMFHHAKVEDHTETMPNDSNFSVPIIDLQDIDTNSSLRVKALDKIRSACKEWGFFQVVNHGIAVDLLDEMICGIRRFHEQDAEVRKRFYSRDMNKKVRYFSNGTLYRDPAANWRDTIAFFRTPDPPNPEEIPSVCRDIVIGYSEKVRALGFTIFELFSEALGLHSSYLKELDSVDGQFLLCHYYPPCPEPELTMGTSKHTDISFMTILLQDQMGGLQVLHQNQWVDVPPVHGSLVVNIGDFLQLISNDMFVSVYHRVLSSHTGPRISVASFFANSFQQSSLKVVGPIKELLSEDNPPIYRDTTVKDVKAHYFEKGLDGNNSLHPFRL

SEQ ID NO: 31103 - protein, 739 aa, Nicotiana tabacum
MSSKNLFSFLFLLVLPFSSSSDATAWIKSGFWYAGSEFPVPEIPSTMFTHIHFAFAYINASSFELYVSHSDEPYISTFSNTVKQKNPSVITLLSIWGGRDESPNFFAMTSQFSRRKSFITTSIKTARQYGFQGLDLIGVNPNTDANMTNMRSFIEEWRTAINSESKSSGTRTLILTMGAYYSPMLDSMSYPIDTIIRNFDWVHLKAYAALYDPTSKLNTDYGIKEWIKRGLPANKIVLGLAYHGYAWTLVNPKHNTVRTPARGLAITQDGSISYRYIKQYMKSYGVTPVYNSTFVVNYVTIGSFWIGYDDVEAIRTKVSYAKDKGLLGFAAFQIPSDDVNWELSKTAQDEEEEDQSGSNRRLLAILLPTLTLTILLLSTIVFILKKKTLRSEGIRELNERAIGHNLKVFKFDKIKAATDNFSIKNKLGEGGFGPVYKGRLSDGQEIAIKRLSAYSKQGVEEFQNEVTLASKLQHVNVLQLQGCCTEREEKILIYEYMPNKSLDFYLYDPVQSLQLDWETRVRIIEGVTQGLLYLQEYSAFTVIHRDLKASNILLDDEMKPKISDFGIAKLFQKDEKEANTGRIVGTYGCVPPEYVKRGLYSRKYDVYSFGVLLLQILGEKKNSSEYGIKNDLNLLEYAYELWEKGNGVDFLDLSLQDDSRIGKQLRYMQAALLCVQEKWEDRPSMLEVYSMLKNETEVLPNPKVPAFSKNKDNDTQETLVTPDLTCSDNSLTISQLIAR

SEQ ID NO: 31104 - protein, 216 aa, Cryptococcus neoformans var. neoformans B-3501A
MSGEIRRKLVIVGDGACGKTCLLIVFSKGMFPEVYVPTVFENYVADVEVDGKKVELALWDTAGQEDYDRLRPLSYPDSHVILICFAIDSPDSLDNVQEKWISEVLHFCQGLPIVLVACKKDLRDDGKTIQDLARMNQRPVSRAEGMAVAQKIGAQGYVECSAKTGEGVREVFQTATRHALQVGLLPLHRTPPLTVRRAKSPSLAEGRRVVWCFRAL

SEQ ID NO: 31105 - protein, 208 aa, Cryptococcus neoformans var. neoformans B-3501A
MSNQQVSTHTPRSADMQPEDELAPTRTEGYKLGHSKTVAELAALDQDDESLQRWKQSLGIAAGASAGGEKRVVLKSLFLSSPTLPSQITIDLTQSKDALAKLKKDPVTIKEGVEYSVGITFMIENEIVSGLKYLQVVKRSGITVDKTEAMLGSYGPQPEPFTKVFASEESPSGMLARSGTYVVRSRVIDDDNTIWLDFEWGFKLGKEW

SEQ ID NO: 31106 - protein, 255 aa, Arabidopsis thaliana
MRGTTDEEDGVMNFSDVLMMSDDVLSSGEVEEDSFGFRFTGNDAPQMLCFGGGNQNDTDLLFSQPSFSPASPLSSRNNACVVNDQSFRSNKKTGSADGHDRVCDPKPGKRCKRDQKKSSLGNAKVKKEKVGEKITTLQHLVSPYGKTDAASVLHETMGYIKFLQDQVQVLSTPYFKHNPLLMCRQDDEDTGEVNPTMKVKELRSNGLCLVPLAWTVHVANTNGADLWSSAILSPLTSHTNSEPVEIVEVKSHKDK

SEQ ID NO: 31107 - protein, 327 aa, Staphylococcus epidermidis RP62A
MTKLSYLEAIQNAQDLALNHFSNAFILGEDVGKKGGVFGTTKGLQSKYGDERVIDTPLAESNIIGTAIGAAMLGKRPIAEIQFADFILPATNQIISEAAKMRYRSNNDWNCPLTIRAPFGGGVHGGLYHSQSVESIFASTPGLTIVIPSSPYDAKGLLLSSIESNDPVLYFEHKKAYRFLKEEVPETYYTVPLGKADVKRPGEDITVFCYGLMVNYCLQAADILANDGIDVEVVDLRTVYPLDKATIIERSQRTGKVLLVTEDNLEGSIMSEVSAIIAENCLFDLDAPIMRLAAPDVPSMPFSPTLENEIMMNPEKIQDKMRELAQF

SEQ ID NO: 31108 - protein, 444 aa, Methylobacillus flagellatus KT
MQLEKQTNSDLHRVVIVGGGAGGLELATRLGRTLGRKKKAHITLIDCTRTHVWKPLLHEIAAGSMNPDKHELDYIAQAHWHHFHFRLGRMDGLDRTKKEVTVAPYYDDGVEVIPRRTFKYDTLIIAVGSTTNDFGISGAREHSIALDTQNQAERFHRQLTNALMRAQTQAEPIQAGQLEVVIVGAGATGVELAAELHNTTRELAAYGLDKIDPDRDIKISIIEASDRVLPALPPKLSKAVDTELRKLGVHVYVGERVTEVTDKGVYTHSGRFIPSSLVVWAAGIKAPDFLRELDGLEVNRINQLVVKRTLQTTLDENIFAFGDCAACPWPGHDENVPPRAQAAHQQASMLVKTVKARVAGKSNLPEFTYRDYGSLVNLGRYSTVGSLMGAIAGGSMYIEGLFARLMYQSLYQMHLMALHGFFAVVLQILARLITRRTEARVKLH

SEQ ID NO: 31109 - protein, 203 aa, Glycine max
MSNTSNNVAGVDNTFRRKFDREEYLERARERERQEEEGRAKPKAKGPPVQRKPLKHRDYEVDLESRLGKTQVVTPVAPLSQQAGYYCSVCECVVKDSANYLDHINGKKHQRALGMSMRVERASLQQVQERFEVLKKRKDVGSFTEQDLDERILKQQQEEEERKRLRREKKKEKVKEKAVEEPEIDPDVAAMMGFGGFRSSNKK

SEQ ID NO: 31110 - protein, 473 aa, Staphylococcus epidermidis RP62A
MSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNGYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEISLLQFMNGSSLELGLTTHAHPSLSEVVMELGLKANGQAIHV

SEQ ID NO: 31111 - protein, 1451 aa, Coprinopsis cinerea okayama7#130
MAEHIPLANISEEASLSRATSFKWSKKADHHDADFDDDAPPTSPKIQAKRRNSRRMSTASRVSIDFFDPQGVEGLRRSMTREKQTQPSTVPFPAPASSDASSDDSFDMDSKDFDLEKWIRQMIQRRSNSEAKPRQLGVVFRDLQVLGIGASASYQPTLGSVLNPLDAIRSFQTARHPPIKEILTGFEGVVRPGEMLLVLGSPGAGCSTFLKTLANHRAEYHAVNGEVHYDSISPEELHKYFRGDVQYCPEDDIHFPTLTVDQTIKFAARTRTPRHREEFTRAQFTEMLSTVLTTVFGLRHVRNTMVGDAAIRGVSGGQKKRVSIAESLATRACMACWDNSTRGLDASTALEFVRALRIATDAMQLSTVVSIYQAGESLYKHFDKVCVIYEGRMAYFGPAHKARDYFIEMGYQPANRQTTPDFLVSVTDPGGRLPVSGVANQPRTADEFAAYFKASQLGRENQRDIEDYIAEHVGKPDRALGYMQSARAEFAKRSGKKNPYMLTIPQQVAAVMRRKVQILRGDMLATFFNTFSFVFQAIIMGSLFLRMPERTSAFFSRGGVLFFSLLFSALATMAEIPSLYSQRRIVLRHKKAALYHPFVEALAHTLVDIPIAFCIISIFSVILYFMTGLQRSASWFRALAAAFKSEATAQSVAGIAVLALCIYTGYTIPKPSMIGALRWITYINPLRYGFESILVNEFRTLVAECDALIPQGPGYENITLENQVCAVVGAQPGESVVNGARFAELSYGFKWSNVWMNLGIIIAFLVGFMALLLLFSEYNTSTTFDSSVTLFKRGTKRVVRSKSDEEEKRSFDASSTSAMLSRKKGDAPLKMNDTFTWKNLNYTVPIPGEDDRQLLSNVSGYVAPGKLTALMGESGAGKTTLLNVLARRVDTGVVTGEMFVNGQALPRDFQSQTGYCQQMDTHVGTATVREALLFSAKLRQPASVPLKEKEAYVEQCIKMCGLDEYADAIVGSLNVEYRKRTTIAVELAAKPKLLLFLDEPTSGLDSQSAWAIVSFLRSLADQGQAILCTIHQPSAELFQVFDRMLLLKKGGQTVYFGDLGPNSSTLIQYFERNGARKCDPSENPAEYMLDVIGAGATATTSFDWYSIWKISPEAACVQQEIEGIYAEGRGRPAVEATLQSEFATSWGYQVKELFYRNVQSYWRDPTYLMAKLVLNAFGGLFVGFTFFNAPNTQQGTQNKLFAIFMITILSVPLASQLQVPFINLRSVYEIRERPSRMYSWTALITSQILIEVPWNILGSIILFVTWYWTVGFDSSRAGYSFLLLGIIYPIYYTTIGQAVAAMSPNAEIAAMLFSLLFSFVLSFNGVMQPYRALGWWKWMYRLSPFTYLIEGLLGQAIGRQAIRCSPVEFVQVKPPSGMTCGSYLDPFISMAGGYLTNPDATSDCNYCSMSTTDHFLMSSFNISYDNRWRNVGLMVVFTVFNFAFKRSKKKN

SEQ ID NO: 31112 - protein, 412 aa, Rickettsia conorii str. Malish 7
MPIKILMPALSPTMTEGNLARWLKKEGDKVNPGEVIAEIETDKATMEVEAVDEGILAKIVIPQNSQNVPVNSLIAVLSEEGEEKTDIDAFIAKNNSVSPSPKTDANLPKPHENIANVEEQVTVIKHDVSRIFASPLAKRLAKMRNIRFESVKGSGPHGRIVKQDILSYTPSTAHNKIVSRNPEEYRLVPNNNIRKIIAKRLLESKQTVPHFYLSIECNVDKLLDIREDINKFFSEDKSTRISVNDFIILAVAKALQEVPNANASWGEDAIRYYNNVDISVAVAIENGLVTPIVKNANQKNILELSREMKALIKKAKDNKLTPEEFQGGGFTISNLGMYGIKNFNAIINPPQSCIMGVGASAKRAIVKNDQITIATIMDVTLSADHRVVDGAVGAEFLVAFKKFIESPVLMLI

SEQ ID NO: 31113 - protein, 574 aa, Oryza sativa (japonica cultivar-group)
MAEVTVVRAEPQEGSTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 31114 - protein, 547 aa, Nostoc punctiforme PCC 73102
MKPYLPQNDPDPTKRQILLERNQGEYEFDYDFLVPMAMLKNVPSIENFSTKYIAERTLETAELPINMLAVKTRSLWDPLDELQDYEDYFPVLPKPNIIKTYQSDDSFCEQRLCGANPFVLRRIEQMPDGFAFTILELQEKFGDSINLVEKLANGNLYVADYRALAFVKGGSYERGKKFLPTPIAFFCWRSSGFSDRGQLVPIVIQINPADGKQSQLITPFDDPLTWFHAKLCVQIADANHHEMSSHLCRTHFVMEPFAIVTARQLAENHPLSLLLKPHFRFMLANNDLARKRLISRGGPVDELLAGTLQESLQIVVNAYTEWSLDQFSLPTELKNRGMDDPDNLPHYPYRDDGLLLWNAIKKFVSEYLQIYYKTPQDLAEDLELQSWVQELVSQSGGRVKGISDRINTLDQLVDIATAVIFTCGPQHAAVNYSQYEYMTFMPNMPLAAYKQMTSEGTIPDRKSLLSFLPPSKQTADQLSILFILSAYRYDRLGYYDDKFLDPEAQDVLAKFQQELNEAEREIELNNKSRLINYNYLKPRLVTNSISV

SEQ ID NO: 31115 - protein, 167 aa, Glycine max
MASTFEGGSDSEKENTVESEEEECPVKQVELTVPKTDDPTMQLLTFRMWVLGVLSCVLLSFVNQFFWYRTQPLIVTSISAQIAVVPIGHFMARTLPTRVFFKDSRFEFSLNRGPFNIKEHVLITIFANSGAGTVYATHIVSAVKLMCKRRLNFLAALVVMLTTQILG

SEQ ID NO: 31116 - protein, 383 aa, Saccharum arundinaceum
MCGGAILSGFIPPSGVAAAAAAKKKQQQQRRVTADLLWPGPGKKGAPQEEDFEADFREFERGLSEGGDDEVQELPAPQPARFAFAAAPKAPRPEVDGVMTPKDAYGDRPTANSIKRNRKNQYRGIRQRPWGKWAAEIRDPSKGVRVWLGTYNTAEEAARAYDAEARKIRGKKAKVNFPDEVSGAQKSTAKPTAANATKLAQPPKACADEVFNNLNNDNNDLFAMFAFNDNKVPVKPAEGARFLPAVKPLVPSKRSATYMLSDQSSNSYGSSDFGWDDDTMTSDYTSVFAPNNVIPAPYMQGGVSKRMRNNYGVAMLQGNGVPSLTQVMPCFDPEMNYQPLPYVESSSSDASMDSLLQTDIPQDVASNGDIWSLDELLMAAGAY

SEQ ID NO: 31117 - protein, 163 aa, Ginkgo biloba
MAQQKPSEGCAQDAPEHQNRGLFGTFGKKKEDEQAGHPQGTAQETPVSAEQKQQHGLLGKLHQGDKTSQGDKTSSGSSSEEDEGGEKKEGGGRRKKKGMKEKIMERVGGGKEEGKSEGMQDQQQQHDKPTKDEEQKGFMEKIKGKLPGQQHTKEGEPGNAPCT

SEQ ID NO: 31118 - protein, 204 aa, Glomus intraradices
GQQEVFHGHGHDHGVGEHGHTHEQLDNPGKYTEREPPKYEKRNWKERAFTVGIGGPVGSGKTALMLALCKALRDQYSIAAVTNDIFTKEDTEFLVRNNALPAERIRAIETGGCPHAAIRGDISANLGALEELHAKFNSQILLVESGGDNLAANYSRELADYIIYVIDVAGGDKIPRKGGPGITQSDLLIINKTDLAEIVGADLG

SEQ ID NO: 31119 - protein, 333 aa, Xanthomonas axonopodis pv. citri str. 306
MAVSHLPSATVSDATLVASGQRVLEIEREALASVGARIGREFAAACRLVLTSRGRVVATGMGKSGHVARKIAATLASTGTPAFFVHPGEAGHGDLGMITEADIVLALSYSGESDEVRMLLPVLKRQGNPIIAMTGRTSSTLAQAADVHLDVSVSAEACPLHLAPTSSTTASLAMGDALAVALLDARGFTADDFARSHPAGSLGRRLLLHITDVMHAGEDLPRVREDASLSEALMEMSRKRLGMTAVVDADGHLIGLFTDGDLRRALDSDIDVRSAGIAQVMTRNPRTIGADQLAAEAARLMEDYKINGLIVVDAQHRAVGALNIHDLLRAKVV

SEQ ID NO: 31120 - protein, 327 aa, Chlamydia trachomatis D/UW-3/CX
MSSQFDQLKLWSVLVGDTGDPALIKTLGVQDATTNPSLILKVAQEPKYQSMLTEAISWGIRQNGDDVQTLTFVLDKIQVNLGLEILKHVPGRVSLEIDARLSFNTEAMVQRAIFLSQLFEKMGGDKKRLLVKIPGTWEGICAAEVLESQGIACNVTLIFNLVQAIAAAKAKVTLVSPFVGRIYDWWIAAYGAEGYSIEADPGVASVANIYSYYKKFDIPTQIMAASFRTKEQVLALAGCDFLTISPKLLEELKKDQQPVERKLSVEEAKKLDIQPVELSESVFRFLMNEDAMATEKLAEGIRIFSGDTQILESAVTEFIRQIAAQEA

SEQ ID NO: 31121 - protein, 426 aa, Cryptococcus neoformans var. neoformans B-3501A
MSSCLPVTLTRTRTRTLTLTLHPAMPSTKGVILVGGPSKGTRMRPLTLDCPKPLLPVAGKPMIWHPLQALSKVPDLTEVIIIGFYDDSQMAAFVKEAKREFPNIAISYLREYKALGTAGGLYHFRDSILRPPVPQHIFICNIDICCSFPFAEMLELHTSHGGTGTIMGVNVKKETATQYGCIVTDPETNQMVHYVEKPEGWISNIVNGGVYLFDKSLFDVIKVAMDEKTARAAEDPLVKPDEILRLEQDVIVPLAAARKMYVYQTHDFWRQIKTAASAVTATALYLSNYKLTNPSLLAPAAPNIIAPTFIDPSATIDPSAKIGPNVAIGPNVTVGPGVRIKDAIVLEGSTLEKHSCALNSIVGTNSHIGAWSRVDGEQEFEREVKGKISVTILASEVSLAPETMVRSCIVLPNKTLTKNATNQVLL

SEQ ID NO: 31122 - protein, 464 aa, Glycine max
  misc_feature (251)..(251): Xaa can be any naturally occurring amino acid
NLGATEEQLDFPVLYASAKEGWASTTFTKDPPADARNMSQLLDAVVRHVPPPNANIDAPFQMLVSMMEKDFYLGRILTGRIFSGVVRVGDKVHGLRNKDSGAEKIEDGKVVKLMKKKGTNMVLTDCAGAGDIISIAGLSSPAIGHTVATVEIMSALPTVELDPPTISMTFGVNDSPLAGRDGTHLTGGRIGDRLMAEAETNLAINVLPGLSESFEVQGRGELQLGILIENMRREGFELSVSPPKVMLKLKXQKLEPVEEVTIEVNDEHVGLIMEALSHRRAEVTDMGPVSGTVGRTRLCLTCPSRGLVGYRSVFSSDTRGTGFMHRAFHAYEKFRGPLGNVRKGVLVSMGFGTITAHALMSLEARGTLFVTPGMEAYDGMIVGEHSRDTDLDVNPVRAKELTNIRAATKDDNVKLTPPRLMTLEEAIGYVASDELIEVTPKSIRLRKKYLDVNKRKAMSKKPKE

SEQ ID NO: 31123 - protein, 342 aa, Brassica napus
METASRVEAVTKGGLPVVPSQYIQPPEARPNLLHAGDAAPIPTIDLSNSDSVTESIGEACRNWGAFHVVNHGVPIHLLDRMKALGLSFFQDCPLEEKLQYACDSTSAASEGYGSRMLLGAEGDVVLDWRDYFDHHTFPLSRRDPSHWPLRPPHYRQVVEEYGNEMKKLAQKLLGIISESLSLPCSSIEEAVGEIYQNITMSYYPPCPQPELTLGLQSHSDMGAITLLIQDDVGGLQLYKDDQWLTVPPISHAILVLIADQTEIITNGVYKSAQHRAVTNANRARLSVATFHDPSKTARIAPASHLIGQHTKPAYKEVVYGQYVSSWYSKGPVGKRNLDALLC

SEQ ID NO: 31124 - protein, 87 aa, Arabidopsis thaliana
  misc_feature (21)..(21): Xaa can be any naturally occurring amino acid
AVVTSPDQATRGAPFSGLKSXSAAFPVTRKASKDITSITSNRGRVSCMNVWAPIGKKKFETRSKLPDLTDVELAKGVDYLLRNMWIP

SEQ ID NO: 31125 - protein, 329 aa, Desulfovibrio desulfuricans G20
MERILAVDIGGTNSRFAAFVLQADGTLKFEDSLWLSTQGAQSFPALLAELENRGFSLLPRDADVMVLAVAGAVEKKGRYCKISNASWAVDLDEVAQTFGIARGRLINDFEAQAYACLSEAVHDAVTVQHGVAEDGAPIAVVGGGTGLGKCLLVCDGVGRYITVPSEGGHSVFPFVGREELEFAEFILRETGRPQVIGDLVVTGTGLRLLHQFHTGERLSSREVSRKLEGDSVVLEWFARFYGRACHDYVLETMALGGLYIAGGLASGNPGLVTHHAFVQEFVQSDVHGHLLRKVPVRLNRNEESGLWGAAVCGVQMLRTGRLVRSAGGA

SEQ ID NO: 31126 - protein, 580 aa, Arabidopsis thaliana
MGCVLCKESTGDKRKHNNPDEPPPADLRNTEDLPSSSSTTTAAISVEIGEKKKKDLDSIQIQPERRTWHTGDFSAGSSRRPGMSLRTPEGWPPWLIAACGDSIKDLTPRRATTYEKLEKIGQGTYSNVYKAKDLLSGKIVALKKVRFDNLEAESVKFMAREILVLRRLNHPNVIKLQGLVTSRVSCSLYLVFEYMEHDLSGLAATQGLKFDLPQVKCFMKQLLSGLEHCHSRGVLHRDIKGSNLLIDNDGILKIADFGLATFYDPKQKQTMTSRVVTLWYRPPELLLGATSYGTGVDLWSAGCIMAELLAGKPVMPGRTEVEQLHKIFKLCGSPSDSYWKKYRLPNATLFKPQHPYKRCVAEAFNGFTPSSVHLVETLLTIDPADRGTSTSALNSEFFTTEPLPCDPSSLPKYPPSKELNVKLRDEELRRQKGLAGKGSGIDGARRIRYRGDRTGRAIPAPEANAESQANLDRWRSISQTNGKSKSEKFPPPHQDGAVGYPLEDLSKKTSVFGAKTETSFGLSRSLKSGEGASMRKISNKDGARGASSRKYIWGLKPPPALGLSMDLLFRSRSEVFGIRR

SEQ ID NO: 31127 - protein, 513 aa, Glycine max
MATLSSYDHFIFTALAFFISGLIFFLKQKSKSKKFNLPPGPPGWPIVGNLFQVARSGKPFFEYVNDVRLKYGSIFTLKMGTRTMIILTDAKLVHEAMIQKGATYATRPPENPTRTIFSENKFTVNAATYGPVWKSLRRNMVQNMLSSTRLKEFRSVRDNAMDKLINRLKDEAEKNNGVVWVLKDARFAVFCILVAMCFGLEMDEETVERIDQVMKSVLITLDPRIDDYLPILSPFFSKQRKKALEVRREQVEFLVPIIEQRRRAIQNPGSDHTATTFSYLDTLFDLKVEGKKSAPSDAELVSLCSEFLNGGTDTTATAVEWGIAQLIANPNVQTKLYEEIKRTVGEKKVDEKDVEKMPYLHAVVKELLRKHPPTHFVLTHAVTEPTTLGGYDIPIDANVEVYTPAIAEDPKNWLNPEKFDPERFISGGEEADITGVTGVKMMPFGVGRRICPGLAMATVHIHLMMARMVQEFEWGAYPPEKKMDFTGKWEFTVVMKESLRATIKPRGGEKVKL

SEQ ID NO: 31128 - protein, 779 aa, Oryza sativa (indica cultivar-group)
MAAPPLPLVLAAAAIASLVILVLVVFACRRWRRAVVAAGAAAAAAGGGGCRRRISGPQPASLFLRIFAVCSSFLSDMAYRSLFPRLVAEESVEMGGDLNEDLNKPLLEILDDHSSQSNTFPGNVVGESSKVQTSRSDTSPRSHGISDSGRTYPADSCTPQGSNLDVEVIAGPSHGISCSRQSTSPTIPITLGRVPPSDLVLKDSEVSGKHARINWNAKTLKWEIVDMGSLNGTFVNSRAVHHPNVGSRHWGEPAELADGDIITLGTSSKLSVQISLQNQRVPAGIGMASDPMVGRRSGKKLAMEDISFCQCPLQGVEQFGLFGIFDGHGGDGAARAVSKIFPENVATLLSHHETKEKVLSYSDASDVLRYAFTMTEAAIDHEYERMQIEETFRDLKSPAYGLGLRHSRTSSSERFDIMLLIALMLQLTCWLAGVHAQKQGWDKHFQANTVRNRNVLSTVRLGMEVLRHSGYTNNKGRLTRGCNPTSSKFIHTWLRFGEIMRGSLSVTRDTATFNLPFISLGQVGEGKLMVIGNPHYNSILRCPNGYSWNGGVNKDGQCTLNSDPDDMKNFMENTLKWEIVDMGSLNGTFVNSRAVHHPNVGSRHWGEPAELADGDIITLGTSSKLSVQISLQNQRVPAGIGMASDPMVGRRSGKKLAMEDISFCQCPLQGVEQFGLFGIFDGHGGDGAARAVSKIFPENVATLLSHHETKEKVLSYSDASDVLRYAFTMTEAAIDHEYEVRLQKPPVVSLTEMEYCGICQGLESSGVTLKFSVLIQQDA

SEQ ID NO: 31129 - protein, 395 aa, Triticum aestivum
AVVCTIHQPSIDIFEAFDELFLMKRGGEEIYAGPLGHHSADLINYYEGIHGVSKIKDGYNPATWMLEVTTIGQEQMLAIDFSDIYKKSELYQRNKALIKELSQPAPGSTDLYFPTQYSQSSSTQCIACLWKQNLSYWRNPPYNAVRFLFTTVIALLFGTIFWDLGGKMSQSQDLFNAMGSMYAAVLFIGIMNCTSVQPVVAVERTVFYRERAAGMYSAFPYAFGQVVIELPYTLAQATVYGVIVYSMIGFEWTAPKFFWYLFFMYFTLLYFTFYGMMAVGLTPNYHIASIVSSAFYAIWNLFSGFIIPRPKVPIWWRWYCWVCPVAWTLYGLVVSQFGDVTTPMEDGTPVKDFIEGYFDFKHSWLGYVATVVVAFAVLFAFLFGFAIMKLNFQKR

SEQ ID NO: 31130 - protein, 129 aa, Methylobacillus flagellatus KT
MADIIKQLEQEEIARLGKTIPSFAPGDTVVVGVNVVEGTRKRVQAYEGVVIAIRNRGLNSSFIVRKISSGEGVERTFQTYSPLIASIEVKRRGDVRRSKLYYLRERSGKSARIKEKLQLRAPKETSSAE

SEQ ID NO: 31131 - protein, 519 aa, Oryza sativa (indica cultivar-group)
MLGEAASPWSLAGAGAAVALLWLCAWTLQWAWWTPRRLERALRAQGLRGTRYRLFIGDVAENGRLNREAASRPLPLGSHDVVPRVMPFFCNVLKEHGKLSFVWTGPKPFVIIRDPDLAREILSNKSGNFAKQTTAGIAKFVVGGVVTYEGEKWAKHRRILNPAFHQEKIKRMLPVFLACCTKMITRWVNSMSSEGISELDVWDEFQNLTGDVISRTAFGSSYQEGWRIFQLQEEQAKRVLKAFQRIFIPGYWYLPIENNRRIREIDQEIRTILRGIIVKRDKAVRNGEGSNDDLLGLLVESNMRQSNEKEDVGMSIEDMIEECKLFYAAGSETTSMLLTWTLILLSMHPEWQEQAREEVMHHFGRTTPDHDGLSRLKIVTMILHEVLRLYPPVVFLQRTTHKEIELGGIKYPEGVNFTLPVLSIHHDPSIWGQDAIKFNPERFANGISKATKFQTAFFSFAWGPRICLGQSFAILEAKMALATILQSFSFELSPSYTHAPHTVLTLQPQYGSPIKLKKL

SEQ ID NO: 31132 - protein, 58 aa, Zea mays
  misc_feature (12)..(12): Xaa can be any naturally occurring amino acid
  misc_feature (41)..(41): Xaa can be any naturally occurring amino acid
  misc_feature (48)..(48): Xaa can be any naturally occurring amino acid
MAEPTPSQSPAXTPPPPPTQQTPAAGGLEDMLACVAALDAXLLPCLPXRDLQAVYRSL

SEQ ID NO: 31133 - protein, 196 aa, Desulfovibrio desulfuricans G20
MTRRAATVTRTTTETAISLSLTVDGKGEVSVTTGHGFTDHMLTLLGFWAGFDLTLTCNGDTHVDAHHTVEDAGLCLGQAFAQALGDRKGIARVGNARVPMDEALTEVDLDISGRPYLVYRGDELLPPVIAGDEADLWREFFKSFANGARINLHISLLYGKNGHHLLESAFKGLGLALRRAAACEREALLSTKGSLD

SEQ ID NO: 31134 - protein, 383 aa, Cenarchaeum symbiosum
MGDLYQRFPVTVAKGEGARVWDEDGKEYIDCMGGYGVALAGHRNPRVVQAIKAQLDRIITVHGSLYNKTRAEFLDRLTGAAPPGLTRVHLNNSGAESVEAAIKFAKRHTGKSGMVAMRGSYHGKTAGALSVTFNPKYKKGFGPMLEGASFSPFGDIDALRDSTGDDTALVIMEPIQGESGIRVAPPGFLQDARRLCDERGIVLIFDEIQCGLGRTGKMWAAEHWETIPDIMCLAKGIAGGIPMGATLTKPEIMASIKKGDHSSTFGGSPLACAAGSAVLQSLSEDGLVSNAETVGSRLHRGLQELQEKHRVISEVRGMGLMAGVELRCGVKDVILEGIKRGVLLLYSGSNILRLLPPLTISEDDIERVLETIDAVLNSVGRDK

SEQ ID NO: 31135 - protein, 516 aa, Desulfovibrio desulfuricans G20
MEKQNKVIIVDYGSQVTQLIARRIREAGVYSEIHPCIVTAAEVAAMSPSAVVLSGGPASVLGEDSPALDKGLLELGVPVLGICYGMQLLAHNLGGELSCSETREYGPADLKFCAGSPLWDGLKTDESSRVWMSHGDRVKKVPAGFTVTGSTETLEVAAMADDQRRIYAVQFHPEVHHSEDGVRMLHNFLFKIAGIKADWSMSSFCERVIKEVSEQVGPDDQVVCALSGGIDSTVVAVLLHKAIGHRLHCIFVDNGVLRLNEVDEVSGYLREHFDLNLTVVDARERFMKQFAGVEDPEKKRKIIGYTFIDVFDEESQKIPNVKYLAQGTLYPDVIESISHKGPSAVIKSHHNVGGLPETMKLKLIEPLRELFKDEVRKLAVELGLPDFIVWRHPFPGPGLAIRVIGEVTEERLDILRKADKIVQNELTASGWYRKVWQGFAVLLPLKTVGVMGDDRTYEHVIALRVVDSVDAMTADWVRLPSEVLERISSRIINEVKGVNRVVYDISSKPPSTIEWE

SEQ ID NO: 31136 - protein, 726 aa, Arabidopsis thaliana
MQISLQIHLSSFTFLLLIFLLPVLSESQVASSESQTLLEIQKQLQYPQVLQSWTDTTNFCHIRPSPSLRIICLHGHVTELTVTGNRTSKLSGSFHKLFTLLTQLSSLKTLSLTSLGISGSLSPKIITKLSPSLESLNLSSNFISGKIPEEIVSLKNLKSLVLRDNMFWGFVSDDLRGLSNLQELDLGGNKLGPEVPSLPSKLTTVSLKNNSFRSKIPEQIKKLNNLQSLDLSSNEFTGSIPEFLFSIPSLQILSLDQNLLSGSLPNSSCTSSKIITLDVSHNLLTGKLPSCYSSKSFSNQTVLFSFNCLSLIGTPNAKYQRPLSFCQNQASKAIAVEPIPKAKDKDSARIKLGLVILIIIGVIILAAILVLLVLIALKRRRSRSEDDPFEVNNTKTINRIFLSVGRVPQTMRSAVIGLPPYRVFSLEELEEATNDFDAASLFCEQLYRGCLREGIPVTVRVIKLKQKSLPQSLAQQMEVLSKLRHMHLVSVLGHSIASNQDHNQHAGHTIFIVQEYISSGSLRDFLTNCRKKEVLKWPQRMAIAIGVARGIQFLHMGVAPGIFGNNLKIENIMLDETLTVKISGYTIPLPSKVGEERPQAKKPRSNEDREKEDVYQFGVILLQIITGKVVAAGSSEMGSLKLQLENGLRDEPSVLSSLADPSVKGSYAYESLRTTVEFAINCLCEDQSKRPSIEDVVWNLQYTIQVQQGWRPSSGNHESSMKAIYE

SEQ ID NO: 31137 - protein, 164 aa, Triticum aestivum
  misc_feature (150)..(150): Xaa can be any naturally occurring amino acid
  misc_feature (162)..(162): Xaa can be any naturally occurring amino acid
SEQNGEPEIDVGSRKRKSLGELEEPSTTPLHLAKWELQKKNFFMQAPAKLTACDYHRDLDMVVVGFSNGVFGLYQMPDFVCHCQLSISREKITTAIFNSLGNWLVFGCAKLGQLLVWEWRSETYILKQQGHYFDVNCIAYSPDSQLIATXGADDNKVKVWTXAT

SEQ ID NO: 31138 - protein, 412 aa, Magnetospirillum magnetotacticum MS-1
MDAPSGIGVDDGTVPGPVLRADRTVTFGAAKPGLLLPPATHLAGHGAVVDIGLRLGAPVPDAPVPDAPGLGAPGPGVAGPDAPAPDRGKTTPVVRRLEPADVAALWSVPGATDHKYTRGVVGVVAGTPTFPGAAVLVTTAAVRTGPGMVRYGGPDDATRAVLAARPEVVHAAGRVQSWVLGPGVPAVPGPGDDPVDDGGQHERVRTALAAATATAATATAATATDATTTDATTTTTGATTTGATPERVPAVVDAGALSLLPERCPPSVVLTPHAGELARLLRARGDDVARTDVEAEPLRWARRAHEATGATVLLKGSATVVVGPEGAWSQADAPAWLATAGAGDVLAGILGTLLAAHAERVVREPGLAARLAAAAAVVHGLAAERANPGGPVAALDVADAVPGVVAELLAAR

SEQ ID NO: 31139 - protein, 274 aa, Chlamydia trachomatis D/UW-3/CX
MFTDKETHRKPFPTWAHLLHSEPSKQFVFGNWKMNKTLTEAQTFLKSFISSDILSNPQIITGIIPPFTLLSACQQAVSDSPIFLGAQTTHEADSGAFTGEISAPMLKDIGVDFVLIGHSERRHIFHEQNPVLAEKAAAAIHSGMIPVLCIGETLEEQESGATQDILLNQLTTGLSKLPEQASFILAYEPVWAIGTGKVAHPDLVQETHAFCRKTIASLFSKDIAERTPILYGGSVKADNARSLSLCPDVNGLLVGGASLSSENFLSIIQQIDIP

SEQ ID NO: 31140 - protein, 379 aa, Oryza sativa (indica cultivar-group)
MTSSPSWFSGIARASSAMPPGGVASAAAPLSDGAGGRGGGGGGGGGGGGVVAAVVAAGPGAGAGVGAGGKRRQVQGALFKYGPKSAQVAFKTGDFNHQVIFIGGLTDGFLATDYNSLYVESNKHEKNLKNDELEKDRKNNTISSLLGAFVTCTRGREMVTGTAVTFFIIHWDALELDQLISYLINKENSDGVILLGHSTGCQDIVHYMRTNFACSKAVSGVILQAPVSDREYRATLPETAEMIDLAAKMLSEGRGMDLMPREANPDAPITAYRYHSLCAYMGDDDMFSSDLSEDQLRQRLGHMSTTQCQVIFSMGDEYVPEYVDKEALVDRLCRALGNAEKVEIEWGNHALSNRVQEAVRAIVDFVKREGPKGWDDPWS

SEQ ID NO: 31141 - protein, 174 aa, Cicer arietinum
NISGGHLNPAVTFGLAIGGNITIITGLFYWIAQLLGSIVASLLLNYVTSKSVPTHGVAAGLSPIAGLVFEIIVTFGLVYTVYATAADPKKGSLGTIAPIAIGFIVGANILVAGPFSGGSMNPARSFGPAVVSGNFADNWIYWVGPLIGGGLAGLIYGDIFIGSYAPAPASETYP

SEQ ID NO: 31142 - protein, 354 aa, Bacillus anthracis str. Ames
MEKRIVCLAGDGVGPEVMESAKEVLHMVERLYGHHFHLQDEHFGGVAIDLTGQPLPQRTLAACLASDAVLLGAVGGPRWDGAKERPEKGLLALRKGLGVFANVRPVTVESATAHLSPLKKADEIDFVVVRELTGGIYFSYPKERTDEVATDTLTYHRHEIERIVSCAFQLASKRKKKVTSIDKANVLESSKLWRIVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGTETTTSFTKAVMQEMEEQALVGRGR

SEQ ID NO: 31143 - protein, 308 aa, Prunus spinosa
CTCNLWMDLIGSSSFVSTHLHRNVTEHAHVSLLCLHHQSFECQVDPDDPYVGQELQWSLFCNETFELCSKLSHPLGSTEYYGIYGSSNGLVCISDDILNFDSPIYIWNPSVRKFRTPPISSNINIKFSHVALQFGFHPGVNDYKVVRMMRTNKNALAVEVYSLRTNSWKMIEAIPPWLKCTWQHHTGIFLNGVAYHLIEKGRIFSIMSFDTGSEEFGEFITPDAISNPSDLCIGVYKEQICLLLDFYPCEVEGMDKLDLWILQEKRWKQSCPFFIPLGYYCTIGISIDNKLLMLRIDDIGGVADLHLC

SEQ ID NO: 31144 - protein, 250 aa, Zea mays
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASGIIGVDLNASRFEEARKFGCTEFVNPKDPP

SEQ ID NO: 31145 - protein, 308 aa, Prunus spinosa
CTCKSWSDLISSPSFVSTHLYRNVTKHAHVYLLCLHHPNFECVVDPDDPYLEEEIQWSLFSNETFKLCSKLSHPLGSTNRYGIYGSSNGLVCISDEILNFDSPIHIWNPSVKKFTTPPMSTNINVKFTYVALQFGFHPRLNDYKIVRMMRTNKGALAVEVYTLRTDSWKMIEAIPPWLKCTWQHHKGMFFKGVAYNIIVKGPIFSIMSFDSGSEEFEEFIAPDSICSPSELCIDVYKEQICLLFSFYSCEEEGMVPNDLWVLQEKQWKQLRPFIYPAGSYGTIGISIDNELLKVRRDFLRGVGNLCLC

SEQ ID NO: 31146 - protein, 791 aa, Pseudomonas syringae pv. tomato str. DC3000
MVEYVVSLDKLGVHDVEHVGGKNSSLGEMISNLAGAGVSVPGGFATTAQAYRDFLELSGLNDQIHAALDTLDVDDVNALARTGAQIRQWIMEAEFPEKLNAEIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEASAGKSVKVIDVEPADRARFCLTDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATHTLQDGQGVTVSCAEGDTGYIFEGELGFDIKTNSVDAMPDLPFKIMMNVGNPDRAFDFAQLPNAGVGLARLEFIINRMIGVHPKALLNYSVLPPEIKDSVDKRIAGYHDPVGFYVEKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILADEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAQAPV

SEQ ID NO: 31147 - protein, 194 aa, Bacillus anthracis str. Ames
MRESSQIRETTETKIKLSLQLDEGKNVSVQTGVGFFDHMLTLFARHGRFGLQVEAEGDVFVDAHHTVEDVGIVLGNCLKEALQNKEGINRYGSAYVPMDESLGFVAIDISGRSYIVFQGELTNPKLGDFDTELTEEFFRAVAHAANITLHARILYGSNTHHKIEALFKAFGRALREAVERNAHITGVNSTKGML

SEQ ID NO: 31148 - protein, 308 aa, Prunus spinosa
CTCKSWSDLIGSSSFVSTHLHRNITKHAHVYLLCLHHPNFECVIDPDDPYLEEELQWSLFSNETFEQCSKLSHPLESTKHYAIYGSSNGLVCISDEILNFDSPIHIWNPSVRKLRTPPISTNINIKFSCVALQFGFHPGVNDYKAVRMMRTNKGALAVEVYSFRTDSWKMIEVIPPWLKCSWQHHKGTFFNGVAYHIIEKGPIFSVMSFDSASEEFQEFIAPDAICRRSALCIDVYKKHICLLCRFYSCEEEGVGKNDLWVLQEKRWKQLCPFRYPLGSYGTMGISIDNELLMERRDFLRGVGHLCLC

SEQ ID NO: 31149 - protein, 270 aa, Legionella pneumophila str. Paris
MDYYFTKGKPQLVNMKTPIYLVTQFQQLMDLMQNQYEVSCLELMQRSGKAACDFLVYRWPKVKKISIFCGRGDNGGQGYVLAQQAKKMGMIPTVWQVGHQMSMSKPPQMHKEVWYEMNSCHQQGIVLHTYSPDIDLGDPELIVDALFGVGLYGHVRPEIALLLQRLQQFTVPILAIEVPTGINASTGEIAGNALAATATITFLCMKLGLLINDGKIYSGEIAFDDLLAPEEIYQQVKGIEESSLLDSSTCFSKKIWYRNKTQKGWQLSIN

SEQ ID NO: 31150 - protein, 306 aa, Prunus spinosa
CTCKLWSDLIGSSSFVSTHLHRNVTKHAHVYLLCLHHPNFDWEEPDEPYAEELQWSAFSIERFEQCSKLTHPLWSTEHYGIYGSSNGLVCISDEILNFDSPIHIWNPSVRKFRTPLISTNYIKFSYVALQFGFHPKVNDYKAVRMMRTNKNAFAVEVYSLRTDSWKMIEAIPPWLKCTWQHHNGTFFNGVAYHIIEKGPIFSIMSFDLASEEFEEFLAPDAICSSWGLCINVYKEQICLLFRCYGCEEEGMDKVDFWVLHEKRWKQLCPFIFPLNYCHRPSGISIDNELLMERRDFIKGVADMYLC

SEQ ID NO: 31151 - protein, 500 aa, Oryza sativa (indica cultivar-group)
MCCVSPSPSASATSSRRGQIIAPDSPPSLRSYSDDSPPSTRAPAVHPEVEFEAKPAKRARVVPGGGGGGGGADAAAGDGRDRISDLPDAVLLSILSFLPFRDAGRTAVLSRRWRKLFDESLLDFNACQPFPPEEGRGCEWVIRSITDILAARPDVRIRSFRFVMYGQGFADHLADVDRWFRTLARRGVRQLDVDMLYTVPAPLLPGSILEFSSLEILRVFNCNFLDLSLPVLRLPVLRTLDLSNVSMSQGFLQAMMSNCPSLECTKLKNITGLDKICVRSRNLVRLFGDFSYLKELVVEDAPNLEELVGIGLPLAAAKVKIVFAPKLRVLGYLGKSVRPLVIHDTVFDGGIVQFRTLMSSVKTLAIQVPFSEKGHTIFVAQLLKFFPCLEALHIEPDSRSICRPVDVEEWDTITSVQCIEHSMNKLVFEDFGGEDCQWRFLTFLLGMARALKDIDFHCSESKDWASLKLCETQSSSIVQSSTKNKWRCSFVDCGLIRSVV

SEQ ID NO: 31152 - protein, 960 aa, Oryza sativa (japonica cultivar-group)
MEGSPSKSRGVTGPAHTDDGDWFSDVPDDIILNIMSFLTTRQAVQTCVLSRRWRNLWRSVPCINSDIDEFTRDSDSEGYYDEKTELAFIMFMERVMELRDPAALISTFQFRCKFELDEGFDDISDPEDINAWISHAVQKQARVLDIVVLCDKLYLDHSEFASRYLTRIEFTSVVLMEGFFKQLEMGCPAWESLFLDECAVNDVEISSQTLKVLTIKNTLFSSDKTTISTPSVTYLKLWRPVDSCVFNDMPLLVTSLLVLYHVQDSGDFFQNLRSLSAAKSLEFNYIGKELTMENNLQLYPKFNNLVRLTLGQWCLDANFYGLMVFLQTSPKLEKLTLKIEKEKTQRIIGKIEDRSFTCEHLTRVEIVCSEDDPLVKDVVTFFVNSGLTSAQVVGVVRARVAKAGGAWWGHTHLLEDDAAVVRAGDDGVFVRGSVHEGVTAVAPVVGGRRRGTGGGRGGGGGKGRGRSHRKRICLITFCSLSDLPRNHRKKGFLFGLLFTSGDQRLSFSRAARLQQQQEEEERCGGGSSHALHLFDETPARAVSSFYARDLFDETPLRACSAAMEGSPSKRRGVTAPAHTDDGDWFSDVPDDVILNIMSFLTTRQAVQTCVLSRRWLNLWRSVPCINADVGEFQRSDTEWEEYDQERESAFKMFMDRVLELRNPAAPIRTFRFRCCRLDGFEGTSDEADMNRWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEGDPLVKDVVNFFVNSGLTSAQVQIIRWC

SEQ ID NO: 31153 - protein, 390 aa, Methanosarcina mazei Go1
MRKEPYDFPLDDYISREEFNKIKKFSRDKETPFLIVDLQKIERSYDELVEHMPFAKIHYAVKANPLDKVVLALKRKGSNFDVATIYELDQLIRLGVEPERISYGNTIKKEKDIAYAYDNGVRLFVTDSESDLKKLARRAPGSRVFFRILTESDGADWPLSRKFGSHPDLIYKLILKAEKLGLEPYGLSFHVGSQQRDIGQWDNAIAKCKYLFEAVAEKGIHLKMINLGGGFPAKYQSQAHDLETYAHEIRRFLHEDFGEELPEILIEPGRSLVADAGIIVSEVIMIAKKARFNQYKWVYLDIGKFGGLIETLDECIKYPIFCDKKGCAEEVILAGPTCDSMDILYEHHKYSFPHTMRDGNRVYIFTTGAYTQSYSSICFNGFPPLKAYVI

SEQ ID NO: 31154 - protein, 98 aa, Glycine max
LIVNTHLLFPHDSSLCVVRLNQVYQILQYVELYQRENRLKPMPIILCGDWNGSKRGHVYKFLTSHGWVSSYDIANRYSDSHAHAHTWVSHRNHRGHIC

SEQ ID NO: 31155 - protein, 426 aa, Methanosarcina mazei Go1
MEEKSDLKRDLSLVEITLTGIGNILGAGIYVLMGKAAGLAGNFVWFSFLFAGVTAALSAFSYMELSSMYPRAGAEYEFVKRAFGERTGLFAGLLVVYYVTITSSAVALGFGRYFSSLFGASSLVGVAGLFLFLSLVMVYGVKESARLAVFISLIELTGLLVIVYAGFPYIGTVNYFEAPDLAGLFEASALIFFAFLGFEDIVRLSQETKNAEKTTPRALIIAISVTVFLYVCVAIASVSVLDFRVLGLSEVPLADVAAVAFGNDAFVLLSWIALFSTMNTVLVVMLGGSRIVYGMADAGSFPRALARVHPRFRTPWAAIFGIAFISGFFVLLGDITTVANIANFMIFIVFFMVNVSLIKLRYAEPERHRPFRVPVSIGRLPLFPSLGALSAVFLFSQISLEIMAYGFFLIVIGFIIVLIRTRKIPP

SEQ ID NO: 31156 - protein, 434 aa, Oceanospirillum sp. MED92
MSNNNQPHKILVIGGGAGGLELVTQLGRRYKKNTNIQVTLVDQKRSHIWKPLLHEVATGSLDPSTDAVIYHAHAAKHHYEFQLGTFCGLDRASKTVTLAEILDDNDQQILPERTLQFDTLILAIGSVSNDFNTPGVKEHCFFLDTAKQAERFHNALINNFMRVNQQDEGVLNIAIVGAGATGVELSAELYNVTDMLKSYGLPKMTSKQLKVSIIEAGPRILPALPARISSSAKNELSALGVEVCENTLIKQAEADGFITAEGDKISADMMIWAAGVKAPDFLADIYQFELTRTNQILVKPTLQASNDDSIFVIGDCCACAQEDGSWVPPRAQSAHQMASLVKTNIHQQINNKALKHFTYKDHGSLVNLSRYSTVGSLMGNLTRNSMFIEGRIARVVYISLYRMHQIAIHGFFKAMMVYVAEKVGKVVRPKMKLH

SEQ ID NO: 31157 - protein, 678 aa, Chlamydia trachomatis D/UW-3/CX
MRHSVYQLDSAVENVFRLAWTLRFSERKMLLLSRQSGSGGSFQLSCAGHELAGVVAAKSLIPGKDWAFPYYRDQGFPLGLGCDLSEIFASFLARTTQNHSAGRMMPYHYSHKKLRICCQSSVVGTQFLQAAGRAWGVKNSGKSEVVYVSGGDGSTSQGEFHEMLNFASLHQLPLVIAIQNNQWAISVPFADQCGADLVALGNSYSGLATYEVDGGDVSALTQTFERAVSDARHRHIPALVIVNVVRLESHSNSDNQAKYRSEEDLSCCQAQDPLVRLEKSLLDDFGVAHEVIEQIKAELQETVNQACELAESAPFPCKGATKHEVFAPYNISLIDYENALETASLQKLEPRVMRDAITEALVEEMQRDPGVVVFGEDVAGNKGGVFGVTRTLTEQFGENRCFNTPLAEATIIGAAVGMAFDGFYKPVAEIQFADYIWPGINQLFSEAASIYYRSAGEWEMPIVIRTPCGGYIQGGPYHSQNIEAFLAHCPGLKVVYPSNAADAKALLKAAIRDPNPVVFLEHKALYQRRLFSTTPVFSSDYVLPFGQARIVHPGTDLTIVSWGMSLVMSVEVARDLLELGISVEVIDLRTIVPCDFATVCESVKKTGKLLVVHEASEFCGFGSELVALVAERAYRYLDAPIKRIGALHAPVPYSKVLENEVLPQKEKIFQEAKLLAEF

SEQ ID NO: 31158 - protein, 392 aa, Chlamydia trachomatis D/UW-3/CX
MDYYTILGVAKTATPEEIKKAYRKLAVKYHPDKNPGDAEAERRFKEVSEAYEVLGDAQKRESYDRYGKDGPFAGAGGFGGAGMGNMEDALRTFMGAFGGDFGGNGGGFFEGLFGGLGEAFGMRGGSESSRQGASKKVHITLSFEEAAKGVEKELLVSGYKSCDACSGSGANTAKGVKVCDRCKGSGQVVQSRGFFSMASTCPDCSGEGRVITDPCSVCRGQGRIKDKRSVHVNIPAGVDSGMRLKMEGYGDAGQNGAPAGDLYVFIDVEPHPVFERHGDDLVLELPIGFVDAALGIKKEIPTLLKEGTCRLSIPEGIQSGTVLKVRGQGFPNVHGKSRGDLLVRVSVETPQHLSNEQKDLLRQFAATEKAENFPKKRSFLDKIKGFFSDFAV

SEQ ID NO: 31159 - protein, 181 aa, Zea mays
  misc_feature (101)..(101): Xaa can be any naturally occurring amino acid
MASVRLSSATMTSSLAHATMVAPFIGLKSSAAFPVTCKANTEITSITSNGGRINCMKVWPPVGKKKFETLSYLPGLTDVEIAQEIDYLIRNKWTPCIEFEXEHGFVYREHGNIPGYYDGRYWTMWNLPLFGCTDPPQVLKEVQQCKREYPNAFIRIIGSDNNRQAQCISFIPHKPPSFTDA

SEQ ID NO: 31160 - protein, 171 aa, Solanum tuberosum
MANPRVFFDLTIGGAPAGRVVMELFADTTPKTAENFRALCTGEKGVGKMGKPLHYKGSTFHRVIPGFMCQGGDFTAGNGTGGESIYGAKFKDENFVKKHTGTGILSMANAGPGTNGSQFFICTAKTEWLDGKHVVFGQVVEGLDVIKKAEAVGSSSGRCSKPVVVADCGQL

SEQ ID NO: 31161 - protein, 785 aa, Triticum aestivum
MAKAPCLCARPSLAARTRRPGPGPAPRLRRWRPNATAGKGVGEVCAAVVEVATKAEDEGEEDEPVAEDRYALGGACRVLAGMPTPLGATALAGGVNFAVYSGGATAAALCLFTPEDLKADRVTEEVPLDPLMNRTGNVWHVFIEGELQDMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLVAEAWDAGGLYQVGQFPHWNVWSEWNGKYRDIVRQFIKGTDGFAGGFAECLCGSPHLYQAGGRKPWHSINFVCAHDGFTLADLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECEGLGLEDFPTAERLQWHGHQPGKPDWSENSRFVAFSMKDERQGEIYVAFNTSHLPAVVELPERTGRRWEPVVDTGKPAPYDFLTDDLPDRALTIHQFSHFLNSNLYPMLSYSSVILVLRPDV

SEQ ID NO: 31162 - protein, 309 aa, Prunus spinosa
CTCKSWSDLIGSSSFVSTHLHRNVTIHAHVYLLCLHHPNFERQNDNDDPYDIEELQWSLFSNETFEQFSNLSHPLENTEHYRIYGSSNGLVCISDEIMNFDSPIHIWNPSVRKFRTPPTSTNINMKFSHVALQFGFHPGVNDYKAVRMMRTNKGALAVEVYSLRTDSWKMIEAIPPWLKCTWQHYKGTFFNGVAYHVIQKGPIFSVMSFDSGSEEFEEFIAPDAIFRPSELCIGVYKERICLLLDFYPCDEEGMEKVDLWVLREKQWKQLCPFIYPLDYYNRTIGISIDNKILMLRKDYTSGIAYLHLC

SEQ ID NO: 31163 - protein, 193 aa, Aspergillus nidulans FGSC A4
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRHDPKTIEELNKTSQKPVTPEQGEEVRKKIGAYKYLECSARTNEGVREVFEAATRAALLTKTHKSKKKCSIL

SEQ ID NO: 31164 - protein, 438 aa, Bacillus anthracis str. Ames
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKTEEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEEVRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEETVSIAGKCCESGDMLIWDITLPKVASADLLAISCTGAYGYSMANNYNRIRRPAVVFVKGGTSQIVVERETYENIIGNDRIRIKELV

SEQ ID NO: 31165 - protein, 307 aa, Prunus spinosa
CTCNSWSNLIGSSSFISTHLNRNVTKHAHVYLLCLHHPNFERLDDPDDPYVQQEFHWSLFSNETFKECSKLSHPLGSTEPYVIYGSSNGLVCISDEILNFDSPIFIWNPSVKKFKTTPMSTNINFKFSLVSLQFGFHPGVNDYKAVRMMRTNKNALAVEVYSLRADSWKIIEAIPPWLKCTWQHHRGTFFKGVAYHIIEKGPIFSIMSFDSASEEFEEFIAPDAICNLWWLCIDVYKEQICLLFRFYGCEEERMAKFDFWVLQEKRWKQLCPFIYPWTYRTVGFSIDNNLIMQRKDYRRGVADLHLC

SEQ ID NO: 31166 - protein, 266 aa, Aspergillus nidulans FGSC A4
MTSERENKTFLARLCEQAERYDEMVTYMKIGGELTVDERNLLSVAYKNVVGTRRASWRIISSIEQKEESKGSEQHVSIIREYRQKIETELEKVCQDVLDVLDESLIPKAETGESKVFYYKMKGDYHRYLAEFASGNKRKLAATAAHEAYKNATDVAQTELTPTHPIRLGLALNFSVFYYEILNSPDRACHLAKQAFDDAIAELDSLSEESYRDSTLIMQLLRDNLTLWTSSDGNEPENVSAPKEEKPEEDAAAPEEKPEEAKAPES

SEQ ID NO: 31167 - protein, 223 aa, Triticum aestivum
  misc_feature (35)..(35): Xaa can be any naturally occurring amino acid
  misc_feature (112)..(112): Xaa can be any naturally occurring amino acid
  misc_feature (129)..(129): Xaa can be any naturally occurring amino acid
MDVADAASKSGHQEQGHRTVSSEPPKRPAGRTKFXETRHPLYRGVRRRGRVGQWVCEGRVPGVKGSRLWLGTFTTAEMAARAHDAAVLALSGRAACLNFADSAWRMLPVLAXGSFCFGSAREIKLAVAXVAVVAYQLQQNIPPAGCPTVEPTDSPSNSLFYMSSGDLLELDEEHWFGGMDAGSNYDSLAQGMLVETPDDRPRREDAEQTGVETPTPVWSYLSD

SEQ ID NO: 31168 - protein, 385 aa, Brassica napus
SAARGADLFESIAAEIISAMILGGTMAKKCKIEDPSGFILFPLVVHSFDLVISSIGILSIKGTRDASVKSPVEDPMAVLQKGYSLTIILAVLTFGASTRWLLYTEQAPSAWFCFALPPMGPIITAYAFVWISKYYTDYKHEPVRTLALASSTGHGTNIIAGVSLGLESTALPVLVISVAIISAYWLGNTSGLVDENGIPTGGLFGTAVATMGMLSTAAYVLTMDMFGPIADNAGGIVEMSQQPESVREITDLLDAVGNTTKATTKGFAIGSAALASFLLFSAYMDEVSAFASVSFKEVDIAIPEVFVGGLLGSMLIFLFSAWACAAVGRTAQEVVNEVRRQFIERPGIMEYKEKPDYSRCVAIVASAALKEMIKPGALAIASPIV

SEQ ID NO: 31169 - protein, 502 aa, Pseudomonas aeruginosa
MEKTTTSPVGATYWRSRAENVEFEGRCLIDGKLIEAHSGQTFDCVSPVDGRVLTKVAEGGEADINKAVAAARAAFQDRRWAGQSPIFRKRTLQAFAALIRLHRDELALLETLDMGKPISASRSVDVEAVANCFDWYAEAIDKLYEQIAPTAENDLALITREPLGVVGAIVPWNFPMLTTAWKVAPALATGNSVVLKPAEQSPLTAIRLGQLALEAGIPEGVFNVVPGFGRSAGKALACHMDVDGIFFTGSTATGRLLTEYAAKTNLKRVCLELGGKSPNIILASYGDIEKAAVTAAESMFNNQGEVCIAPSRLIVERSIHKQVVEIVAEIARQRQPGDPLDPATRIGALVNAQHADRVMGFIERAKTDGATLAAGGTRALTETGGSYVVPTVFDNVSNDMEIAREEIFGPVLSVIPVSSVDEAVSVANDSPYGLGAGVWTDSLSDAHKISRKLRAGVVYVNCYNDCDITTPFGGVKQSGNGRDKSLYALDEYTELKTTWIRL

SEQ ID NO: 31170 - protein, 292 aa, marine gamma proteobacterium HTCC2207
MIRGSIVALVTPMHQETQGVDWSALKHLVDWHIEQGTNSIVAVGTTGESATLSVAEHAQVIRVIVEQAAGRLPIIAGTGANSTREAIVLTQAAADSGADACLLVTPYYNKPTQEGLYLHHKAIAEAVAIDQILYNVPGRTACDMQPETVLRLSEIDNIVGVKEATGDLERAKTLIDQCREGFAIYSGDDATARELILLGGDGDISVTANVAPKLMSQMCAAALAGDAALAAELDRKLEALHRDLFVEANPIPVKWAVAELGLQENVLRLPMTPLSAEHRERVRAAMRNAEII

SEQ ID NO: 31171 - protein, 246 aa, Brassica napus
  misc_feature (230)..(230): Xaa can be any naturally occurring amino acid
TFDGRIVAYHGGNGEDVAVKILERPENSPEKAQFMEQQFQQEVSMLANLKHQNIVRFIGACRKPMVWCIVTEYAKGGSVRQFLTKRQNRAVPLKLAVKQALDVARGMAYVHGRNFIHRDLKSDNLLISADKSIKIADFGVARIEVQTEGMTPETGTYRWMAPEMIQHRAYNQKVDVYSFGIVLWELITGLLPFQNMAAVQAAFAVVNRGVRPTVPSDCLPVLNEIMTRCXDANPEVRPCFLEGVSL

SEQ ID NO: 31172 - protein, 967 aa, Oryza sativa (japonica cultivar-group)
MAPLHRRLLHLAVVFAGLLLPGVRAGTGGAASGDAGALLAARAALTDPTAALSAWRGDDLCRWPHVACDAAAGNAAVSDGVVAGLYLGGLYLAGGFPVALCSLRSLRHLDMSSNDLTGPLPACLAGLQALETLNLASNNFSGELPAAYGGGFPSLAVLNLIQNLVSGAFPGFLANVTALQELLLAYNSFSPSPLPDNLGDLAALRVLFLANCSLTGSIPPSVGKLTNLVDLDLSSNNLTGEIPPSIVNLSSLVQIELFSNQLSGRIPAGLGGLKKLQQLDISMNHISGEIPEDMFAAPSLESVHMYQNNLTGRLPATLAAAARLTELMIFANQIEGPFPPEFGKNCPLQSLDVSDNRMSGRIPATLCAGGKLSQLLLLNNMFDGAIPDELGKCRSLMRVRLPCNRLSGPVPPEFWGLPHVYLLELRGNAFSGNVGAAIGRAANLSNLIIDNNRFTGVLPAELGNLTQLVVLSASDNSFTGTVPPSLASLSVLFLLDLSNNSLSGEIPRSIGELKNLTLLNLSDNHLSGSIPEELGGMDKMSTLDLSNNELSGQVPAQLQDLKLLGVLNLSYNKLTGHLPILFDTDQFRPCFLGNPGLCYGLCSRNGDPDSNRRARIQMAVAILTAAAGILLTSVAWFIYKYRSYNKRAIEVDSENSEWVLTSFHKVEFNERDIVNSLTENNLIGKGSSGMVYKAVVRPRSDTLAVKKLWASSTVASKKIDSFEAEVETLSKVRHKNIVKLFCCLTNEACRLLVYEFMPNGSLGDFLHSAKAGILDWPARYNIALDAAEGLSYLHHDFVPAIIHRDVKSNNILLDADFRAKIADFGVAKSIGDGPATMSVIAGSCGYIAPEYAYTIRVTEKSDVYSFGVVMLELVTGKSPMSSDIGDKDLVAWAATNVEQNGAESVLDEKIAEHFKDEMCRVLRIALLCVKNLPNNRPSMRLVVKFLLDIKGENKPKAMKITEALPAT

SEQ ID NO: 31173 - protein, 208 aa, Rhodobacter capsulatus
MTNGPLRVGIGGPVGAGKTTLTEQLCRALAGRLSMAVVTNDIYTREDAEALMRAQVLPADRIRGVETGGCPHTAIREDASINLAAIADLTRAHPDLELILIESGGDNLAATFSPELADLTIYVIDTAAGQDIPRKRGPGVTRSDLLVVNKTDLAPHVGVDPVLLEADTQRARGPRPYVMAQLRHGVGIDEIVAFLIREGGLEQASAPA

SEQ ID NO: 31174 - protein, 540 aa, Bacillus anthracis str. Ames
MSYEKVWANNEKLNQTEKNKLKKDGLEIFNDIPYYAENGFESIPKEEWDAFKWAGLYLQRPKEAGYFMMRVNIPSGIITNAQAEVLASIAEDYGRDVIDITTRQAIQFHWLEIHQIPDIFKRLARVGLSSAGACGDITRNITGNPLAGIDANELFDTTHIVKEVYDYFQHNEEFSNLPRKFKMSISSNIYNAANAEINCVAFTPAKKEIDGEKKVGFHIKVGGGLSARPYLADELDVFVLPEEVKAVAIAIATIFRDFGYREKRHLARLKFLVADWGAEKFKEKLIEYTGPLQSKGESALKGWNAGYFYGVQDQKQEGLKYVGFNVPVGRLHAEEMFEIARIAKQYGNGQIRTCNSQNFIIPNVPPENVTGLLTEPLFEAISANPKSFIGHAVSCTGIEYCNLALVETKERLRKIAEYLDTQIALDVPVRIHMVGCPNSCGQRQIADIGLQGVKMKTKEKGIVEAFEIYVGGTLLDGGAYNQKLKGKIDGEDLPDVLASFISYFKENKLPAETFYDFVGRVGVETLQIALNNVLEEVIAS

SEQ ID NO: 31175 - protein, 309 aa, Prunus spinosa
CTCKSWNDLIGSSSFVSTHLNRNVTKHAHVCILCLHHPNFERLINRDDPYSKKEFQWSLFSNETFEQCYKLSHPLGSTEHYWIYGSSNGLVCISDEILNFDSPIHIWNPSVRKLKTTPMSTNINMKFSIVSLQFGFHPGVNDYKAVRMMRTNKGAVAIEVYSFRTESWKMIEAIPPWLKCTWQHHKGIFLNGVAYDIIEKGPIFSVMSFDSGSEEFEEFIVPDAICASWGLCIDVYKGQICLLFDCYPCEEEGMEKIDLWVLQEKLWKQLPSFIYPLGYCFGIIGINIDNELLMGRRDLTKGVADLYFC

SEQ ID NO: 31176 - protein, 531 aa, Exiguobacterium sibiricum 255-15
MGFFHRGTHEIGKAGIDLEAHLDQEMILVLDFGGQYNQLITRRIRDLGVYSELHSHKITAAEVKDIAPAGIIFSGGPRSVYAEDAYRCDPEIFDLGIPIFGICYGMQLMSQHFGGTVERAGHREYGKATLTLNDPSPMYANLPLEQTVWMSHSDLVTSVPNGFVVDGTNVSCPIASIKNEELKMYGVQYHPEVNHTMFGKELLKNFLFEVCQCTGDWSMENFIEIEIAKIKEEVGDKKVLCALSGGVDSSVVAALIHAAIGDQLTCMFVDHGLLRKGEAESVMKTFADHFHMNVIKIDAQDRFLNKLKGISDPEQKRKIIGNEFVYVFDEEASKLTDMDFLAQGTLYTDIIESGTDTAQTIKSHHNVGGLPEDMQFKLIEPINTLFKDEVRELGKELGLSDEIVWRQPFPGPGLGIRVLGEITDEKLEIVRESDFILRDEIKKAGLEREIWQYFTVLPPLRSVGVMGDERTYDYAVGIRAVTSIDGMTSDWARIPWDVLEKISVRIVNEVQNVNRVLYDVTSKPPSTIEWE

SEQ ID NO: 31177 - protein, 310 aa, Oryza sativa (japonica cultivar-group)
MGVPSAPAPDAHRRGVFLLSVGAGGGGAGTAVVEVEVEHPHSLSLSPPPMSSCGRYILHRVCRFDTLAGVAIKYGVEVADVKRVNGLTTDLQMFAHKTLRIPLPVLNTDLTPSVHSVKLSTVAPSMDLLQNYYGLARPPKGDPENEGTEMATYSIGQHTKARSLSTGFSLVNGEVDDAEKPIRRRQKSDAEFSTREGNSGGVLMKAGPGLALRPKSGSRPEINNSQQDLVATAVPSYGDGLQAVRKSSSTPEFQDSDNSIASVWLKSKWNLKPDAFTLPLPILLLDSIPKPIFDTFPKQIAAWRNKAARD

SEQ ID NO: 31178 - protein, 129 aa, Vibrio fischeri ES114
MTKVLHTDNAPAAIGPYIQGVDLGNMVLTSGQIPVNPATGEVSDDIAEQARQSLENVKAVVEASGLTVSDIVKMTVFVKDLNDFGTVNEVYGNFFDEHKVANYPARSCVEVARLPKDVGIEIEAIAVRK

SEQ ID NO: 31179 - protein, 134 aa, Brassica napus
  misc_feature (131)..(131): Xaa can be any naturally occurring amino acid
MRPPRGGGGFRGRGGDRGGRFGGGGRGGGGRGRFGGGGGGFRDEGPPAEVVEVSTFLHACEGDAVTKLTNEKVPYFNAPIYLQNKTQIGKVDEIFGPINESYFSVKMFEGVIATSYNEGDKFFIDPMKLLXLSR

SEQ ID NO: 31180 - protein, 309 aa, Prunus spinosa
CTCKSWSDLIGSSSFVSAHLHRNVTKHDHVYLLCLHHSNFELQADPDDPYVKQEFQWSLFSNETFEECYKLSHPLGSTEHYGIYGSSNGLVCISDEILNFDSPIHIWNPSVKKLMTPPTSTNINIKFSYVALQFGFHPGVNDYKAVRMMRTNKNALAVEVYSIRTDSWKMIEAIPPWLKCTWQHHKSAFFNGVAYHIIEKGPTFSIMSFDLGSEEFEEFIAPDAICSSWGLCIDVYKEQICLLLKFYSCQEEGMDKIDLWVLQEKRWKQLCPFTFPLGYYYCTIGISVDNKLLLHRKDYIRGIPHLYLG

SEQ ID NO: 31181 - protein, 309 aa, Prunus spinosa
CTCKSWSDLIGSSGFVSTHLHRNVTKHAHVYLLCLHHPNFECQNDNDDPYDIEELQWSLFSNGTFVQFSNLSHPLENTEHYRIYGSSNGLVCISDEILNFDSPIYIWNPSVRKFRTTPTSTNINIKFSYVALKFGFHPGVDDYKAVRMMRTNKNALAVEVYSLRTDSWKIIEAIPPWLKCTWKNHKDTFFNGVAYHIIEKGPIFSIMSFDSGSEEFEEFIAPDAICGPWGLCIDIYKEQICLLCRYYGCEEDGMEKVDLWVLQEKRWKQLCPFIFPWDDWNVTIGISIDDELLMEIRDFDKGVANLYLC

SEQ ID NO: 31182 - protein, 438 aa, Aspergillus nidulans FGSC A4
MPISKIHARSVYDSRGNPTVEVDVVTETGLHRAIVPSGASTGQHEAHELRDGDKSKWLGKGVLTAVKNVNETIGPAVIKENLDVKEQSKIDEFLNKLDGTPNKSNLGANAILGVSLAIAKAGAAEKGVPLYAHISDLAGTKKPYVLPVPFQNVLNGGSHAGGRLAFQEFMIVPDTASSFSEGLRQGAEVYHKLKALAKKKYGQSAGNVGDEGGVAPDIQTAEEALDLITEAIEQAGYTGKIHIAMDVASSEFYKPEEKKYDLDFKNPDSDPSKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADISVGLRSGQIKTGAPARSERLAKLNQILRIEEELGENAVYAGQNFRKSVNL

SEQ ID NO: 31183 - protein, 473 aa, Arabidopsis thaliana
MAGREILHKMKVGLCGSDTGRGKTKVWKNIAHGYDFVKGKAGHPMEDYVVSEFKKVDGHDLGLFAIFDGHLGHDVAKYLQTNLFDNILKEKDFWTDTKNAIRNAYISTDAVILEQSLKLGKGGSTAVTGILIDGKTLVIANVGDSRAVMSKNGVASQLSVDHEPSKEQKEIESRGGFVSNIPGDVPRVDGQLAVARAFGDKSLKIHLSSDPDIRDENIDHETEFILFASDGVWKVMSNQEAVDLIKSIKDPQAAAKELIEEAVSKQSTDDISCIVVSRASCDERLSQKGIVDDLDDEADSVDKDVSVPMTEALEKKNRIVELMLEREHASSVKSVLETLNGLPGVRMWSPFHKTSIDHLIADEASRQGFIAFPRAEHKSRFLEFMTRRNLDDCSVKESGLRDKEWLYLYMLSKWDFDLRAYLPFEMKKVVVQTREDIESSMKLKASNAIFYMNFKAYGGPQCRGIVRKQVIED

SEQ ID NO: 31184 - protein, 290 aa, Zea mays
IPGSTPRPPLFCHNRVRASTEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGALCEPLTVGVHACRRAGVGPRTGLLLVGAGPIGLVSLLAGRGLSRASLWVPACFPPPLCRGPSPGLASALRCFPPRGPCRFGASLSRCLGFSFLFALF

SEQ ID NO: 31185 - protein, 579 aa, marine gamma proteobacterium HTCC2207
MIAENTNKGINVTIQTIVVPDLGGAETVEVIELGLNPGDSIEVEDALLVLESDKATMDIPSPAAGALVKYLVAEGATVRVGDAIAEIDVADEATAETEAEPEEVEQVTNEPLVEAAVATEQAQEQAPQVAAASSAEQMILVPDIGSDDKVELIEVCIAVGDEVNEGDTLIVLESDKATMDVPSTHSGKVLEIVVAEGAKLGTGDAVALFEVAGDAPAPVVAKPVTDKPVADKPVAPAAAPVAAPIEAAADAIQSAPGQPAQPAAVAAAEPALSSDAAQVYAGPAVRLIARELGVALTEVSGTGPRGRILKDDVSNYVKQVIKNKDAPAAAATGGSGIPVVPAVDFSQFGQIEELPMSKIQKLTAANMQRNWLNVPHVTQFDDADITDLEAFRKGLKAEGEKRGVRVTPVAFLIKAIGAALEANPEFNRSLAADGQNLIQKHYCHVGMAVDTPRGLVVPVIRDVNEKGIWDISAEISLLAGKARDGKLKPAEMQGGCFTLSSLGAIGGNGFTPIVNAPEVGILGVSKSQMKPVWDGAEFVPRLLLPMALSYDHRAINGGDAGRFMTHLVKLLSDIRYLAL

SEQ ID NO: 31186 - protein, 882 aa, marine gamma proteobacterium HTCC2207
MTKDLDPFETQEWLEAFDAVHKIHGDERANFLLSQLQSHASDQGIKLPPSVTTPFRNTISAQREKRMPGDLFMERRIRSLIRWNALAMVMRANKKSEGIGGHIASFASAATLYDVGFNYFFRGPEGDHLGDLVFFQGHSAPGMYARSFLEGRLSTDQMDNFRREVDGDGLSSYPHPWLMPDYWQFPTVSMGLGPIQAIYQAHVMRYLSARGMSPRGDRKVWAFLGDGECDEPESLGAISLAGREQLENLTFVVNCNLQRLDGPVRGNGKIMQELEGVFRGAGWNVIKVVWGRHWDRLIEKDTTGLLVKRMDEVCDGELQNYKFNGGAYTREHFFGKYPELLELVADMTDEQIMYLNRGGHDPYKVYAAYAEASAHKGQPTVILAHTVKGYGLGGAGEAANDTHSVKKLDIDSLRGFRDRFGIPVPDDQLQNVPYYRPPEDSPELEYMRRRRASLGGSLPARKADFTAMKVPELSAFKKQLESSGEREISTTMAFVRVLSTLIKDKTIGSSVVPIVPDEARTFGMEGMFRQLGIYTSEGQKYVPHDHQQIMYYKEDKKGVILEEGINEAGAMSAWIALATAYSTSSCPMIPFYIFYSMFGFQRIGDLAWAAGDSQARGFLIGATAGRTTLNGEGLQHQDGHSLILANTVPNCRSYDATYSYELAVVVQDGVKRMFEDKENCFYYLTTMNENYKQPAMPEGAEEGIIKGIYKFSHGGKAKLRVQLMGAGTILNEVREAAQILKETYSVESDIWSLTSVNELTREGQQVDRWNLLHPESKPKRAYLSEQLDGAEGPVIIATDYMKNYAEQMRKYIDKPLTVLGTDGFGRSDSREALRSFFEVDRYFITVAALKSLADEGSIKHSVVSEAIKSFGIDPEKTNPLFA

SEQ ID NO: 31187 - protein, 244 aa, Streptomyces sp. CH7
IPGDTEVRELDLASLASVRAFAAKLTADHPSVDVLVNNAGLVHLGPRRTTADGFELHVGTNMLGPYALTGLLLDALTAGSGGRVVSLSSITHKNAHLDFGDLMSEHGYRASSAYGRSKLATTLFGLELDRRLRAAGLPVVSALAHPGLTRTNLTPRAWEHRGRFGRLIAAGGLLATQSVEQGALPQLRAATDPEVRGGQFFGPARLWETRGPVTEARLGEEAADPAVARRLWAVAEDLTGVRYP

SEQ ID NO: 31188 - protein, 346 aa, Pseudomonas aeruginosa
MRAAVYESFQGKITVQTMPDPEPSEFGAVIEVKASGICRSDWHGWVGHDTDIVLPHVPGHEFAGVVAAVGRGVTKWKVGDRVTMPFMGVCGSCGECSSGNEQMCDHQFQPGFKHWGSFAQYVAIDMADRNLVALPEAVAFSTAAGLGCRFATSFRAMAFQARIEPGQWVAVHGCGGVGLSAIMIAEALGANTIAIDIADDKLELARALGAARTINARQVDNVASAIADLTGGGAHVSVDALGSVVTCRNSIESLRKRGKHLQVGLLAGDQALPAIPMGRVVLKELQLLGSYGLQPHKYGDMLAMIEAGKLKPEKLIGRTVTLEEATTILPKMDSFQERGVAIIDRF

SEQ ID NO: 31189 - protein, 435 aa, Pseudomonas aeruginosa
MTALISSSNYPLPVVHHARGVFIYDDSGKSYIDGSGGAMTVSIGHGVPEVLSAMSRQAQQVCFTYRTHFTSTAAEELAKEIVALAPGDLNKVFFVNSGSEATELSMRTAIQYWQARGQPTKTKILGRAISYHGMTMGSLSMSGHAARRADYSNLLHQFAVAPPPYAYRFEVPNDGTFGASVWEKIIQEQGADTIAAVIVEPIVGAAGGALTPPIGYLKALREICDRHSILLISDEVITGMGRTGTWFGCEHDGIVPDIIATGKGMSSGYTPMGGVIIRDGIMEALGERVKLFGHTFSANPLSAATCLAVIRYMKEHAILDNVAARSVQLESGLKDLSVRYPWMADVRGRGLLWGFEFVKDATTKEPIDAARQPNLRFAQHCFDAGLIAYPAGIAPLNNSALLAPPLVISASETEELLSRLEIGLQRFGNEMGLPA

SEQ ID NO: 31190 - protein, 235 aa, Physalis alkekengi
WLGLFHRRKNQYGRFMMRLKLPNGVTTSAQTRYLASVIRKYGEEGCADITTRQNWQIRGVVLPDVPEILKGLAEVGLTSLQSGMDNVRNAVGNPLAGIDPEEIVDTRPYTNLLTQFITGNSRGNPAVSNLPRKWNPCVVGSHDLYEHPHINDLAYMPATKDGRFGFNLLVGGFFSAKRCDEAIPLDAWVPADDGVPVCKAFLEAFRDLGFRGNRQKCRMMWLIDELGVEGFRAEV

SEQ ID NO: 31191 - protein, 503 aa, Capsicum annuum
MAIGSLARRKASTILSSSRYVSKYSSYYFSRSFASGSDENDVVVIGGGPGGYVAAIKAAQLGLKTTCIEKRGTLGGTCLNVGCIPSKALLHSSHMFHEAQHSFAQHGVKFSSVEVDLPAMMSQKDKAVAGLTRGIEGLFKKNKVNYVKGYCKFLSPSEVSVDTIDGGNTVVKGKNIIIATGSDVKSLPGLTIDEKRIVSSTGALALTEVPKNLVVIGAGYIGLEMGSVWGRLGSQVTVVEFASDIVPTMDGEVRKQFQRSLEKQKMKFMLKTKVVSVDTAGDVLKLTLEPAAGGEQTTLEADVVLVSAGRVPFTSGLGLDKIGVETDKAGRILVNERFASNVTGVYAIGDVIPGPMLAHKAEEDGVACVEFIAGKEGHVDYDLVPGVCYTHPEVASVGKTEEQVKALGLDYRVGKFPFLANSRAKAIDDAEGIVKVLAEKETDKILGVHIMAPNAGELIHEAVLALHYGASSEDIARTCHAHPTMSEALKEAAMATYDKPIHI

SEQ ID NO: 31192 - protein, 273 aa, Nocardia farcinica IFM 10152
MGADATTPRRAAVLGKPIGHSRSPQLHLAAYRALGLDWTYDRIECDAAQLPGLVDGLGPEWVGLSVTMPGKEAALGYADVRTERAVLVGSANTLVRTETGWRADCTDVDGVLGALRGGGVTGVGSGVVLGAGGTARPALLALRELGARSVTIVARDEGRARPARELAEKLGLTVTVAGFDPDGVRAACAQAQAVVSTIPAEAAATIAAAVATAPVVLDAIYNPWPTPLATAVEAAGHTVVSGLQMLLEQAYGQVEQFTGRPAPRGAMAAALTS

SEQ ID NO: 31193 - protein, 286 aa, Chlamydia trachomatis D/UW-3/CX
MSVLGACITPFKADLSIDFAALESVVRSQEHAGNGIILFGSTGEGLSLTYEEKLSILSFVSTLNLNVPIFVGVTATSVQETMSWIDFAQQWPIDGFLVPTPLYTRPGLNGQKAWFDRILSVSRKPIILYNNPIRTGVSLYPEVVKSFVSHPLCIGVKDSGGSAQACELFAESGLRVFCGDDNLWPDMRLSGASGVISVLANVWPELARDYVAQGRPIEAWKKVCSWLNLSTNPLGIKALMAAQKMIECDAVRPPLSIRDLQRRDELADILACRATLQTELLSVCRQ

SEQ ID NO: 31194 - protein, 210 aa, Triticum aestivum
  misc_feature (27)..(27): Xaa can be any naturally occurring amino acid
  misc_feature (89)..(89): Xaa can be any naturally occurring amino acid
  misc_feature (106)..(106): Xaa can be any naturally occurring amino acid
MAADNPSNGVDVYTSLASYSNDNRKAXDLSIHDSSMGLTVPSTAVCLRRLAGDAARGAVMGSIFCSGSGMFEKKGFKGSFSDAGSGCKXNFAILSGVASLVVCLLXKLRGEHDAFYVGNSWMLACFLFLLFTKVPPQAMATNLGFTFGCFSFVPSRGFVERAADVVSPCPDQARIKPEILKNYFRILPLGPPNSMIDNKWNLFSCVLPIS

SEQ ID NO: 31195 - protein, 309 aa, Prunus spinosa
CTCKSWSDLIGSSGFVSTHLHRNVTKHAHVYLLCLHHPNFECQNDNDDPYDIEELQWSLFSNGTFVQFSNLSHPLENTEHYRIYGSSNGLVCISDEILNFDSPIYIWNPSVRKFRTTPTSTNINIKFSYVALQFGFHPGVDDYKAVRMMRTNKNALAVEVYSLRTDSWKIIEAIPPWLKCTWKNHKDTFFNGVAYHIIEKGPIFSIMSFDSGSEEFEEFIAPDAICGPWGLCIDIYKEQICLLCRYYGCEEDGMEKVDLWVLQEKRWKQLCPFIFPWDDWNVTIGISIDDELLMEIRDFDKGVANLYLC

SEQ ID NO: 31196 - protein, 402 aa, Arabidopsis thaliana
MRSRQLHNVSEDRETLSRRNKRSKTSLNGHIPIDLLIEIFLKLPVKSIATCRSVSKFWTYVLGRQDFTELFLTKSSSRPQLLFACANDNGYFFFSSNQPQNLDENSSPIAAYPLTHVPKSRDLGPPINGLVSLRGERILKGRIRPVDVSIIYNPSTGESLTLPKTNMTRKKIYTVTSFLGYDPIEKQYKVLSMNMSYEKHPKCEGYQVLTLGTGKLSWRMIKCCLNYQHPLKNSEICINGVLYYLAMVNGSSWPTRAVVCFDIRSEMFNFMEVYRELSYTTTLINYNNGKLGMLMGQEAHKTISGICRSFELWVLEDTVKHEWSKHVYLLPPLWKDAVANTRLYFAGMIGTSEIVLFRPDEPLCVFYYNIDRNTIKRVGIRGLEAFKYFRIFLNHVENVKLF

SEQ ID NO: 31197 - protein, 309 aa, Prunus spinosa
CTCKFWTDLIGSSSFVSTHLCRNVTKHAYVYLLCLHHPNFECHVDPDDPFVKKEFQWSLFPNQTFEECYKLSHPLGNTEHYGIYGSSNGLVCISDEILNFDSPIHIWNPLVRKLRTTPISTNINIKFSYVALQFGFHPRVNDYKAVRMMRTNKSAMVVQVYSLRTDTWKMIEVIPPWLKCTWQHHKGTICNGVAYHIIQKGHILSIMSFDSGSEEFQEFIAPDAICTPSDLFIDVYKEQICLLFGFYGCEEEGMDKIDLWVLRDKRWKQLCPFMFPLDHCHRTIGINADNELLMERRDFIKGITYLCLC

SEQ ID NO: 31198 - protein, 423 aa, Zea mays
MAFAARRSIATRLSHHLTRRLHPCVPHARTSDSLDEQASRPSPPLPLPLPPLHVQLKQRSREVQILGFLPFSLRLAGPTRRTFSSSAPAPNLEAAPAAEVDAAGVLADAAEAAASVPAPFPGEVAAAAADSFPPVAALQHIIDAIHTFTGLNWWVCIALTTFIIRSATVPLLVNQLKATTKLRAINPEMEVIKDQMNSMDPKSVQEGQAKMKALFKKHGVSPLTPMKGLLIQGPIFMSFFFAISNMVEKVPSFKGGGTLWFTDLTTPDSLYILPMLTGLTFLATVELNLQEGMEGNPMAGKMKYFSRGVAVLTVPFTMNFATAVFCYWTSSNIFTLLYGLVIRRPAVRKWFDLPALENTPSLTAKPVFNMFGGSKAIPAAQSPVAIAGAQQSGLGQPDASALGYKVKNLEKKVKSRGKSRKHR

SEQ ID NO: 31199 - protein, 308 aa, Prunus spinosa
CTCKSWSDLIGSSSFISTHLHRNVTKHAHVYLVCLHHPNFECHVDPDDPYVKKDFQWSLFPNQTFDEFYKLSHPLGDTEHYGIYGSSNGLVCISDEILNFDSPIHIWNPSVRKLRTTSISTNINIKFSLVSLQFGFHPGVNDYKAVRIMRTNKNGLAVEVYSLRTDSWKMIDAIPPWLKFNWQHHKGAFFNGVAYHIIQKGPLFSIMSFDSGSEEFEEFIAPDAICRSLGLCIDVYKEQICLLFGFYGCEEEGMDKIDLWVLQEKRWKRLCPFIVPFDCEGTIGISIDNELLLERRDFIRGVSDLHLC

SEQ ID NO: 31200 - protein, 558 aa, marine gamma proteobacterium HTCC2207
MYIYDQYDQKLVDERVEQYRDQTQRYLDGKISEEEFLPLRLQNGLYVQRLAPMLRVAVPYGLMSSTQVRKMAEISRKFDKGYVHFTTRQNIQLNWPLLKDVPDILAELASVQMHAIQTSGNCIRNTTTDQFAGVAADEIEDPRPWCEIIRQWSTIHPEFAFLPRKFKIAVCGSEEDRAAFLLHDIGIQLVKNDAGETGFHVFVGGGLGRTPVIASSIKPFLPKQHLLTYLDAVLRVYNRYGNRNNKYKARIKILVKAWTPDVFAERVEAEWAQILARDVDGVAQLTSGEVERVKTFFPLPDYQSVDEAAMDAALQAQASDNVAFSRWLERNVRNQKQPGYAAVTLSLKPAGVAPGDVTDRQLESIAGLADQFSNGELRTTHNQNIVIADVIKSQLFDFWQMAKADGLATPTIGTINDMICCPGGDYCSLANAKSIPVAEAIQRKFEDLDYVYDLGDLELNISGCMNACGHHHIGHIGILGVDKKGEEWYQIQLGGSANKNAALAKVLGPSLSRNDVVEGIEKLLDVYVENRLEGEAFLATYQRIGADKFKERVYAKDA

SEQ ID NO: 31201 - protein, 206 aa, Physalis alkekengi
GGRGNSIWLGLFHRRKHQYGRFMMRLKLPNGVTTSAQTRYLASVIRKYGKDGCADVTTRQNWQIRGVVLPDVPEILKGLDEVGLTSLQSGMDNVRNPVGNPLAGIDPQEIVDTRPYTNLLSQYVTANFRGNVAVTNLPRKWNVCVIGSHDLYEHPHINDLAYMPATKDGRFGFNLLVGGFFSPKRCAEAIPLDAWVPAEDVVLVCQ

SEQ ID NO: 31202 - protein, 234 aa, Solanum lycopersicum
WLGLFHRRKNQYGRFMMRLKLPNGVTTSAQTRYLASVIRKYGEEGCADITTRQNWQIRGVVLPDVPEILKGLEEVGLTSLQSGMDNVRNPVGNPLAGIDPEEIVDTRPYTNLLSQFITGNSRGNPAVSNLPRKWNPCVVGSHDLYEHPHINDLAYMPAIKDGRFGFNLLVGGFFSAKRCDEAIPLDAWVPADDVVPVCKAILEAFRDLGFRGNRQKCRMMWLIDELGVEGFRAE

SEQ ID NO: 31203 - protein, 577 aa, marine gamma proteobacterium HTCC2207
MHRSFVTNIKYKNKHWMGIGMNVQEAAIQAQLAIGVSNKQPALPADSLLAMWQQAVADSGERPAFTCLGQTLSYAEIDQLGERIAGYFHTQLGLAAGDRLAIQLPNLLQYPIVVIAAWKLGLVIVNTNPMYTHRELVHQFNDSGAKAVVVLDQFYDTLQAALPETGIEHVVVTRAIDLLPQPKKTLLTAVTKVLGKRPSLPAQGIISFTDMLAGQSAYPSHTPAYDDISALQYTGGTTGVSKGVMLTQGSLMSNVAQTMDMVSAGGRSVKYFTTVSPLPLYHIYAWMLNMGLMPATRGHSVLIPDPRNIPMFVGAIKSLKFEIFCGLNSLFVALLQDSKFQKLDFSKLQITLSGGMALMDAVAHEWHEATGCVVSEGYGMTESSPVISMNPSGHEKIGTAGIPLPGTEIKVVDENGVEQDVGGVGELCVRGAQVMKGYWQREAQTEEVIVDGWLHTGDIVTVDEQGYIKIVDRLKDMIIVSGFNVYPNELEQALTLHPDVLECAAIGVADAKAGEVVKMFVVANNASLTTEQVVEFCKANMAGYKVPKFVEFREDLPKSNVGKVLRKELKAEELAKL

SEQ ID NO: 31204 - protein, 234 aa, Solanum lycopersicum
WLGLFHRRKHHYGRFMMRLKLPNGVTTSDQTRYLGSVIRKYGKDGCGDVTTRQNWQIRGVVLPDVPEILKGLDEVGLTSLQSGMDNVRNPVGNPLAGIDLHEIVDTRPYTNLLSQYVTANFRGNVDVTNLPRKWNVCVIGSHDLYEHPHINDLAYMPATKDGRFGFNLLVGGFFSPKRCAEAIPLDAWVPADDVVPVCKAILEAYRDLGTRGNRQKTRMMWLIDELGVEGFRAE

SEQ ID NO: 31205 - protein, 512 aa, Pinus taeda
MSVPEMGPFGVVVTGIVAIAIVYKLVQRWRFKLPPGPRPWPVVGNLLQIEPVRFRCFWDWSKKYGPIMSVWFGSTLNVVVSNTELAKEVLKEHDQQLADRPRSRSAEKFSRNGQDLIWADYGPHYVKVRKVCTLELFSPKRLEALRPIREDEVAAMVESIFNDCGKQEGIGKPLVVKRYLSGVAFNNITRPAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 31206 - protein, 478 aa, Chlamydia trachomatis D/UW-3/CX
MLCTTISGPSFLEAKKQILRSLKECHCFEMRVDLLSVSCLELKKLMELAPISILAWKKPESCSQADWIDKMQSLAELNPNYLDLEKDFPEEDMIRIRQLHPQIKIIRSLHTSEHTDIIQLYAHMRSSAADYYKFAVSSSSTTDLLDICHQKRSLPENTTVVCLGGMGRPSRILSPILQNPFTYARSTGSSPVAPGQFSLKHHYFYNFASLSAQSPICALIGDTSRSIGHLTHNPFFSQLGVACPYIKLPLTPQELPKFFSTIRTQPFLGVSVTSPLKTAVLPFLDKQAPSVKASGSCNTLVIRQGEIEGHDTDGEGLFSVLMQHQIPLNNQRVAIIGAGGAAQSIATRLSRANCELLIFNRTKAHAEDLASRCQAKAFSLEELPLHRVSLIINCLPPSCTIPKAVAPCVVDINTIPKHSTFTQYARSQGSSIIYGHEMFTQQALLQFRLWFPTLSFKHLEKTFIRRAAVLASLFSIAP

SEQ ID NO: 31207 - protein, 632 aa, Cryptococcus neoformans var. neoformans JEC21
MPTITVDKAELYRRLEKEYSHEEFDELCFEFGIELDEDTTIQVEEARKRGLPTPPPQLKIEIPANRYDLLCIEGLARALRIFLQKDIPPSYKLDIPEKLQEVYVEASTAPLRPYFASAVLRLARPMNQLEYESFIDLQDKLHQNLCRMRKFVAIGTHDLDTIEGPFRYMCKDPKQIKFAPLNRDTEHTAEELMTIYEADRHLAKHLHLIRDAPAYPIIYDSKDRVLSMPPIINSQRSKIVPGKTTNIFIDTTATDKTKLDIVINMVCAMFAEYCRVPFYIEPVRVHMPDGTSHITPPLEPRATTASSSYINAATGLALSRQEICTLLTRMSLSATPSPSNEDLLDVLVPCTRPDILHECDIMEDAAIAYGFNKLPREMPTTNTVAKAFPVNKLGDIIRKECAMAGWVEALPLILCSHDENFAWLNRPDPGHYAVHLANPKSLEYQVVRTSLLPGMLKTARENKALPLPMKIFEVSDVAIQDSTEERQARNYRRLCAVYMDRKAGFEVAHGLLDRVMQILGVPLLERKENEGNYGYYIASADDPTYLPGRAAHVFYRPKPTVQPSEPTPSAPPSNPIQSFTSDLKAALHAEKGSSWERDIDIGSLGILHPSVLDNFELIRPCSALEIDVEPLL

SEQ ID NO: 31208 - protein, 309 aa, Prunus spinosa
CTSKSWSDLIGSSSFVSTHLHRNVTKHAHVCLLCLHHPNVRRQFNPDDPYVTQEFQWSLFSNETFEEGSKLSHPLGSTEHYVIYGSSNGLVCISDEILNFDSPIHIWNPSVRKLRTPPMSTKINIKFSYVALQFGFHPQVNDYKAVRMMRTNKNALAVEVYSLKTDSWKMIEAIPPWLKCTWQHRKGTFFNGVAYNIIEKGHIFSIMSFDPGTEEFKEFIAPDAICSPWELCIDVYKEQICLLFSCYSCDEEGMEKVDLWVLQEKRWKQLCPFIYPFGYCYRVIGISIDNELLTGRTDFDKGVADLCLC

SEQ ID NO: 31209 - protein, 379 aa, Exiguobacterium sibiricum 255-15
MRAVTYQGTKNVEVKDVQDPSIEKNDDIIVKITSTAICGSDLHIYQGNMPAKKDYVIGHEPMGIVEEVGPDVTKVKRGDRVVLPFNVACGHCFFCEHDMESQCDNSNGNPHVDTGGYFGFTEEFGGHPGGQAEYLKVPFGNFMPLVVPESCELEDEALLFLSDVIPTAYWSVINSGVKKGDTVVILGSGPVGLMTQKFAWMQGAKRVIAVDQQVYRLNHAKMTNRVETVNLQDHKETGQYLKELTQGGADVVIDCVGLDGKMSAVEKVEQKVGLQGGTLSAINIAKDAVRKFGTVQLTGVYAKKYNQFPLGDFFTRNITLKMGQAPVVHLMPELFQKIINQEFDPTDIITHKIDLEQAAHAYQTFNDHEDGCIKVILKP

SEQ ID NO: 31210 - protein, 306 aa, Vibrio fischeri ES114
MKPTKQILEDILDEVRPLIGQGKVADYIPALACVPNDKLGIAVFTNDGEMLTAGDATECFSIQSISKALSLTLAMELYQPEELWQRVGKEPSGQAFNSLIQLEMEQGVPRNPFINAGAIVISDMLYSRFSAPKHRLLEFVRKLSGNDHIIYDRVVANSEMDHSDRNASIAYLMRSFGNFDNEVMPVLKNYFHACALSMNCVDLARTFGYLANKGIQPGISEPIVTPMQCKQINALMATCGLYDGAGEFAYRVGMPGKSGVGGGIIAIVPGEMTIAVWSPELDPSGNSLAGTKALELLSERIGRSIF

SEQ ID NO: 31211 - protein, 141 aa, Exiguobacterium sibiricum 255-15
MEWNHPLFAAITAWFIAQAAKLVTGLIKTKKFDLEIMFASGGMPSSHSSTVVALAVVIGFQEGFSSSLFALAAIFAVIIMYDATGVRQAVGLQAKLLNDYFKGIRHKTPLLNELVGHTEFQVFVGLLLGLAVGFLWPVLFF

SEQ ID NO: 31212 - protein, 1147 aa, Novosphingobium aromaticivorans DSM 12444
MTQTAPFAAFAPRHSVPSDLRRAITAATRRAERECMVMLLPEATLPQATRASAQALARKLVEALRAKPRGNGVEQLVQEYALSTHEGVALMCLAEALLRIPDNDTRDDLIRDKIAGGDWLAHLGGDRSLFVNAATWGLVVTGKLASSVDDTGLGAALTRLIARAGEPVIRRGVDLAMRMMGEQFVTGETIDEALKRARPLEDRGFRYSYDMLGEAAMTASDAARYHADYQAAIHAIGKAAARRGVYEGPGISIKLSALHPRYARAQQDRVFAELLPRLKALAYLALRYDIGLNIDAEEADRLELSLDLLEELAMDPELAGWNGLGFVVQAYGKRCPFVIDWIVDLARRSGRRIMVRLVKGAYWDAEIKRAQVDGQSGFPVYTRKAHTDVAYIACARRLLAATDVVFPQFATHNAQTLATIHEMAGPDFAVGRYEFQCLHGMGEPLYDEVVGKDKLDRPCRIYAPVGTHETLLAYLVRRLLENGANSSFVNRIANPDVPVDEIVADPVAQVAADADPGAPHPLIALPAALYPDRRNSSGLDLADESTLAALTDRFQAISAHSRHAHPSADLPHVNPRPVLNPANHRDVVGHVSEAAPAAAGMAASLAAASRWSATPVAARAMILERAADAMQAAMPELIALIVREAGKSVSNAIAEVREAVDFLRYYASQAPAMSGSRPLGVALCISPWNFPLAIFTGQVAAALMAGNPVLAKPAEETPLIASEAVRILHEAGVPDDALVFLPGDGAIGAALVAAPEIAAVLFTGSTEVGRLIQRQLATRLSAEGRPIPLIAETGGQNAMIVDSSALAEQVVADVIASAFDSAGQRCSALRVLCLQEDVADHVLAMLRGALAELTVGPTDRLSADIGPVIAAEAREAIEAHVARMEAAGCPVHRLPLGTATNEGTFVAPTIIELSAPDLLTREVFGPVLHVIRFRRADMDAMVERINAWGYGLTFGLHTRLDETVARVTAKAHAGNIYVNRNVIGAVVGVQPFGGHGLSGTGPKAGGPLYLRRLVASAPAAPALELTERELPGPVGERNIYALRPVGRVLVAAQSPERLAALTSRVERLGGTPIAADDGWQAQGPFARALVEGDAAFILSFQQAVAALDGPIAPVLASADDDTMLVAEVSLSINTTAAGGNASLMAMA

SEQ ID NO: 31213 - protein, 100 aa, Glycine max
EDLDECFFTSYNQKWKDHEELSMKAYEKEADEFKMKYIYSHIASTEQKEGTVALWLHSLNHRNYPDLHVINEEAIPNNKGADLKEAITDNKSADPEVVTE

SEQ ID NO: 31214 - protein, 347 aa, Exiguobacterium sibiricum 255-15
MGVKVAVNGFGRIGRMVFRRLIAEGKSEVVAINASYPVETLAHLIKYDTVHGKFAYPVDIIDGALMVNGRQIQIVSERDPEQLPWGQLGIDIVVEATGKFNSKTGAEKHLTAGAKKVVITAPAKGDLRTIVMGVNDEMYDHETDAIVSNASCTTNCLAPVVQVIDRAFGIESGLVTTIHAFTNDQNNIDNPHKDLRRARACGSSIIPTSTGAAKAISLVLPHLEGKLNGLALRVPTPNVSLVDLVVEVSRDTTVAEVNEAFVKAADGALDGILGLTMEPLVSIDFNGEEKSTVVDGLSTMVMGGRQVKVLAWYDNEWGYSCRVVDLVHLVGAHIEATGNEAKQLELK

SEQ ID NO: 31215 - protein, 70 aa, Glycine max
CNNVWKGGLQVDQSKGMLGTFAPQKEPYVHTLKEDITPSGVLARGVYSAKIKKKKKKKKKKKKKKKKKKK

SEQ ID NO: 31216 - protein, 789 aa, Burkholderia thailandensis E264
MSTTPSSASSEAGHAEAAAPSHARQYIDAVLEQSFRHLFGPTATPEQPRKHGVVSIAKLTAALADYLSPEEIKEVKAAFHFSDEAHLGQYRQSGEPYITHPVAVAEICAGWKLDAQAIMAALLHDVMEDQGVTKSELAERFGPKVAELVDGLSKLDKMEFRSREEAQAENFRKMLLAMARDVRVILVKLADRLHNMRTLGAVPMEKRRRVARETLDIYAPIAHRLGLNNTYRELQDMSFANFNPHRYATLEKAVKAARGNRREVIGKILESVQRAMADAKIDAEITGREKTIYSIYKKMRDKQLSFSQVLDVYGFRIVVEHPLDCYTCIGVLHALYKPVPGKFKDYIAIPKVNGYQSLHTTLVGPFGAPIEFQVRTRKMHEIAEAGVAAHWLYKNGGADLNDVQKRAHQWLKSLLDIQSEAGDSSEFLEHVKIDLFPDAVYVFTPKSKIMALPRGATALDFAYSIHSDLGNQCVAVKINNELLPLRTELKSGDIVEVITAPYSKPNPAWLGFVRTGKARSAIRHYLKTMRLNESVQLGERLVDQSLKGYGLALADVTPEVWEKLVQWTGNKSRQEIFADIGLGRRVAAVMAKRIEVLMSGRDADDDLPRAERQATNHAPPVVITGTEGMSVQLSACCRPIPGDDIMGYIGIGLGMAIHTTACRVAQRIHRRDPGRWIDVAWAPQPGRLFDVAVKALVKNTKGIFARVAADITSADANIVHIAMDEDLTQESTVLRFVIQVSDRVHLANVMRRVRTNPDVMRIMRERSSDDVVHARHDGGMRIDRERQDY

SEQ ID NO: 31217 - protein, 383 aa, Fragaria x ananassa
MVTAASIGSRVESLASSGISTIPKEYVRPEEELVNIGDIFEDEKSTEGPQVPTIDLKEIDSDDIKVREKCREDLKEAAVEWGVMHLINHGISDELMERVKKAGKAFFDLPIEQKEKYANDQASGKIQGYGSKLANNASGQLEWEDYFFHCVYPEDKRDLSIWPQTPSDYIVATSEYAKELRGLATKILSILSLGLGLEEGRLEKEVGGLEELLLQMKINYYPKCPQPELALGVEAHTDISALTFILHNMVPGLQLFYGGKWVTAKCVPNSIVMHIGDTLEILSNGKYKSILHRGLVNKEKVRISWAVFCEPPKEKIILKPLPETVSEEEPAIFPPRTFFEHIQHKLFRQSQEALVSTKESAALKSTTESALKSTKEAALISTN

SEQ ID NO: 31218 - protein, 383 aa, Fragaria x ananassa
MVTAASIGSRVESLASSGISTIPKEYVRPKEELVNIGDIFEDEKSTEGPQVPTIDLKEIDSNDIKVREKCREDLKEAAVEWGVMHLINHGISDELMERVKKAGKAFFDLPIEQKEKYANDQASGKIQGYGSKLANNASGQLEWEDYFFHCVYPEDKRDLSIWPQTPSDYIVATSEYAKELRGLATKILSILSLGLGLEEGRLEKEVGGLEELLLQMKINYYPKCPQPELALGVEAHTDISALTFILHNMVPGLQLFYGGKWVTAKCVPNSIVMHIGDTLEILSNGKYKSILHRGLVNKEKVRISWAVFCEPPKEKIILKPLPETVSEEEPAMFPPRTFFEHIQHKLFRQSQEALVSTKESAALKSTTESALKSTKEAALISTN

SEQ ID NO: 31219 - protein, 418 aa, Colletotrichum lagenarium
MGDLQGRKVFKVFNQDFIVDERYTVTKELGQGAYGIVCAAVNNQTQEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPQLFAQANPDALDLLDRMLAFDPSSRISVEQALEHPYLHIWHDASDEPDCPTTFNFDFEVVEDVGDMRKMILEEVYRFRQLVRTVPGSTQAGAQAAGQAGAGQVPIPSGNPGWTSSDPRPQEYVGQGGGLEADLAGGLDHRR

SEQ ID NO: 31220 - protein, 199 aa, Saccharomyces cerevisiae
MDTLFNSTEKNARGIPQAPFIENVNEIIKDPSDFELCFNKFQERLSKYKFMQESKLATIKQLKTRIPDLENTLKICQSLRNHSDEGDESDEPILLHYQLNDTLYTKAQVDIPEDRADLKVGLWLGADVMLEYPIDEAIELLKKKLADSEQSLTVSTEDVEFLRENITTMEVNCARLYNWDVQRRQDLKQAQEGTKNLKI

SEQ ID NO: 31221 - protein, 389 aa, Arabidopsis thaliana
  misc_feature (104)..(104): Xaa can be any naturally occurring amino acid
MALLRPHLHRFHSNTLRHSAYPSADAGGGLVVYPTYGRHRCSAIAIDAPSSLTGVTPIRWGYTSVQGFRDEMEDDIVIRSDAVDSFSYAAVFDGHAGSSSVKFXLREELYKECVGALQAGSLLNGGDFAAIKEALIKAFESVDRNLLKWLEANGDEEDESGSTATVMIIRNDVSFIAHIGDSCAVLSRSGQIEELTDYHRPYGSSRAAIQEVKRVKEAGGWIVNGRICGDIAVSRAFGDIRFKTKKNDMLKKGVDEGRWSEKFVSRIEFKGDMVVATPDIFQVPLTSDVEFIILASDGLWDYMKSSDVVSYVRDQLRKHGNVQLACESLAQVALDRRSQDNISIIIADLGRTEWKNLPAQRQNVVVELVQAATTIGLVTVGIWMSSHLS

SEQ ID NO: 31222 - protein, 232 aa, Triticum aestivum
  misc_feature (122)..(122): Xaa can be any naturally occurring amino acid
MEDERSTQSYQGGEAAEQVEVTDRGLLGNLLGKKKAEEDKEKKEEELVTGMEKVSVEEPEVKKEEHVDGEKKETLFSKLHRSSSSSSSSSDEEEEEVIDDNGEVIKRKKKKGLKEKLQEKLXPGHKDTEGEHVTGLPAPAAPASVQTHHDTDVVVEKIDGDVKTEATPAVPVTHAAPAPVHAPAPAAEEVSSPDAKEKKGLLGKIMDKLPGYHKTGEEDKAAAATGEHKPSA

SEQ ID NO: 31223 - protein, 386 aa, Zea mays
MLHLRHRIVPHIRSSSSTSAISPLHRLLSAAAAAAPISPSQGFAVEDYLVGTCGLTRPQALKASKKLSHLNSPANPDNVLAFLAGLGLSGADAAAVVAKDPQFLCAGVERTLAPVVDGLAGLGLSRPEIARLVSLVHSRFRRRSIVPKLEYYLPLFGSFHSFLRASQRACYLLSSDLDKVVKPNVMFLRECGLGDCDITKLCISEPRMLGNKLERVQAMVVRAEGLGVPRGSGMFKVALQAVAFLSEEKIAAKVDHLKKTFSWSDGEVVVALSMAPMLLKRSKDILQRSFEFLVFEVGLEPGYIAHRPVILYYSLEGRIKPRCYVLKFLKENRLLDRDWSFYTAVTRPEKYFMKKCIWPYKESAPHLAEDYAAACRGEMPSNFRFT

SEQ ID NO: 31224 - protein, 234 aa, Burkholderia thailandensis E264
MQDIIEGFLKFQRDAFAPRTALFQRLATGQQPRALFISCSDSRLVPELVTQREPGDLFVIRNAGNIVPSFGPEPGGVSASVEYAIAVLEVADVVVCGHSDCGAMRAIASCACLDHLPAVRGWLRYADAAKCVNDAREHASEQERVDSLVRENVVAQLANLNTHPSVRLALEQGRLALHGWVYDIETGSIDALDGATGRFVALAEHRHVHATPPRFDHGITHEASRVMHGVARGV

SEQ ID NO: 31225 - protein, 496 aa, Apium graveolens
MAGSGVYADIIEGDVFKYYSDGEWKKSSSGKSVAIINPTTRMTQFKVQACTQEEVNKAMETAKKVQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLTMHPGVNCISFTGGDTGIAISKKAGMVPLQMELGGKDACIVLEDADLDLVASNVIKGGFSYSGQRCTAIKVILVMQSVADTLVEKVNAKVAKLTVGPPEDNSDITPVVSESSANFIEGLVKDAKEKGATFCQEYKREGNLIWPLLLDNVKPDMRIAWEEPFGPILPVIRINSAEEGIHHCNASNFGLQGCVFTRDINKAMLISDAMESGTIQINSAPARGPDHFPFQGLKDSGIGSQGITNSINMMTKIKTTVINLPSPSYTMG

SEQ ID NO: 31226 - protein, 664 aa, Vibrio fischeri ES114
MSSRKHLANAIRALSMDGVQQANSGHPGAPMGMADIAEVLWRSHLNHNPQNPEWADRDRFILSNGHGSMLIYSLLHLSGYDLSIEDLKNFRQLHSKTPGHPEYGYAPGVETTTGPLGQGITNGVGMAMAEKALAAQFNREGHDIVDHNTYVFMGDGCLMEGISHEACSLAGTLGLGKLIAFWDDNGISIDGEVEGWFSDDTPKRFEAYGWHVIPAVDGHDSDAINAAIEAAKADPRPSLICTKTVIGFGSPNKQGTHDCHGAPLGAEEIAATKAQLGWEYGAFDIPADVYAGWDAKEVGAEKEAAWNAKFDAYAAAHPELAAEYKRRVNGDLPAEWEEKANTIIADLQANPANIASRKASQNALEAFGAMLPEFMGGSADLAPSNLTMWSGSKSLEANDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSSLIFSRQNLAQQERTQEQVADIAKGAYILKDCEGQPELILIATGSEVELAVEAAAQLTAEGKAVRVVSMPSTDAFDKQDEGYREAVFPSAVTKRIAIEAGIADFWYKYVGFGGKIIGMTTFGESAPADELFKMFGFTTENVVNTAKELLA

SEQ ID NO: 31227 - protein, 387 aa, Vibrio fischeri ES114
MSVIKMTDLELAGKRVFIRADLNVPVKDGKVTSDARILASLPTIKLCLEAGAKVMVTSHLGRPTEGEYNEEFSLAPVVNYLNDALDCDVKLAKDYLDGLELNAGELVVLENVRFNKGEKKNEEELSKKYAALCDIFVMDAFGTAHRAQASTHGVGMNAPVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIGNAKTILWNGPVGVFEFKNFEAGTAGISKAIAESAGFSVAGGGDTLAAIDKFGIKADVSYISTGGGAFLEFVEGKVLPAVAMLEERAKA

SEQ ID NO: 31228 - protein, 1313 aa, Geobacter metallireducens GS-15
MNRRELMAGVLLGSAGFLVNWFKLSLFFNVDFLFGSVFSMFALLRFGPATGLLAAVIAAGCTWLQWHHPWAIVIFGCEALCAGWLRNRKRMDLMLGDIIYWFSGGLVLVWLFYHQVMGFNAGATLLVALKQGMNGIINTLIAEALFLLSWRLRGGTELPSLRKWLGVILEGVVLVPAFVFAFLDTSWYFRQQMTRLQESTARTAEVGNLTISSWLDEEQHKLGMLVKLVGDPDHNPSQEMQRLLERYHAAHGSDTYRLGVMDRNHVTRAFSPRVDEKGVSTIGVWLGDRPYIAELNDPSHPIVFDAFMGKIGVPGPRLIMLAPCMVGGEYRGAVFSVVSLGHPAALLKGIVGKRDVNLTLLDRHRRVVASTDSGKKFLEQFALPKGGQLHSVGSNVSQWVPDPQPGGGPMKRWNRSFYMTEIALEPKSGFRLVVQSSLAPSLKEINNRASILLGVLAILTLVVVGLSRYFSRRLLAPFAMLGKVTSQLPVRIAQGEQISWRPAEVREEQELQDNFRLMENALQNSFSELTAINEELEHRVTERTAELRIAKEAAENSELQLRSITNSAHDAILMMDHQGSISYWNPAAEQILGYSAAEALGKNLHDLLTPERYLADHLTAFSEFQQTGSGNAVGKTLELFARRKDGQEIEVALSLSAVFLNGAWNAVGLLRDITEQKRINASLRMLSAAVEHSPVSIIITDRDGRIEYVNPKSCQMTGYAFEELRGQNPRIMKGPTHPPEFYKNLWETILSGREWYGEFHNRRKDGSLVWVMASISPIYDEKGEITHFVGVREEIEKQKKLQEELANIAQLEKVARDRAEQANRAKSEFLAGMSHEIRTPLNAIIGMSDLLAETRLDGEQSGYLSVVHSAGETLQGLINDILDLSKIEAGMLQLDSVPFSLRDCIRQLTDITSVKASSKGVTYSFSVKSAVPDWLMGDSLRLRQVLINLVGNAVKFTDSGGSVLLEVEPVQQSDAEVLIRFSVADTGIGIAPEKLDTIFESFSQADSSTTRRYGGTGLGLAISRHLAGMMGGEIGVESTVGKGSCFRFTVPFAISRRTEEPLPKEQLPGDKLGRPLSILVVDDNLANRTVLTAYFRRTEHTVECAVNGEEALAKIKGGGYDVVFMDMEMPVMDGYTAVRLVREWERETGRAPLPVIALTANALKEDQLRSLDAGCTAHLTKPIKKDKLLEIVGEYQQRPRTNGKQGTNMDRDNVPDKIVVVCDPDLEDIIPAYLEGRKTEGSVIRELAVNGQFDEVRTIAHGLKGSGGCYGFSRITEIGRDMELAANDGNLVEVLKQLDTLEAYLQAIEVRYE

SEQ ID NO: 31229 - protein, 277 aa, Triticum aestivum
  misc_feature (84)..(84): Xaa can be any naturally occurring amino acid
  misc_feature (191)..(191): Xaa can be any naturally occurring amino acid
  misc_feature (265)..(265): Xaa can be any naturally occurring amino acid
AYLGDLHKFVQKSRFVPVRNSRDIVDPRVRSIDGDTEIAFTEDVSGRFEALGWHTLWVKNGNDGYDEIRKAIQEAKSVTDKPTXIKVTTTIGFGSPNKANSYAVHGAALGTSEVEATRANLGWPYEPFFVPEDVKSHWSRHIPQGAALEADWDAKFAQYEQKYPEDAATLKSIITGELPAGWDDALPQYTXPKSPADATRNLSQQCLNALAKVVPGLIGGSADLASSHMTLLKMFGDFQKDPPEDRNGRFGVRDHEWASICNGLXLPTPGLHPYCGT

SEQ ID NO: 31230 - protein, 121 aa, Oceanospirillum sp. MED92
MDSLFTKIINREIPAEIIYEDDQVIAFNDINPQAPFHALIVPKKHIATLNDISSEDESLVGHMIKTAAVIAEREGFAETGYRTVFNCNEHGGQTVYHIHLHLLGGKPMGWPPYQETLKTPV

SEQ ID NO: 31231 - protein, 764 aa, Legionella pneumophila str. Paris
MLKILKRIVQDVTAASDLKEALGILVQRINTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRHFDDAEESFLITLAAQLGGIIAHAEATGELAELTQPKKGIGVDKVEAAYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFEELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 31232 - protein, 935 aa, Zea mays
  misc_feature (662)..(662): Xaa can be any naturally occurring amino acid
  misc_feature (739)..(739): Xaa can be any naturally occurring amino acid
  misc_feature (829)..(829): Xaa can be any naturally occurring amino acid
GGIPAVLVCVSLQTLDLAYNQLNGSVPAALGALPVLRRLSLACNRFGGAIPDELGGAGCRNLQFLDVSGNMLVGGIPRSLGNCTELQALLLSSNNLDDIIPPEIGRLKNLRALDVSRNSLSGPVPAELGGCIQLSVLVLSNPYAPTAGSDSSDYGELDDFNYFQGGIPDTIATLPKLRMLWAPRATLEGELPGNWSSCQSLEMINLGENLFSGGIPKGLVECENLKFLNLSMNKFTGSVDSSLPVPCMDVFDVSGNQLSGSLPVFMSKKNCLSSQAPRDDLVSEYSSFFTYQALAGFMSSPSPLDAHLTSYHSFSRNNFTGPVTSLPLATEKLGMQGSYAFLADGNHLGGQLQPSLFDKCNSSRGLVVEISNNLISGAIPTDIGSLCSSLLVLGVAGNQLSGMIPSSIGELSYLISLDLSRNRLGGVIPTSVKNLLHLQRLSLAQNLLNGTIPPDINQLHALKVLDLSSNLLMGMIPDALADLRNLTALLLDNNKLTGKIPSGFANSASLTTFNVSFNNLSGPVPTNGNTVRCDSVIGNPLLQSCHVYTLAVPSAAQQGRGLNSNDSNDTTPSNSQNEGANNSFNAIEIASITSATAIVSILLALIALFIYTRKCAPRMSARSSGRREVTLFQDIGVPITYETVVRATGSFNASNCIGSGGXFGATYKAEIAPGVLVAIKRLSVGRFQGAQQFDAEIKTLGRLRHPNLVTLVGYHLGESEMCLIYNYLSGGNLERFIQXERSKRPVDWKMLHKIALDVAKALAYLHDTCVPRILQRDVKPSNILLDTNYTAYLSDFGLARLLGNSETHATTGVAGTFGYVAPEYAMTCXVSDKADVYSYGVVLMELISDKKALDPSFSPYGNGFNIVAWACMLLRQGRAREFFIDGLWDVGPHDDLVETLHLAVICTADSLSIRPTMKQVVQRLKQLQPPIREHR

SEQ ID NO: 31233 - protein, 798 aa, Exiguobacterium sibiricum 255-15
MLVSKQWLQEFVDVRHKTGQELADLITKSGIEVEGVEVRDADLNNIVVGRVLTKEKHPEADKLNVTTVDIGQEEPVQIVCGAPNVDAGQDVIVARVGARLPGIKIKRAKLRGVVSEGMICSLEELGFEKKYIREDEQDGIHTFREPVTPGQDVLELLGLHDEVLELGLTPNRSDCLSMYGVAHEVAGILNTTPVFPSVEVPEAASSTAVTVQLDSEACTFYAAREIRDITIGESPLWLKNRLIANGIRPINNVVDITNFVLLETGQPLHAFDANKLGQQIVVRQAKAGETFQTLDEVERTLDPSMLVITDGERPVALAGVMGGANTEVDSATTSIVLESAYFAPTSVRKTSRVLGLRSDSSSRFEKGVDPRRVVLALDRAAMLIAELAGGTVLSGTAEAGTLQLEDHLIEGSVSYINHRLGMEIEGTVMKDLLERLGLEVELSADALTVSVPTRRQDLMIPADLAEEVARLYGYDALTSSLPREASRGFLPKRNQHRRKMRQLLQGAGLSQAITYSLTSEQRAMQFNEQQDLHPVKLAMPISEARSTLRTSLIPGLLEVAQHNVARQHADLAYYELGSVYLQRDASLETLPLEQEMLAGIMVGLAEQHRVHGTHVKTDFFVIKGIVETLAEALDVPLTYEAAAMQSMHPGRTARILLDGEAIGFVGQVHPGLSKEEYGLKEVYVFELDAMALHSKVARVYQEISRFPSMTRDVAIVLDRSVSASEVEAVIMQAAGPLLKQVELFDVYTGDNVGADQKSFAFSLRYQNKERTLVDEEVTTAHQQVIEALQSSFKAELRS

SEQ ID NO: 31234 - protein, 379 aa, Zea mays
MATAGKVIKCKAAVAWEAGKPLSIEEVEVAPPQAMEVRVKILFTSLCHTDVDFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 31235 - protein, 81 aa, Glycine max
  misc_feature (36)..(36): Xaa can be any naturally occurring amino acid
YNQAFEEKKIHLHTKVVKMYEASLAEIDSLVRAPGXIGLSKNSAEVQTFLEKLVRIHCPGSKVCISSILKVCLSLGVRLRL

SEQ ID NO: 31236 - protein, 353 aa, Arabidopsis thaliana
MMITRVEPRAQIAVSGGWTTFVLDGPYVSSHEALSRSHILKPGVTSAWIWTRAPTIGGMRFASTITLGEKTPMKEEDANQKKTENESTGGDAAGGNNKGDKGIASYWGVEPNKITKEDGSEWKWNCFRPWETYKADITIDLKKHHVPTTFLDRIAYWTVKSLRWPTDLFFQRRYGCRAMMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 31237 - protein, 525 aa, Oryza sativa (japonica cultivar-group)
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSPHPPLPPQ

SEQ ID NO: 31238 - protein, 1095 aa, Triticum aestivum
MPPRSCALALLVSLACAALLVAPCRCVNEQGRALLDWRRSLRPTGGALDSWRASDASPCRWLGVSCDARGAVTSLSVTGVDLRGPLPANLLPLAPSLTTLVLSGTNLTGPIPPEIGGYGELVTLDLSKNQLTGAIPPELCRLAKLETLALNSNSLCGAIPDDLGDLASLTHVTLYDNELSGTIPASIGRLKKLQVIRAGGNQALKGPLPKEIGGCADLTMIGLAETGMSGSLPETIGQLKKIQTIAIYTTMLSGGIPESIGNCTELTSLYLYQNSLSGAIPPQLGRLRKLQSLLLWQNQLVGAIPPELGQCEELTLIDLSLNSLSGSIPATLGRLPNLQQLQLSTNRLTGVIPPELSNCTSLTDIELDNNALSGEIRLDFPKLGNLTLFYAWKNGLTGGVPASLAECASLQSVDLSYNNLTGPIPKELFGLQNLTKLLLLSNELSGVVPPDIGNCTNLYRLRLNGNRLSGTIPPEIGNLKNLNFLDMSENHLVGPVPAAISGCASLEFLDLHSNALSGALPAALPRSLQLVDVSDNQLSGQLRSSVASMPELTKLYLAKNRLTGGIPPELGSCEKLQLLDLGDNAFSGGIPAELGALQSLEISLNLSCNRLSGEIPPQFAGLDKLGSLDLSHNGLSGSLDPLAALQNLVTLNISYNAFSGELPNTPFFQKLPLSDLAGNRHLVVSDGSDESSGRGALTTLKIAMSVLAVVSAAFLVAATYMLARARLGGRSSAPVDGHGTWEVTLYQKLDISMDDVLRGLTSANVIGTGSSGVVYRVDTPNGYTIAVKKMWSPDEASAGLAFRSEIAALGSIRHRNIVRLLGWAANGGSSTRLLFYSYLPNGNLSGLLHGGVVGGTKGAPTAEWGARYDVALGVAHAVAYLHHDCVPAILHGDIKSMNVLLGPAYEPYLADFGLARILSSGQSKLDDSSSKPQRIAGSYGYMAPEYASMQRISEKSDVYSFGVVLLEVLTGRHPLDPTLPGGAHLVQWVQAKRGSDDEILDARLRESAGEADAHEMRQVLAVAALCVSRRADDRPAMKDVVALLEEIRRPAAADDAKPPRPATTLPSAAAAPMLSPARGGARSVGDSFAVSDYSA

SEQ ID NO: 31239 - protein, 418 aa, Frankia sp. EAN1pec
MILGTGSAWDTACVQLADAAQHLGLDDGMHDLLRTPRRSITVSVPLLRDDGQLLVLSGYRVQHNLARGPAKGGLRYHPACDLDEVKALAMWMTWKCALMGIPYGGAKGGIAVEPGLLSRQERERMTRRYAAELVPLIGPDKDIPAPDVGTDEQTMAWIMDTYSTHTGHTAPGVVTGKPLSIGGSAGRAGATSRGVQLAAFAALRELGRDPRETTVAVQGFGKVGALAAQYLHDAGCRLVAVSDVKGGIHNRAGLNPSALIRHLARGADTVVGYPGTDTITNTELLELNVDMLVPAALEGVINTGNADRVRAPLIVEGANGPVTAEADHVLTGKGTVIVPDILANGGGVAVSYFEWVQDIQAYFWTEDQVNDRLRALMQRSYQEVSALARERRVSLRTAAHIIGVARVAEAHRTRGLYP

SEQ ID NO: 31240 - protein, 533 aa, Vibrio harveyi
MNQYVNDPSNYQLLIKNLLFSPVAFNPEQEIVYANHRRHSYKTFHDRVRQFANALTKMGVKKGDTVAVMDYDSHRYLECYFAIPMIGAKLHMINVRLSPEQILYTIDHAEDDIILIHEEFLPILDQIKGRIDTVTRYVVLRDDEECEYERLLEQESTEYNFPDFDENTVATTFYTTGTTGFPKGVFFTHRQLVLHTMGILSTIGTNASQGRLHQGDIYMPITPMFHVHAWGLPYMATMLGVKQVYPGKYVPDVLLNLIEQEKVTFSHCVPTILHLLLSSPKSKAMDFSGWKVVIGGAALPKALCKSALERDIDVFAGYGMSETGPILSIVQLTPEQLELDVDQQAEYRSKTGKKVALVEAYIVDEDMNKLPHDGETAGEIVVRAPWLTPNYYKDNKNSKALWRGGYLHTGDVAHIDDEGFIKITDRVKDMIKISGEWVSSLELEDILHQHQSVSEVAVIGMPHNKWGEVPLALVTLKEDAQVTEKELLGFAKDFINKGILAREALLLKVKIVDEIAKTSVGKVDKKELRKLHL

SEQ ID NO: 31241 - protein, 390 aa, Burkholderia thailandensis E264
MNAPHDMPTTPTLLSRLPDVGTTIFTVMSALAAEKGAVNLGQGFPDFDCDPRIVDAVARAMRDGRNQYPPMAGIAPLREAIADKIARLYGHRYDAATEITVTAGATQALLTAILCAVHPGDEVIVIEPTYDSYLPSIELAGATPVFVTLNAPDYAIPFDKLAAAITPKTRAILINTPHNPTGTVWREADMRALADIVRGTHLLIVSDEVYEHMVYDGTRHESVARYPELAARSIVVSSFGKTFHVTGWKVGYVAAPAPLTAEFRKVHQFNVFTVNTPMQFGLADYLRDPEPYLTLPAFYQKKRDFFRAGLANTRFKLLPCAGTYFQCVDYSTISDLPEAEFAKWLTTEIGVAAIPVSAFYHEPHESGVVRFCFAKREDTLATALERLARL

SEQ ID NO: 31242 - protein, 146 aa, Brassica napus
MKRSASNSVTNGDASNKKMKKTTEEDSEIGFANLDENLLYEVLKHVDARTLATSSCVSKIWHRTAQDERLWELICTRHWANIGCSQHQLRFVVLALGGFKQLHSLYLWPLSSPNQHGRLGKDELKLSLSLLSIRYYEKMNFTKRLP

SEQ ID NO: 31243 - protein, 73 aa, Gossypium barbadense
LDFLQTDFPDMDVIGISGNFCSDKKPAAVNWIEGRGKSVVCEAIIKGDVIKKVLKTSVESLVELNMLKNLAGS

SEQ ID NO: 31244 - protein, 322 aa, Alkalimonas amylolytica
MTIDFTQQALQVLQIEATAISQLARFVNDDFNKACQLIMDSPGRVIVSGMGKSGHIANKIAATFASTGTPAFFVHPGEASHGDLGMITKDDVVIAISNSGETGEVLTIIPVLKRIGAHLIGMSGNPASTLARLSDVHVCVQVEQEACPLGLAPTASTTATLAMGDAMAVALLNARGFSADDFALSHPGGSLGRRLLLRLEDVMHTGNTIPMVPTTATIKTALLEMSAKGLGMTTVVDKHGVLQGIFTDGDLRRILDQRYDIHDTLITAVMVRNCITAQPQMLAAEALKLMEQRKINGLVIVDQHQHPVGAMNMHDLLKAGVL

SEQ ID NO: 31245 - protein, 329 aa, Oceanospirillum sp. MED92
MIMKHSVCLLEAVNLALASEMRRDDSIVLLGEDIGVNGGVFRATASLREEFGLKRVMDTPLAETMIAGLTVGMSTQGLKPVAEIQFMGFIFPALEHIICHAARMRNRTRSRLSCPMVIRAPFGGGIHAPEHHSESTETLLAHIPGLKVVIPSSPARAYGLLLAAMRDPDPVIFLEPKRIYRSVQQEIEDNGVELPIGKCFTLREGSDITLLSWGAMITETLEAAAALKEQGIHCEVIDVASISPLDTETILTSVRKTGRLVIIHEAPRNLGLGAEIAATVAEKALLELQAPIARVTGYDTVMPYFRLENHYLPNTQDIIDAVTQTLEFS

SEQ ID NO: 31246 - protein, 162 aa, Malassezia sympodialis
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVIDGMNVVKAIEAEGSGSGKPRSRIEIAKCGVC

SEQ ID NO: 31247 - protein, 340 aa, Novosphingobium aromaticivorans DSM 12444
MKTRFDSDPFEPVATEAVTRSIPPRKIGREVVIAESAGLAALAEALDASFDAAVSLLHSGGGRVFVSGVGKSGHVARKIASTLSSTGRPACFIHPVEAMHGDLGMLCPGDVLIVLSNSGASMELRGLVDHAQRLSARIVAIGARPDSPLMRVADIALVIPDGPEACPVNIAPTTSTTMMLALGDALAVAVMSARGIGVERIRLLHPGGPIGERLRVAEDVMRTDALPLVGVEDPMPEVLLCMARSGLGIAGVVALGGGLVGVIEADRLPAVARDLAGERAGFLMNRHAWVARRETPLDEIARNLGVGGSDAALVIAGENDRRPIGVVSARNLGTSGAWPA

SEQ ID NO: 31248 - protein, 268 aa, Corynebacterium efficiens YS-314
MDWSNIIFAFSLTLFAGLATGVGGVIAVARKAPGERFLAGSLGFSVGVMLFVSFVEILPKAVEELTGVWGERGGNWAATGAFFAGIALIAVIDRLVPTAINPHEPSTVGGAVEGYERRSRMMRAGVLTAIAISIHNFPEGFATFVAGLTDPRIAIPVAVAIAIHNIPEGIAVAVPIREATGSRGKALKWATLSGLAEPAGAVVGFILLMPFLGPEAMGLSFAAVAGIMVFISLDELLPTAISSGRHHTAIYGLVGGMAVMAVSLLLFI

SEQ ID NO: 31249 - protein, 537 aa, Oryza sativa (japonica cultivar-group)
MADAATTPLLTSHEAKPAKAPSIDDAIETYIGATGAGQLFKAILLAFAWAFDAQQVFISVFTDAEPRWHCTAGADPSCSPGAASPCALPPGAWAWDRPAETSVVSEWALKCGGGGPALVSLPASSFFAGNLAGGFLLTTLADTHLGRRKMLVLSLATMSVAGVLTAFSPNVWVYAALRFVSGFGRSMVGTSAMVLSTELVGKWWRNTVSVAGFVLFSVGFMSLPALAYTLREASWRTMYVWTSLPSLCYAVLLYFLVQESPRWLLVRGRNQEAIEALRQIASLNGGEGVTTSSFSMLDACAVEVGDGVAGGDGMFASLRLIWERRWAFQRLAAMMTASFGVGVVYYGLPLSVGSLSSDLYLSVAYNAAAELPSSVLSWLLMGRFNRRSSLVALTAASGLCSLACVVIPDEEAGTGGLRLAAELASFFASCAAFDVMLMYSIELFPTSVRNSAVGLVRKAAVLGGVVAPMLVALGRERSYWSFGVFGLAVGCLGLFVTWLPETKGRRLSDTMEEEEEAAAAILSCAGASDMNNNGELV

SEQ ID NO: 31250 - protein, 191 aa, Nocardia farcinica IFM 10152
MSKHAAVESDEHVAERTAEAARQVERLTRWHDDFPTPGVRFADLTPVFADAEGFRSVIESLAACAPDADLVAGVDARGFLLGAGVAATLGTGVLAVRKGGKLPPPVISREYSLEYGSAALEIPGNGVELRGRRVLLLDDVLATGGTLAAAAHLFVEAGAQVVAAAVVLELEFLGGRARQGDYPLTSILRLP

SEQ ID NO: 31251 - protein, 753 aa, Vibrio fischeri ES114
MLTQLRDIVDHVAKAESLDDALALLVKNTRHSMHTECCSVYLMSNDNLRLELMATEGLKAKPKTVSLGIDEGLVGLVARSCEPLNLANASVHPSYKYIPSIAEYKFNSFLATPIIYRRQNLGVLVVQQKEKRQFTEVEESFLVTLSAQLAVILAHAKAHESWSTQLQPQSIEQKQFKGISASNGVAIAPLWFDDAQPRIESILPSSCLDTEQEQDRLGTAVELALKDFRRAKKRFEQELNTETLAIFDLFTHLLNDPMLKGDLKKQINQGDSAEWALRQVIESYAGRFEKMSDSYLSERANDVRELGQRLLYFLNYEGKLELDLAHPVILVTTQLTASMLASVPQDKLKAVISLEGAANSHAAILSRALGIPAIMGVEFNPTHYHQNLAIVDGYSGALYIKPTEALIQEYTELQNEELALSELITQDLDKPTFTRDEHQMKIYLNAGLSADTSIAVNQGVDGVGLYRTEIPFLLQQRFPSEEEQYLQYKTILETYPKKPVIMRTLDIGGDKPLPYLPIEEENPFLGWRGIRFTLDHPDIFLLQLKAMVRANIGNGNLSIMLPMISGLPELKQARKLINQAYEEVLGESEGDFSQPRIGMMIEVPSMLYLLPRVVGLVDFISVGTNDLTQYLLAVDRNNARVSHVYESYHPAVLLALKQIIDTANQYKLPVSVCGELAGDPIGCLLLLGLGYQSLSMNTSNVAKVKYIIRQVSQQEVEQLVATLLHHDDAEQILTDMIGFFEEKDLSGFIRAGR

SEQ ID NO: 31252 - protein, 952 aa, Novosphingobium aromaticivorans DSM 12444
MGYERQADFGTPEVRSETEVTCFIDGREVTVPAGTTVMRAAALTGGSIPKLCATDNLKQFGSCRLCLVEIDGMRGTPASCTTPVASGMKVHTQTPRLEKLRRGVMELYISDHPLDCLTCSANNDCELQDQAAAVGLRDVRFGYEGENHLGAATDTSNPYFDFDPSKCIVCSRCVRACDEVQGTFALTIDGRGFASKVSAGLGSDDYLSSECVSCGACVQACPTATLQEKAVKEIGKPERAVVTTCAYCGVGCTFRAEMRGEQLVRMVPWKDGKANRGHSCVKGRFAWGYAQHQERVLSPMIRESIDQPWREVSWEEALSHTAREINRIRETYGRNALGGITSSRCTNEETFLVQKLIRAGFGTNNVDTCARVCHSPTGYGLKTTFGTSAGTQDFDSVEDTDVILVIGANPTDGHPVFASRMKRRLRQGAKLIVIDPRRTDLVRSPHVEADFHLPLRPGTNVAVLTAMAHVIVTEGLADEAFIRERCDWDEYQHWAEFVSAARNSPEFLSPVIGVGADAIRGAARLYATGGNGAIYYGLGVTEHSQGSSTVMAIANLAMATGNIGRRGVGVNPLRGQNNVQGACDMGSFPHELSGYRHVSDAETRALFEAEWGVPIDPEPGLRIPNMLDAATDGVFKAIYIQGEDILQSDPDTRHVAAGLAAMECVIVHDLFLNETANYAHVFLPGSTFLEKNGTFTNAERRIQPVRKVMEPLNGYEDWQVTQELARAIGLDWNYTHPSEIMDEIARLTPTFAGVNYKRLDAEGSLQWPVNDKAPDGSPIMHIDGFVRGRGKFVVTDYVPTDERTGPRFPLLLTTGRILSQYNVGAQTRRTANTVWHPEDVLEMHPTDAENRGVKTGDWVRLASRSGETTLRALVTDRVAPGVVYTTFHHPATQANVVTTDYSDWATNCPEYKVTAVQVTPSNGPSDWQEDYEAQAARSRRIAGHEGAMEPAE

SEQ ID NO: 31253 - protein, 378 aa, Schizosaccharomyces pombe 972h-
MADLYTKDWTDVKDKPVARVVFIHGFGEHVNAYPEFFEALNERNIEVYTFDQRGFGHSRKGGPKKQGCTGGWSLVFPDLDYQILRASDTELPLFLWGHSMGGGLALRYGISGTHRHKLAGVIAQAPMLRCHPDTEPNFLLRKALTLVSKVHPNFLFDSDVQSQHITRDEAVNQRLQDDPLVSSVGSLQVFSDMLNRGTKTIELAPQFFLPLLITHGTDDNVTCSDSSKEFYENAGTKDKTYQSYPGFYHSLHIEKKPEVYEYLDKVAAWIYEHSKPSETVKSEQETAVEHPKPTATTSAPSASPTGVPVEEESHKATSDAVPPAEAKPEPVPASAAERAPTSESTTVPETIVASTTKVISEPAPRVTTAATADIVTNK

SEQ ID NO: 31254 - protein, 457 aa, Burkholderia thailandensis E264
MQSNTVHPCDEVLPSGKLLTLGLQHVLVMYAGAVAVPLIVGGALKLPKDQIAFLISADLFACGIATLIQTLGVWLFGIRLPVIMGCTFAAVGPMIAIGTNPGLGILDIFGSTIAAGAIGIVLAPMIGKLLRFFPPVVVGTVISVIGLSLMEVGINWAAGGVGNPNYGDPVYLGLSFIVLALILVINKFGRGFVANISVLLGMVAGFAIAFAAGRVNTDGVAAAPWVGFVAPFHFGLPHFDPLAIATMVIVMFVTFIESTGMFLAVGDMVERPVDQETLVRGLRVDGLGTLIGGIFNSFPHTSFSQNVGLIGVTGVKSRFVCATGGMILVLLGLFPKMAQLVASVPPFVLGGAGIVMFGMVAANGVKVLSKVDFVHNHHNLFIVAVSIGLGLVPVVSPNFFSKLPAALAPILHSGILLASVSAVVLNLVFNGMKGERDARCDIHSAGCDFDGRPADLH

SEQ ID NO: 31255 - protein, 512 aa, Debaryomyces hansenii CBS767
MLVTLKTPTGNSISFKTGLFINNEFRQAKNGNELTTPNPATGEPLATISAATAEDIDDAVKAARKAFETTWGKKSTPSQRSEALHKWADLIDANIDTLAELESLDNGKPVWMARDVDIKDSIACLRYYAGLADKIEGRTIEQEEGVKLAFTRPEPIGVCGQIIPWNYPIQMFAWKVGPALAAGNTVIMKPAEQTPLSALVLAELAAKAGFPPGVINIVNGLGAVAGKAISSHMDIDKIAFTGSTVTGRTIMEAAAKSNLKKVTLELGGKSPVVVFDNADIDQAVNWVSQGILFNHGQDCCAGSRLFVQDTIKDVFLAKLKTNFESHVIGDPFDIKTFQGPQVSKQQQEKIQSYIKSGIEEGATLFTGGEQRLAHLSAQFKNGYYVSPTIFTDCKPGMKIVDEEIFGPVLTVQSFSTEEEAVEKANNTEYGLAAGVFSQNASQCMRMVHALRGGTVWCNHYMALSNAVPFGGMKQSGFGRELGIEGLKEYTQTKAVHWNYGEEAVWPIDGTTV

SEQ ID NO: 31256 - protein, 224 aa, Oryza sativa (japonica cultivar-group)
MAADSLDMSLDDLITNKYKRRSRPDPAPSARRFHSRAATRAAAAPYHAITFQAPPTAYTHPTPVETGTKLHISNLDYAVSNEDIKELFSEVGDVKRYSINYDKSGRSKGTAEVVFSRKSDALAAVKRYNNVQLDGKPMKLELIGINIEPPPPAMFGFAAPAGYFDFPPKRGGRGWPRGRGGFGGRGRGHVGRGRGRGDRGSRKISAEDLDADLDKYHAEGMQMS

SEQ ID NO: 31257 - protein, 471 aa, Saccharomyces cerevisiae
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 31258 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 31259 - protein, 1061 aa, Oryza sativa
  misc_feature (14)..(14): Xaa can be any naturally occurring amino acid
MGSAGNENSDTLLXNGVVGILAETANMWERRAPLTPSHCARLLLGGGKRGTGVNRIIVQPSTKRIHHDAQYEDVGCEISKDLSECGLIIGIKQPKLEMILPHRAYGFFSHTHKAQKENMPLLDEILEKRVSLFDYELIAGDDGKRLLAFGKFAGRAGLIDFLHGLGQRYLSLGYSTPFLSLGQSHMYPSLAAAKAAVIAIGEEIATFGLPSGICPIVFVFTGTGNVSQGAQEIFKLLPHSFVDAGKLPELSAARSLSQHPQSSKRVFQLYGCVVSSRDMVTPKDPTRCFNKADYYAHPEHYKPVFHERIAPYASAIVNCMYWERRFPRLLSIDQLQQLMKNGCPLVGISDITCDIGGSIEFVNKSTSIERPFFRYDPCTNSCHDDMEGNGVICLAVDILPTEFSKEASQHFGDILSKFVARLASAKELLELPSHLRKACIAHAGRLTSLYEYIPRMRKTIIELPPAPTNLLPDKKYNSLVSLSGHLFDKFLINEALDIIETAGGSFHLIRCDVGQSIDDMSYSELEVGADDTATLDKIIDSLTSLANAHGDPNARREIELSLKIGKVNECGTDDSMAKEGSKVLILGAGRVCRPAAEFLASYSNIFSSSAYDHDIDQIHVIVASLYQKDAEETIDGIRNATAAQLDVADIKNLSNLVSQVEVVVSLLPASFHAAIARVCIEMKKHLVTASYVDESMSKLEQSAEGAGVTILCEMGLDPGIDHMMSMKMIDEAHSRKGKIKSFTSFCGGLPSPASANNPLAYKFSWSPAGAIRAGRNPAVYKFHGEIIHVDGDKLYESAKRLRLPELPAFALEHLPNRNSLMYGDLYGISKEASTVYRATLRYEGFSEIMATFAKIGFFDAASHPLLQQTTRPTYRDFLVELFNACNISTTARKEYSEVSGGQDGELISRLLSFGHCKDKEIAAKTVKTIKFLGLYEETQIPENCSSAFDVICQRMEQRMAYIHNEQDMVLLHHEVEVEYPDGRPTEKHQATLLEFGKVENGRPTTAMALTVGIPAAIGALLLLQNKIQKKGVIRPLEPEIYIPALEILESSGIKLAERVET

SEQ ID NO: 31260 - protein, 195 aa, Burkholderia thailandensis E264
MRVAEVVRNTSETQIRVKIDLDGTGRQKLATGVPFLDHMLDQIARHGLVDLDIEAHGDTHIDDHHTVEDVGITLGQAVAKAVGDKKGIRRYGHSYVPLDEALSRVVIDFSGRPGLEFHVPFTRARIGTFDVDLSIEFFRGFVNHAGVTLHIDNLRGVNAHHQLETVFKAFGRALRMAVELDERAAGQIPSTKGSL

SEQ ID NO: 31261 - protein, 390 aa, Corynebacterium efficiens YS-314
MGSDCLHRRTPPMTDMFDLIDDWGPEKIVVVHDHRTRMRGVLVIDNTARGMGKGGTRMQPTVSVGEIARLARVMTWKWAGVDLFYGGAKAGIQADPASPDKEAVLRSFVRKLSNEVPEEYIFGLDMGLTEHDAAIITDELGRGTCMGTPYELGGVPYDQLGVTGYGIAEVADEVAQSQNLAGASVAIQGFGAVGHAVAERLHTLGYRVVAVSTARGAIADPNGLDIPELVRLREEVGDDLVSHYPVLRIDPGEELFMDAEILIPAALQDVINARGAERVTARIVVEGANLPTSPQAQQILHQRGITVVPDFIANAGGVVAAAFAMDNRFSPFRTDPEQIYTSVSSKLRLNATTVLGRAAERSQTSHDAARQLSQERVRAAMEVRGMLPSG

SEQ ID NO: 31262 - protein, 428 aa, Bacillus anthracis str. Ames
MVAEKGTQTKTQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRDIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAGGVTVSYFEWVQNNQGYYWTEEEVEQRLEKVMVRSFDSIYETAQVRKVNMRLAAYMVGVRKMAEASRFRGWV

SEQ ID NO: 31263 - protein, 487 aa, Mycobacterium tuberculosis CDC1551
MPPLDITDERLTREDTGYHKGLHSRQLQMIALGGAIGTGLFLGAGGRLASAGPGLFLVYGICGIFVFLILRALGELVLHRPSSGSFVSYAREFYGEKVAFVAGWMYFLNWAMTGIVDTTAIAHYCHYWRAFQPIPQWTLALIALLVVLSMNLISVRLFGELEFWASLIKVIALVTFLIVGTVFLAGRYKIDGQETGVSLWSSHGGIVPTGLLPIVLVTSGVVFAYAAIELVGIAAGETAEPAKIMPRAINSVVLRIACFYVGSTVLLALLLPYTAYKEHVSPFVTFFSKIGIDAAGSVMNLVVLTAALSSLNAGLYSTGRILRSMAINGSGPRFTAPMSKTGVPYGGILLTAGIGLLGIILNAIKPSQAFEIVLHIAATGVIAAWATIVACQLRLHRMANAGQLQRPKFRMPLSPFSGYLTLAFLAGVLILMYFDEQHGPWMIAATVIGVPALIGGWYLVRNRVTAVAHHAIDHTKSVAVVHSADPI

SEQ ID NO: 31264 - protein, 641 aa, Burkholderia thailandensis E264
MSTGAQTKAAEASQHADGPRLLADVGGTNARFALETGPGEITQIRVYPGAEYPTLTDAIRRYLKDVKIGRVNHAAIAIANPVDGDQVRMTNHNWSFSIEATRRALGFDTLLVVNDFTALAMALPGLTDAQRVQIGAGARRQNSVIGLMGPGTGLGVSGLIPADDRWIALGSEGGHATFAPMDEREDLVLQYARRKYPHVSFERVCAGPGMEIIYRALAARDKKRIAANVVTADIVERAHAGDALALEAVECFCGILGTFAGNLAVTLGALGGIYIGGGVVPKLGELFMRSPFRARFEAKGRFEAYLANIPTYLITAEYPAFLGVSAILAEQLSNRTGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVEQAIDILNNARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRASPNAELAEAMARAKARAGASAGDEAADVLDWLSHGAAPAAKE

SEQ ID NO: 31265 - protein, 124 aa, Selenomonas ruminantium
MQVIHTDNAPAAVGPYSQAIKAGNTLYLSGQIAINPAEGKIVATTITEQAEQCCRNIEAVLKAAGTDMSKVVKTTCFLAEIADFKAFNEVYAKHFISKPARSCVAVKDLPAGALCEVEAIVVFD

SEQ ID NO: 31266 - protein, 126 aa, Sulfolobus solfataricus P2
MKEIIFTEKAPKPIGPYSQGVKVGDILYVSGQIPVDPKTNEVVGKNIEEQTIRVIENIKAVLEAAGYMLDDVVMSFVYLKDIKDFQRFNEVYSKYFSNKPPARVTVEVSRLPRDVLIEITVIAQKS

SEQ ID NO: 31267 - protein, 374 aa, Aspergillus niger
MAAPRLFRPAARLLSSRLTSAPLRPQTACAPSILRFRGYATESGTKEVTVRDALNEALAEELESNKKTFILGEEVAQYNGAYKVTRGLLDRFCPKRVIDTPITEAGFCGLAVGAALAGLHPICEFMTFNFAMQAIDHVINSAAKTHYMSGGIQPCNITFRGPNGFAAGVAAQHSQDYSAWYGSIPGLKVVAPWSSEDAKGLLKAAIRDPNPVVVLENELLYGQTFPMSEAAQKDDFVLPIGKAKIERPGKDLTIVTLSRCVGHSLNAAAQLKQKYGVDAEVINLRSVKPLDVETIIQSLKKTGRIMCVESGFPMFGVSSEILALSMEYGFDYLTAPAVRVTGAEVPTPYAVGLENMSFPQEDTIVSQAAKLLRL

SEQ ID NO: 31268 - protein, 128 aa, Legionella pneumophila subsp. pneumophila str. Philadelphia 1
MQPINTKLAPKAIGTYSQAIKSGEIVFLSGQIPLDPETMQICSDDIKLQITQVLENLSAVCEEAGGSLANIVKLNVYLTDLSHFPLINEAMSRYFSEPYPARAAIEVSALPKGAKVEMDGILVLSESA

SEQ ID NO: 31269 - protein, 395 aa, Mycobacterium tuberculosis CDC1551
MAQREWVEKDFYQELGVSSDASPEEIKRAYRKLARDLHPDANPGNPAAGERFKAVSEAHNVLSDPAKRKEYDETRRLFAGGGFGGRRFDSGFGGGFGGFGVGGDGAEFNLNDLFDAASRTGGTTIGDLFGGLFGRGGSARPSRPRRGNDLETETELDFVEAAKGVAMPLRLTSPAPCTNCHGSGARPGTSPKVCPTCNGSGVINRNQGAFGFSEPCTDCRGSGSIIEHPCEECKGTGVTTRTRTINVRIPPGVEDGQRIRLAGQGEAGLRGAPSGDLYVTVHVRPDKIFGRDGDDLTVTVPVSFTELALGSTLSVPTLDGTVGVRVPKGTADGRILRVRGRGVPKRSGGSGDLLVTVKVAVPPNLAGAAQEALEAYAAAERSSGFNPRAGWAGNR

SEQ ID NO: 31270 - protein, 413 aa, Schizosaccharomyces pombe 972h-
MHSLLRPSRFSANQSVLCLLQRHRVFFSSISVKPRKRMVYCVVSYRGTGFAGLQYNANVKTIQDTLFQAFARVGAVVQVNADSPKKIRMCSAARTDKGVHAIVNVLGLKVLDNQPLPHVVNLVNDILPPCIRVWKMARTFNSFSPHTVCDSRVYEYWLPVSSLLTPRPCTLEAYVIAKASEKAFPINETLSHLANLSKQDCVANSLSEPFRLSKPKLDFLKHACTMFRGTHRFHSYTTEKGFSDASSRRFLLDVRVDNLHIDKLNRQWVKLIFHGQSFMKHQIRKMVGILIHLTRTGWNAQVLLNTFNNSYRIRIPRAPAEFLLLNQPIFQAFNKKCSRFDHEPVEWSCAQKGIDQFAHSFLRTPMFDCFISSESFQSFFILQKQFQLFQDLALLTSFDFLEPSSRRDILGEK

SEQ ID NO: 31271 - protein, 418 aa, Oryza sativa
  misc_feature (352)..(352): Xaa can be any naturally occurring amino acid
MEGRPGRRRRRRVKAPTRAAGMDWISGLPDEILHHIMSFLNARQAVQTCVLSRRWSDLWRTVPCINADFNEFDFIDYQGDDEDYNDEVAFKRFVNRMLELRDPATMMDKFWLKYKISDGYNEYKDSNVDANRWISHALQKQARVMEVVVFSFPLELDHSVFTSCYLRKIGFSCVSLHQGFFKQLDAGCPELEELFLHDCTIADEEIFSQSLKVLTIDDTEFSKANKAYISIPSVTSLTLSSPENSTPMLKDMALLTTTSVSVKFYTFSYGFDANDLRQCLWSLSGVTNLELNYEGTELTFENNLQWCPEFINVVNLTLGQWCLDANFYALIVFLQNSARLEKLTLNLAKDRXELMERSFTCEHLKIVEVKCLEDDPQVISVQDFFASNGMASVQFHIKHWGQYEEEDELPAFVRYEER

SEQ ID NO: 31272 - protein, 561 aa, Schizosaccharomyces pombe 972h-
MFVGSPSAIEKPLSLSSKTKVGDETEFTEDALRGSSLVPTGILNGDDECHALHMSPQAIHSQAGKAESDGLPTYASVEKSTTPIGRLLSNLNGGLASAPPKVGFGFPRYYALRIEDLPRDLTPREFLCTFLFATNVVSVELNPVSVDNEVAHGLAVFSSRDAAASARDTLLSSDVYSACSMIILDNYRKGSQTNLSDETEGSESSVSFNRLSRNHSPTRPLLGNRDLFRRSSNHVSASMPTANHSESAYRHSKTPLGDSTFQAPNNGGSLHSDRLWSSFPVSYPLTLANVLAKDEVGSPTWSPTPSKSSTNLRQDGVPPILRFNSLSINTNVARNYLSSEKGYSAHTQNSSAQSPHPRVFSANSAFSTTSPPPLTPSTSRDYPFSASTISPSTPFSAYSSSHGIHQRIPASTPTNTNPADQNPPCNTIYVGNLPPSTSEEELKVLFSTQVGYKRLCFRTKGNGPMCFVEFENIPYAMEALKNLQGVCLSSSIKGGIRLSFSKNPLGVRSSSSSHNNHNGNVRNLHSGSMNNYNTDSLLNHTGGHNEVHASPSWGNNLMYGK

SEQ ID NO: 31273 - protein, 429 aa, Xylella fastidiosa Dixon
MSDLDKVTLNAGETSLVLPVLKPTLGNGCVDIAKLTKETGLFTYDSGFTATASCKSAITYIDGEKGVLLYRGYPIEQLAEHSSFLEVAYLLMNGELPRKDEFAKFDDEITHHTMMHESLKNFLGGFHYDAHPMAMLAASVASLSAFYHDTLDLNDLEQRRLAAIRLIAKVPTLAAAVHRYSIGWPIRYPRNNLGYVERFLHMMFEVPSEPLQLNPVVTKALDLLFILHADHEQNASTSTVRLVGSTGANPYASVAAGITALWGPAHGGANEAVLKMLEEIGDAKNVDLVIAKAKTKDKNSPFRLMGFGHRVYKHFDPRAKIIRETAHTVLGELGVNDPLLEVALKLEEVALKDDYFVQRKLYPNVDFYSGIIYKAINIPLEMFTVMFAIARTAGWVSHWLEQQVDPEMKISRPRQIYTGHSERDYKDAR

SEQ ID NO: 31274 - protein, 295 aa, Debaryomyces hansenii CBS767
MTKLQGIFAAVPTPLTTDAKGIDIPNIAKQVDRLADAGIHGIVTTGTTGEFPALTTEEHKSVIKAYIDAAKGRIPVVAGLGSNSTQHAIEMAQFSEKMGATAVMIVPPFYDPLSFKALYKFYKDVCGSISIPVMYYNLPGATGVHLTADQVRQLGEIKGFDYMKDTSGNAKEHADLLTNPSDKITVFNGWDTLTFFSMSHGAQAIVWGIASIVPKECVELWNTFSREKNIDEAREQWKFLWEVSDFLESVNYPAGIKTGLDIIGQSAGPLRLPTLPLEDEDIEKLSKILEKRKYK

SEQ ID NO: 31275 - protein, 1467 aa, Aspergillus nidulans FGSC A4
MSESELRQRKPAARLRDDPQPSQDAQPRLKHGIPMQVLRSLLLATWFNCCCVVILMTQLIGCPLYIINKHYYYAWMASTKRSFGLVITSLTEWGCPTYVRVSGDESIRGQVRIADDGRLKTTFPERLVMISNHQVYTDWIYLWWIAYSNMMHGHIFIILKESLKYIPIIGQGMTFYGFIFMARKWLSDKPRLQHRLEKLKTQHIGSDSGAPKYDPMWLLIFPEGTNLSINTKRRSDAYGAKNGFPPLKHQVLPRSTGLFFCLQQLRGTVEWVYDCTVGYEGPPKGSYADKYFTLRSTYVQGRPPTSVNMYWRRFAVSDIPLDDQQEFDAWLRARWTEKDELLDEYFETGRFPSALAGSIEVGHGDAQQLNAAEDGYAEAHVRLGHWTEVYDGMLLYLNNSPCLLSDRGTWKDLLLLSSTELLSPRLEGGVAGSRSLRTPAMTSLRNKYSNGIVNGDSLPVTGVLANSRFSDIPSAIDIPASTLDSEVEVSLEGLPDDPTELCTLLENERAAKNFWVIIALAYAKQKQIDHAIDILNKGLASVAQGATKEKLGLLGWVCWLYLLKSREAPRVVSDVGLGTEARTKDYYIQQATGILNEASRLNPSFPPLFLARGVLSLLRASLHPPRPVRPGAVDNSERVESLRQALKQFDESSKAFGGRNAMAILGRARAHYLLGRYAEALEGYQKVLMRMPGLTDPDPRIGIGCCLWQLGFKEQAKAAWERALALNPDSKVANILLAVYYLYDSSRHATTDPAFGSLYKVAMTQYTQKAFKLDKEYPMTCALFGSYFLLRKAYSTVDTLARKSIENTDVMQIASDGWYLLGRKCHYEGDLAKAAEFYHRSDQARGGGDKGYLPAKFGSVQMQVSNKDYDGAKFQLEKIIQQTKNPECMTLLAALYAEEVFAAQKSGMKEDKSAEAKKAITLFEAVRALWKDESKKITPDESVLVYLSRLYEQNAPDKSMQCLTQLEELQLAEISDEERPEGLEDEEMKAALRVNLPPQLLNNMGCFLYQSSQLNMARSMFQAALDSCARSQEREGELDTDALVTTISYNLGRAFEASDMPDEAKKVYEALLERHSDYTEASARLTYLALRRSPTDEGPKKMAKLYETDSTNLEVRALFGWYLSKSKKRAANIAEDHEQRHHKHTLQYFDKHDRYALTGMGNVHLLFARDMRRDTDQEKEKRRKMYERAVEFFDKALQLDPRNAYAAQGIAIALVDDRKDLSTAVQIFSKIRDSLRDASVYLNLGHVYAELRQYTRSIEHYEAALSKDRARDAQILACLGRVWLLKGKQEMSLAAMKTALDYAQRAHSVAPTQAHLEFNVAFVQNQIASLTYSLPETQRTAQDVQDAADGLRTAVETFGRIAQAKNPPYPAESLEQRANMSKTIIKQLERALQSQKEYEEKNAAKLQQAREAREAEIRRREEEVRKAEEAERERKQRIAEERQRLVEEAQRLALSGQKRNGPAKKRR

SEQ ID NO: 31276 - protein, 334 aa, Idiomarina baltica OS145
MSRKITVIPGDGIGPDIVKSALAILEKAGCEFDYEFVDAGLTALEKTGELLPQATLDAIAKNGVTLKGPLTTPVGEGFTSINVSLRKRFGLYANLRPVKSFKGTQARYDNIDIITVRENTEGMYSGLGQKVSEDGSEAEAMSKITRAGAERIVRFAYDLARREGRKKVTAVHKANILKSTSGLFLKVAREIADEYPDIESAEMIVDAACMRLVMNPEDFDVLVTTNLFGDILSDLCAGLVGGLGMAPGANIGKDCAIFEAVHGSAPDIAGKNLANPSSVILAAVQMLEYLEMPEPAEKITRALAEVIESGDRTTRDLGGSHGTTDFTDAIIERL

SEQ ID NO: 31277 - protein, 443 aa, Enterococcus faecalis V583
MSEKKQNNLHLTVGPEDSVSFGQATMLGIQHVLAMDVYVVPVIIASIIGISTAQTSSLIQATFIAAGLATIIQSHFCMRLPVAQGPSFIPIGAIAGIYFANNQQGNGWGAVLGASLVGAIVVIILGFTGIFNRLITKFVPPIVGGTIIFVVGLSLMPVALSDNIYHAKGELGQNILLAFIAAGTLIFFALLGSALKKGRIFRVSSVILALLFGSIAAQLLGVLDLSAVSKAAWFSLPQLPLVNFSFQFDWSAIATMLVIYLVLMAETTGTWFAVSHVVAEPLTEEKINRGVIGEGLGCLVSSFIGGTPVTSYSTNAGIISITGVASRKVFVAAGAWFVLFGLSGKLSTLISAIPAPVIGGVFVVVCGIISVSGMKVMSDVTIHEKEMYVIAVPIIMTLALTLLPKEFLETLPQFLQYLFSSPVATASIVAILLQAILPNVQEG

SEQ ID NO: 31278 - protein, 306 aa, Nocardia farcinica IFM 10152
MTQEFAVTTPETTQTVGTARVKRGMAEMLKGGVIMDVVTPEQAKIAEDAGAVAVMALERVPADIRAQGGVSRMSDPDMIDGIINAVSIPVMAKARIGHFVEAQILQSLGVDYIDESEVLTPADYTNHIDKWQFTVPFVCGATNLGEALRRITEGAAMIRSKGEAGTGDVSNATTHMRKIRQEIRKLAALPEDELYVAAKELQAPYELVREVAETGKLPVVLFTAGGIATPADAAMMMQLGAEGVFVGSGIFKSGNPAQRAEAIVKATTFYDDPDVLAKVSRGLGEAMVGINVEEIPQPHRLAERGW

SEQ ID NO: 31279 - protein, 1076 aa, Vibrio fischeri ES114
MPKRTDIKSVLILGAGPIVIGQACEFDYSGAQACKALREEGYRVILVNSNPATIMTDPDMADATYIEPIHWEVVRNIIEKERPDAVLPTMGGQTALNCALDLEKHGVLAEFGVEMIGATADAIDKAEDRSRFDKAMKSIGLECPRADTAKTMEEAYGVLDMVGFPCIIRPSFTMGGTGGGIAYNKEEFEEICRRGLDLSPTNELLIDESLIGWKEYEMEVVRDKNDNCIIVCAIENFDAMGIHTGDSITVAPAQTLTDKEYQLMRNASLAVLREIGVETGGSNVQFGINPKDGRMVIIEMNPRVSRSSALASKATGFPIAKIAAKLAIGFTLDELMNDITGGATPASFEPTIDYVVTKIPRFNFEKFAGANDRLTTQMKSVGEVMAIGRNQQESLQKALRGLEVGATGFDEMVDLDAPDALTKIRHELKDAGAERIWYIADAFRAGMSVDGVFNLTNVDRWFLVQIEDLVKEEEAVKAGGFANLTADALRKLKRKGFADARLSKLLGVGESEIRRLRDQHDIHPVYKRVDTCAAEFSSDTAYMYSSYDEECEANPTDKDKIMILGGGPNRIGQGIEFDYCCVHASLALREDGYETIMVNCNPETVSTDYDTSDRLYFEPVTLEDVLAIARVEKPKGVIVQYGGQTPLKLARALEAAGVPIIGTSPDAIDRAEDRERFQVAVDRLELLQPENATVTTMEQAIDKSKEIGFPLVVRPSYVLGGRAMEIVYDEQDLRRYFNEAVSVSNESPVLLDSFLDDAVEVDVDAICDGEQVVIGGIMEHIEQAGVHSGDSACSLPAYTLSEEIQDVMRDQVRKLAFELGVRGLMNTQFAVKDNKVYLIEVNPRAARTVPFVSKATGAPLAKIAARVMAGQSLESQGFTKEIIPPYYSVKEVVLPFNKFPGVDPLLGPEMRSTGEVMGVGTTFAEAFAKAELGCSKEYPEGGRALLSVREGDKKRVVDLAKHLVKLGYQLDATHGTAVILGEAGINPRLVNKVHEGRPHILDRIKNGEYTYIVNTAAGRQAIEDSKVLRRGALAEKVNYTTTLNAAFASCLAHEADDRKTVNSVQELHAKVAAKYA

SEQ ID NO: 31280 - protein, 308 aa, Pseudomonas sp. B11-1
MPLDKQIAAVLQQFSELPAPDFSQLDAAQYRQFCDNLLPAIPGDPMIEVRNLRVAAAAGELDARLYRPLEEDNLPLLVFFHGGGFVMGNLDTHDNLCRSLASQTEAVVVSVAYRLAPENHFPAAPLDCYAATCWLVEHAAELGVDGRRLALAGDSAGGNLALAVSRLAAQRQGPKISYQCLFYPVTDARCDSQSYEEFAEGYFLTGAMMYWFWQQYLQDTGQGDDPLASPLRAETLADLPPTTLITAEFDPLRDEGEAFALRLQQAGVSVRVQRCEGMIHGFISMAPFVERAAHALSDAAADLRRALN

SEQ ID NO: 31281 - protein, 371 aa, Cryptococcus neoformans var. neoformans JEC21
MVVSPPLTPGVQGSRAWVTLVTNPAYVAGLLTLHRTLSSLSAYPLLVMTTPSLPATHSSLLRSLGLNLVPVSHLSPSSSQHPGFDPSFSRFNDAWTKLQVFGLTEYDKVILIDCDMIFLKDMDELFDFELPGRDWIGASPACVCNPLKLGHYPKDWIPANCSLSMQQSPTSLTSPPIPSPSAPRTAHLLNSGLVILHPSSTVLASLIDFINTSPTIAHVKFADQDVIAEAFKGRWRPLPWWCNALKTLRAVHKPLWRDEEVGIIHYILDKPWSARPPSLPPHQHPSPALPPSPASLDGSDDGQASYHVKPQIRRRPLPSGLLDAVRNSPPQKSLTDYSEVDAWWWIVYEDLLDDLKARGVDWEAVDKWVTR

SEQ ID NO: 31282 - protein, 540 aa, Corynebacterium efficiens YS-314
MGVFPGGFCMPAGIPPISRWHPRTINPGAPVPVAWWGQSHLSRKDTPMTDPLDVSALLTKVPTGLLIGDTWRDSSDGSTYTVDNPATGQTIATLASATSDDALAALDAACEVQSSWARTPARERSEILRRAFDLINERAEEFATLMTLEMGKPIAEARGEVTYGNEFMRWFSEEAVRTYGRHGQTPEGTHRMLTVRKPVGPCLLITPWNFPLAMATRKVAPAIAAGCTMVLKPARLTPLTAQYFAQTMLDAGLPAGVLNVVSGASASAISNPIMEDDRLRKVSFTGSTPVGKQLLKKAADKVLRTSMELGGNAPFIIFEDADLDLAVEGAMGAKMRNIGEACTAANRFLVHDSIAQDFSRRLAERFNQLTLGNGLDDGVTVGPLVEAKARENVAKLVDDAVTEGATVLTGGTAGEGEGYFYQPTVLVDVAPGARILTEEIFGPVAPIITFTTEEEAIQLANDTEYGLASYLFTRDYARMFRISDQLEFGLLGFNSGVISNAAAPFGGVKQSGIGREGGTEGIDEYTQLQYIGIRDPYTDR

SEQ ID NO: 31283 - protein, 418 aa, Sulfolobus solfataricus P2
MSKKVDELIKEDQEYLMQSFRRWYPFVIDHGFGAIVYDIEGNEYIDFNAGIGVVALGHKNEKIINAVKEQMDKFFHYSLTDFYYEVAIEVAKRLSSLMPFSAKVFYANSGTESVEAAIKIARGHTGRQWIIGFINSFHGRTLGSLAFTSSKAIQRKSFSPLLPSTYLIPYPDRRDPLCKEECTEELLGFIEDWVFKKVVDPNEVAAFIAEPIQGEGGVIVPPKDFFYKLNNLLKKFGILLILDEVQTGIGRTGKMFAFEHFNVTPDLVCLAKALGGGLPLGAVVGRKEIMDLPPGSHANTFGGNPLALAAANVILEEVPKLLDHVSSIGKKIIEELTDTRSPYLYDVRGLGLLIGAELRKNDKPFVEGLEKVLYNSFRRGVLAIGAGESVVRIEPPLIISEELAMKGTKILKEEIEKL

SEQ ID NO: 31284 - protein, 288 aa, Schizosaccharomyces pombe 972h-
MNYQRLEKLGEGTYAHVYKGQNRVTGEIVALKVIRIDADEGTPSTAIREISLMKELRHPNIMSLSDVLQTENKLMLVFEYMEKDLKKYMDTYGNQGALPPSQVKNFTQQLLKGISFCHENRVLHRDLKPQNLLINSRGELKLADFGLARSIGIPVNTFSNEVVTLWYRAPDVLLGSRVYSTSIDIWSVGCIMAEMATGRPLFAGSNNEDQLLKIFRLLGTPTEQSWPGISLLPEYKPTFPIYKAQDLAYLFPTFDPLGLDLLRRMLRLQPELRTTGQDALQHAWFLTA

SEQ ID NO: 31285 - protein, 143 aa, Shewanella oneidensis MR-1
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAQSIDENAAHGSDSLASAEREIAYFFSAEELCPRTR

SEQ ID NO: 31286 - protein, 471 aa, Corynebacterium efficiens YS-314
MSENPTRPEGGRHHVVVIGSGFGGLFTAKNLAKADVDVTLIDRTNHHLFQPLLYQVATGILSSGEIAPSTRQILSGQDNVNVIKGEVTDIDITKRTVTASLGSYTRVYEYDSLVVGAGAGQSYFGNDHFAQFAPGMKTIDDALELRARIIGAFERAEVCEDPAERERLLTFVVVGAGPTGVELAGQLAEMAHRTLAGVYTNFNPSSAKIILLDGAPQVLPPFGKRLGRNAQRTLEKLGVTVKLNALVTDVDEEAVTYKTKDGEEHRIPSFCKIWSAGVAASPLGKLIADQAGVEVDRAGRVKVNRDLSVGEYKNIFVVGDMMALDNLPGVAQVAIQGGEYVAEQIAAEAEGRSSDEREDFDYFDKGSMATVSRFSAVVKMGKVEVTGFIGWLLWLGVHLMFLVGFRNRFVSAISWGLNALSRKRWNLATTRQQLHSRTALAKLGQVIDEKDGDVPIELKDTTRFGAANKLK

SEQ ID NO: 31287 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAISAAKELASQGEKIRVVSMPSTDVFDKQDAAYKEEILPNAVRRRVAVEMGASQNWYKYVGLDGAVLGIDTFGASA

SEQ ID NO: 31288 - protein, 466 aa, Tagetes patula
MAMGLGLGSVYLLLLCFVLTSCCNGGISSSYSRTNDISADMPLNSDVFALPHGFNAPQQVHITQGDHEGRGVIVSWVTPNEPGSSKVIYWAENSNVKQHAVGSFVTYKYYNYSSPYIHHCTIKNLEYNTKYFYELGTGNVTRQFWFTTPPEVGPDVPYTFGLIGDLGQTFDSNRTLTHYESNPAKGQAVLFVGDLSYADAYPLHDNNRWDSWARFVERSVAYQPWIWSAGNHEIDYLPEYGEGEPFKPYTHRYYVPYEAPGVHLRFGYSIKRASAYIIVMSSYSAYGMYTPQYKWLMNELPKVNRSETPWLIVVMHCPLYSTYLHHYMEGETMRVMYEQYFVKYKVDVVFSGHVHAYERTERISNVAYNIENGLCTPRNDEYAPVYITIGDGGNQEGLLYEMVDPQPKYSAFREPSYGHATFEIKNRTTAYYAWHRNQDGYSVEADSVWFHNLYWKSLSDSSAASL

SEQ ID NO: 31289 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAIEMGASQNWYKYVGLDGAVLGIDTFGASA

SEQ ID NO: 31290 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGENIRVVSMPSTDVFDKQDAAYKEEILPNAVRRRVAVEMGASQNWYKYVGLDGAVLGIDTFGASA

SEQ ID NO: 31291 - protein, 521 aa, Gibberella zeae PH-1
MEKFPDFVDTPLGESPSDSPSNTPGWANGAPPRPSDRWLPVSKHDSNWSTASRGHTRQKSLTDAIRTIRGRNGSVSQNAQEIADALRAPVSPKLIILCLMWYASSALTNTSSKSILIAFDKPATLTLVQFAFVSSLCIFMAWLATIFPVLRTKVAALKYPIRKPTRDVIRTTLPLAAFQIGGHLLSSTATSKIPVSLVHTIKGLSPLFTVLAYRFVYDIRYPKTTYLSLIPLTFGVMLACSGKTTYGGELIGVIHALLATVIFVTQNIFSKKLFNEAAKAEAESPHSMSKKLDKLNLLCYSSGMAFLLTLPIWLWSEGFTLLMNLYHEGSIDLNEQPNSMDHGRLTLEFIFNGVFHFGQNILAFILLSIVSPVTYSVASLIKRVFVIVLALVWFRSPTTPIQGVGIALTFLGLYLYDRTKSSNKADQKAQSMQVKRSSLLPTTNGGLRPTPITESPQSTDLNPYPYREGYFGRPTAAEDSKKSDDGGARSRTPATSNGWLPPGTKQEDTWQPGDRVAGVAR

SEQ ID NO: 31292 - protein, 479 aa, Bacillus thuringiensis
MLEKKVGIHFAIKRENNVKKRMGYAMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRRICSENGILFVADEIQTGFSRTGKYFAIDHYNVVPDLITVSKSLGAGVPISGVIGRKEIMNESAPGELGGTYAGSPLGCAAALAVLDVIENEKLNDRAIELGKVVMNRFEEMKNKYHCIGDVRGLGAMCAFEVVQDRKTKAPDKTLTANLCAEANKRGLLLLSAGTYGNVIRVLMPLVITDEQLEEGLTIIEESLQACYEQTNIARV

SEQ ID NO: 31293 - protein, 572 aa, Saccharomyces cerevisiae
MCGIFAAFKHEDIHNFKPKALQLSKKIRHRGPDWSGNAVMNSTIFVHERLAIVGLDSGAQPITSADGEYMLGVNGEIYNHIQLREMCSDYKFQTFSDCEPIIPLYLEHDIDAPKYLDGMFAFCLYDSKKDRIVAARDPIGVVTLYMGRSSQSPETVYFASELKCLTDVCDSIISFPPGHVYDSETDKITRYFTPDWLDEKRIPSTPVDYHAIRHSLEKAVRKRLMAEVPYGVLLSGGLDSSLIAAIAARETEKANADANEDNNVDEKQLAGIDDQGHLHTSGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDKDFLQLCMNIDPNEKMIKPKEGRIEKYILRKAFDTTDEPDVKPYLPEEILWRQKEQFSDGVGYSWIDGLRDTAERAISDAMFANPKADWGDDIPTTKEAYWYRLKFDAWFPQKTAADTVMRWIPKADWGCAEDPSGRYAKIHEKHVSA

SEQ ID NO: 31294 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADPGASAYQAWTKLVADYKEAHPELAAEVEAIIDGRDPVEVTPVDFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQNAAYKEEILPNAVRRRVAVEMGASQNWYKYVGLDGAVLGIDTFGASA

SEQ ID NO: 31295 - protein, 107 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLS

SEQ ID NO: 31296 - protein, 99 aa, Brassica napus
  misc_feature (14)..(14): Xaa can be any naturally occurring amino acid
FLESVPGFEEAIQXAYASHLLSLSYQKLPRSVLAELLNMDGASLDKFIEHQVANSGWILEKENGSIVLPQNEFNHPELKKNAGENVPLEHIARIFPILG

SEQ ID NO: 31297 - protein, 325 aa, Marinobacter sp. ELB17
MAKMNMLQAINNALDTAMAANERVLCFGEDVGIFGGVFRATSNLQQKYGKSRCFNTPLVEQGIIGFANGLAAQGSVPVAEIQFADYIFPAFDQIVNETAKFRYRSGNLFDVGGLTIRAPYGGGIAGGLYHSQSPEAYFAHTPGLKVVVPRNPHQAKGLLLAAIHDPDPVLFFEPKRLYRASVGEVPEEEYQLPLGKAEVLKEGTDVTVLGWGAQMEVIEHAVEMAEKDGISCEVIDLRSILPWDVDTVAESVLKTGRLVITHEAPLTGGFAGEIAATIQERCFLYLESPIARVAGLDTPFPLVLEKEHFPNLLKVYEAICDSVEF

SEQ ID NO: 31298 - protein, 483 aa, Sulfolobus tokodaii str. 7
MKSHIILRLFLHTLTLPNALSSPILSVSKVYQSSRPSSSIRYYTSSLLIISHTVIKNMSVSELLRKNNVEILRFTWVGLDGIIRSKGAYIDEVDNLVKTGIGLTMAMMSFTPMDYISPYGTFGPQDEDVFLTPDLSTLSIFPPSAVVLCYLYKGSSPWMYDPRSTLKKILEKYSEYEFKSSFEIEFYLVKDRKPFDDTKCFDSRAYYNNQIIPEIAKVAGSVGIVPLRVIKEYGPGQYEFDIQHKDAMRSADEVILFKEIARQIASKYNVEANFMPKPFNKMAGSGLHLNFSIWKDGRNLFYDPNDNYGLSDLAYNFIAGIIEHAKALTAIAAPTVNSYKRLVPGSWAPTKITYGYNNKSAMLRIPTPYPGMSMQDRRIEYRVPDATTNPYLLLSAFIEAGIDGIERGLKPPSPVNENAYFRKDIEDVPRNLREALNELKKDTRLIERVGREIVEEFIRVKMAEVEEFESLVTDWEYEVYKYV

SEQ ID NO: 31299 - protein, 335 aa, Debaryomyces hansenii CBS767
MKVKIKSRAGASVISCTSNQVSLNTLVHEIKTALKGSISDDAVVTLKNGFPPKAIDMSRLEAPLSELGIKNGDQLILEDENESSSTDMQESNPTQVSSGSHTKTKSDPNIPSIYIESLDKHLILRNIPDDNSCMFNSISYGLFGYDSFDRDGISPPSNLRSIISSTIQDNQDTYNEVVLGRTVDKYCQWILKKDSWGGAIELGILAEWFKVRINCLDIELGKFIRFENEANKPDNFIILIYLGIHYDILSLNVNLSTSSQDKQTDTCVWPINSKIEELVLEYSLKLCHYLQTQNYSTNTTTFRIRCLDCYKILVGEMGASKHANETGHYNFGEVK

SEQ ID NO: 31300 - protein, 116 aa, Aspergillus nidulans FGSC A4
MADVEMKEASSSKTKAVSKAEGSGDGKKKFEVKKWNAVALWAWDIVVDNCAICRNHIMDLCIECQANQGSSTTEECTVAWGICNHAFHFHCISRWLKTRQVCPLDNKDWEFQKYGR

SEQ ID NO: 31301 - protein, 451 aa, Streptomyces coelicolor A3(2)
MTPQPSPQAGAAVKAADRAHVFHSWSAQELIDPLAVAGAEGSYFWDYEGKRYLDFSSGLVYTNIGYQHPKVVAAIQEQAARMTTFAPAFAVEARSEAARLIAERTPGDLDKIFFTNGGADAVEHALRMARLHTGRPKVLSAYRSYHGGTQQAVNVTGDPRRWASDSGTAGVVHFWAPFLYRSRFYAETEEQECARALEHMETTIAFEGPGTIAAIVLETIPGTAGIMMPPAGYLAGVREICDKYGIVFVLDEVMAGFGRTGTWFAADLYDVVPDLMTFAKGVNSGYVPLGGVAISAEIAATFAERPYPGGLTYSGHPLACAAAVATINVMAEEGVVEHAARLGAEVVEPALRELAERHPSVGEVRGTGMFWALELVRNRETREPLVPYNATGQAATPMSAFAASAKAHGLWPFVNMNRTHVVPPCNVSEAELKEGLAALDTALSVADEYTE

SEQ ID NO: 31302 - protein, 202 aa, Pinus pinaster
MTTEYDYLFKLLLIGDSGVGKSCLLLRFADDSYVGSYISTIGVDFKIRTIELDGKAIKLQIWDTAGQERFRTITSSYYRGAHGIIIVYDVTDMDSFNNVKQWLSEIDKYASDNVSKLLVGNKCDLTEKQAVDQQMAKSFADELGIPFLETSAKDASNVEQAFLTMAGEVKRRMASQLTEGNRKANTVEMKGQPLQQKGGCCS

SEQ ID NO: 31303 - protein, 748 aa, Nocardia farcinica IFM 10152
MAVLSDHAPPSSPAPAEGGPAAGRGKLVSIVRHDLPASIVVFLVALPLSLGIALASGAPVAAGLIAAVVGGIVVGCLGGSVLQVSGPAAGLTVVVAESIAQFGWRVTCFIVVAAGALQILFGLSRIARAALAVAPVVVHAMLAGIGVTIALQQVHVLLGGSSHSSAWHNITALPGRLTSMNTGAALVGVLVVAVMLGWKYLPEKVRVVPGPLVAVVAATVLSLVLPLDVERIVLSSSLFEAIELPQIPDGGWAPVALMVLTIALIASVESLLSAVAVDKMHSGPRTNFDRELVGQGSANMLSGMLGGLPVTGVIVRSATNVQAGARSRASAVLHGVWLLLFSVALVGVVEQIPKAALAGLLIVIGIQLVKIAHIKLASRTGDLLVYAVTILGVVFLNLLEGVIIGLVLAFALLLWRVVRVTIVAEQIPQSQRWLVRIDGSCTFLALPRLSGELAKVPAGADVTVEMTVDFLDHAALEALQDWVRQQESGGGSVEFVEIGSVRMADALAGPPARGFARAMWEEILGPWRRDEKHLDPVTAGVAAYHRSHAHVVRRHLDELVHRQDPDSFFLTCSDSRIVPNVITNSGPGDLFTVRNVGNLVPATGDASVEAALVFALEELNVRCVVVCGHSSCGAMGALYGGGDAAPGIEPWLAHARPSLERFRAGHPVAEAARAAGFGEVDQLSMVNVAVQLETLQRHPAVRRAVAERGVTVAGLFFDIASARVVEITADGIVHIDEARGRRQVPEPV

SEQ ID NO: 31304 - protein, 516 aa, Cryptococcus neoformans var. neoformans JEC21
MFRSSLPQRTSHNSASEAGPSIPTPIPTDGDAVTLENASNTTGEATLSSSGSSEGESLISKMMADNPYFSAGAGLMGIGVALTALRRSITLGATMAQRRMLVTLEIPSKDRSYPWFLEWMAHQSAAQTRGNVKPPGLFGWGQGMRSHELAVETSYKQHENGASEAIFNLVPGPGTHYFKYGGAWFQVKRERDSKLMDLHSGTPWETLTLTTLSTSRDLFSSLLEEARTLAEASTEGKTVVYTAWGVEWRPFGKPRRRREMGSVVLGKGIAEEIESDLKGFLGRGKWYAERGIPYRRGYLLHGPPGSGKTSFIQALAGSLNYNICLMNLSERGLTDDKLNHLLGLVPERSFVLLEDIDSAFNRRVQTSEDGYKSSVTFSGLLNALDGVASSEERIIFMTTNHYDRLDPALIRPGRVDIQQLLDDAAGEQAKRLFVKFYGNSVNEDGTKGRVLREGELPLNDEEVESLGNSVQRIVDDERAHGKVVSMASLQGHFIRTGAKESLDGIRELCRPREGQA

SEQ ID NO: 31305 - protein, 98 aa, Glycine max
  misc_feature (28)..(28): Xaa can be any naturally occurring amino acid
  misc_feature (36)..(36): Xaa can be any naturally occurring amino acid
  misc_feature (58)..(58): Xaa can be any naturally occurring amino acid
GDEVQDLGEGTFPSAPGIETISSSPKNXSEIDFSWXETELLAGVKKDGDSSLKVIAIXASVLLPFDHRMLVHNVTAQGLNYGSSSSLAHASVPFYLQS

SEQ ID NO: 31306 - protein, 483 aa, Bacillus thuringiensis
MDKKATFVSIDKKAMYINGEWITLQEQIEVNNPATKEIFATVPKGGVTEAKQAVDAAHEAFKTWSKLTAADRATKLKKWFMLIDKNKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDSRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGVANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 31307 - protein, 379 aa, Legionella pneumophila subsp. pneumophila str. Philadelphia 1
MEQRDYYELLEVSRNASDAEIKKAYRRLAMKYHPDRNPGDTSAEEKFKEIQKAYNILSDKQKRAAYDQFGHAGVDPSMGGGPGGFGGFGGFGDVFEDIFENIFSGGRGHGRQSRGQRGADLQFNVQLTLEEAAIGKEVEITVPRHGTCTVCEGSGAKKGTSPKTCETCQGMGQVRIQQGFFSIQQTCPTCHGEGKIISDPCASCHGQGRVRESKKINVKIPAGVDNGDRVRLSGEGEAGVHGGGSGDLYVQISLKKHAIFERHENDLHCEVPISFATAALGGSIEVPTLEGRVTLKIPAETQTGKVFRLRSKGMKSVRGYGQGDLLCKVVVETPVNLSREQKELLNKLQDSLENAKGTHSPKTSSWFAGVKKFFEDMKF

SEQ ID NO: 31308 - protein, 634 aa, Streptococcus pneumoniae
MSNLSVNAIRFLGIDAINKANSGHPGVVMGAAPMAYSLFTKQLHINPAQPNWINRDRFILSAGHGSMLLYAFLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILSNAVRRRVAVEMGASQNWYKYVGLDGAVLGIDTFGASA

SEQ ID NO: 31309 - protein, 122 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 31310 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 31311 - protein, 116 aa, Zea mays
LFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 31312 - protein, 175 aa, Zea mays
  misc_feature (44)..(44): Xaa can be any naturally occurring amino acid
  misc_feature (71)..(71): Xaa can be any naturally occurring amino acid
NWWERVGFVLFSFTICGVQAVQFCLNPFLSHVYVGPPKGNDWFXKQTAGPLDILGPPWMDWFQGGLQFQIXPPLFPPLPRGPLWKVSPAVGYLFKKHGVTFSPAPLLGANVLSWKTLRGSPFQARSPPRGGGGAPKNFVWGAFYPPGLLTGPGYGLGEGHFWCFNFLPPPMFGCF

SEQ ID NO: 31313 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHFSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 31314 - protein, 436 aa, Geobacter metallireducens GS-15
MNYVIIGNSVAAVGAIRGIRSIDQQGNITVISRERHVAYGRPLISYLLGGLITEKRMAYLPEDFYEKNRVNLLLNAEVVGVDTDNRKVTIAGGDVIVYDKLLVATGGDPFVPPIEGMAGKDRIFTFTTWDDAAKLKGIADDIEKVVVIGGGLIGLKAAEGLHLIDKKITIVELADRILSAAFDRPAGRVVAKKMKANGIDVITEDTVVRIEGDGAAITGVTLKSGDFIPCDTVVVAIGVRPAAGFLKGSGVEVNRGIVVDDLMETNVKGVFAAGDVAEAKDFFSGVKNPMPIWPDAYIQGDIAGVTMAGGSKGYQGGIAMNSIELFKVSTISMGITNPVEPKEYEILTYQDLENYQYRKIVLKDGILAGAVLVGAVDRAGIFAGLIRDRIEVSSFKDHLLTPDFGFVNLPREIRSTLFAPVGKVTGAYEQARAVGH

SEQ ID NO: 31315 - protein, 309 aa, Gibberella zeae PH-1
MAAVYKSISKTSAPKAEASSNGIKKNKQRVLILSSRGVTYRHRHLLNDIASMLPHSRKDAKFDSKTKLYELNELAELYNCNNVLFFEARKGKDLYVWLSKVPNGPTIKFHLQNLHTMEELHFTGNCLKGSRPVLSFDGAFDKQPHLRLIKELFLHTFGVPQGARKSKPFIDHVMGFSFVDGKIWVRNYQVNEVEAEAKGEEEEDEDSKSKSRSGKPDTDINLVEIGPRFVLTPIVIQEGSFGGPIIYENKEFVSPNQVRADLRRTKASRHNARTEQQVERRVRKGDLGLRSAGGQRPAKSELDTKMLFA

SEQ ID NO: 31316 - protein, 593 aa, Triticum aestivum
MQQRKAPKASAEGVTEQEASPAAVLPRTATARDLLEAEEAPDQCSMTPRKKNKKRQTGAGERRCRPVLNLLLVAFVVAVLLAVVLLADGGRVPAVWIAAARAQLRRGSGHAWLPYARNAPDKLLGGLLADGVDGETCRSRHESSAYRRSTPRRPSPYLVAKLRRHEELQRRCGPGSDAYSRAVQQLSAGRSAVDAECKYVVSVCNRGLGNRILAAASAFLYTLLTDRVLLVYRGNGMGDLFCEPFPGATWLLPPDFPVAGLANITVDAAETYGNMLKNKVLTADSKEPVQVPALAYAYLEHDYGDGDKRFFCDDDQRLMSNIQWLVARMDTYSVPGLFQVPSFAEELAALFPESDAVFHHLGRYLFHPADHVWGLVSRYYRAYLARAEQLVGVQVRVFDSEQGKSPHVLRQITSCVWKEKLLPEVLAAGEPVITPATGGISRTVLIASLRPWFYERIKSMYWEQPTASGEDVGVHQPSHEEYQQFGRRSHDTKAWAEMYLLSLCDVLVTSGWSTFGYVAQGLAGVTPWVMYRPLNFSETPDPPCGRDVSMEPCFHTPPMYDCKLKHTADTARSVPHIRRCEDVKWGLKLVGPK

SEQ ID NO: 31317 - protein, 417 aa, Burkholderia thailandensis E264
MAEIKNYTLNFGPQHPAAHGVLRLVLELDGEVIQRADPHIGLLHRATEKLAESKTFIQSVPYMDRLDYVSMMVNEHGYVLAIEKLLGIEVPERAQYIRVLFDEITRVLNHLMWIGAHALDVGAMAVFLYAFREREDLMDVYEAVSGARMHAAYYRPGGVYRDLPEAMPQYKASKIRNERALAKMNEARSGSVLDFIDDFFTRFPKCVDEYETLLTDNRIWKQRLVGIGVVSPERALQLGLTGPMIRGSGIAWDLRKKQPYEVYDRIDFDIPVGVNGDCYDRYLVRVEEMRQSTRIAKQCIEWLRENPGPVITDNHKVAPPSRVGMKTNMEDLIHHFKLFTEGFHVPEGEAYAAVEHPKGEFGIYLVSDGANKPYRLKIRAPGYAHLSALDEMARGHMIADAVTIIGTQDIVFGEIDR

SEQ ID NO: 31318 - protein, 353 aa, Prosthecochloris aestuarii DSM 271
MFKIVSIPGDGIGPEVVASAIRVINTLARQHGLEITIEEHLFGGASYDVHGEMLTQETLEACRKCDAVLLGAVGGPKWENLPHEKKPEAALLGIRKELGLFANFRPAKVYDALVNASSLKPEILAGTDFMVIRELTGGIYFGEPRGYDDTRGWNTMVYEHYEVERIARLAFDAAMKRKKQLVSIDKANVLESSQFWRNIVHEVHKDFPEVELIDMYVDNAAMQIVRDPKQFDVIVTKNLFGDILSDISGMITGSLGMLPSASIGSSHALYEPIHGSAPDIAGQNKANPIATIASAAMMFEHSFCMKNVADEIYSAIEKTLASGFRTADIANPEDTIVSTTEMTDAIVANLEAS

SEQ ID NO: 31319 - protein, 479 aa, Burkholderia thailandensis E264
MEEAKHFIAGAWAPPAGGETIAVIDPSDGEPFARLARGTAPDVDAAVRAARAAFDGPWGAVSAAERGRALYRLSMLVAACREELALTESRDTGKPLTQARADADALARYFEFYAGAADKLHGQTLPYRDGYTVLTLREPHGVTGHIVPWNYPMQILGRSVGAALAAGNACVVKPSEDACLSVLRVATLAAEAGLPAGALNVVTGYGHEAGAALARHPGVDHISFTGSPDTGRLVAQMAAEHHAPVTLELGGKSPQIVFADADLDAALPVLVSAIVQNAGQTCSAGSRVLIDKAVYEPLVERLATAFNGLKVGPGQADLDCGPLISAKQQRRVWDFLSDAQHDGIAMAAHGEVVPDAPETGFYQAPALLRDVPHTHRLAQEEVFGPVLAAMKFADEDEALALANGTPYGLVAGIWTRDGARQMRLARKLRAGQVFVNNYGAGGGVELPFGGTGRSGYGREKGFEALYGFTVLKTIALRHG

SEQ ID NO: 31320 - protein, 193 aa, uncultured archaeon GZfos17F1
MRKATINRKTNETEIDLMFVIEGTGRSEIGTGVAFLDHILDSFARHGLFDLTIRATGDTELGDHHLVEDVGIVLGQAISKALGDHAGIARFADVRVPMDEASASVILDLSGRSYLVFDVGFSSDVVGDLTTQMVPHFFHSLITGAGINAHISASGRNDHHIIEAIFKAFGIALRRSATVERSDVPSTKGVLTG

SEQ ID NO: 31321 - protein, 297 aa, uncultured archaeon GZfos17F1
MADIIGIGALNVDKLYLVERIGAAGEEIGINSVSEQPGGSAANTIAALTRLGIKTGFIGRVGDDADGAYLRSELVKEGVDTRGIEVARGRTGSAIVLVDPGGERSMYVHPGVNDVLSLTPENISYAKNAKYLHLSSFVGETVIDVQREILDRSKAEISFAPGMLYARRGVDTLRKIISNARVVFLNRDEIEMLTGSGYSEGAGELNDIGAEIVVVTLGGDGCYIRTSDAEISIPGLAARVVDTTGAGDAFCAGFLYGLLIDKPLSVCGRLGNFVAAKCIEAVGAREGLPRKIEIVEG

SEQ ID NO: 31322 - protein, 181 aa, Zea mays
  misc_feature (153)..(153): Xaa can be any naturally occurring amino acid
MAGDGTDAAFEDEVEPTVTISEYMDGIEAEELEADLVLGGDDGNECTYGAGYLKRQAVFSCLTCVPDGVAGVCTACCLACHDGHEVVELWTKRNFRCDCGNSKFGGHLCKLSPEKDPENPANSYNQNFKGSYCTCRRPYPDPEAKEQVGMIQXCCICEDWFHEDHIGLDSLEKITRDEEGG

SEQ ID NO: 31323 - protein, 323 aa, Coccidioides immitis RS
MGSPIFRRYLNRHFIRTLKRSYSTAAHPENIPTPGGLPPLIRGTQDAPSSGALTNKPSLEDYCFYRDTLPPKPSQLEYADHFFAASKHSPVYLWGSSLFRTIPVSSIPEIAFIGRSNVGKSSIINGLVGEDICASSSKPGRTKLMASIGVGGTKGGGSKIALVDTPGYGKGSHTEWGQEIHKYLEKRKQLRRIFLLIDAGVGLKTRDHQVLNFLRRFAIPYQLVLTKLDHALSFNGHKNKTKPNDSRSDLIRFSQTVQDILSSAQPVNPILDGPGPLNDVIACSVQMQSKKQKKSVAGLSSLRWAILLATGFDQIPKGFKLKR

SEQ ID NO: 31324 - protein, 327 aa, Oryza sativa (japonica cultivar-group)
MGSKSSKDTDDDHEPKQQEKKLPEHLEVQRTRVVCKADAPVNTEGFQYAGAYSAMGIDNSVSAEKFCKNFKVEISRLTEDDMEFDMIGIDASIANAFRRILIAELPTMAIEKVLMVDNTSVIADEVLSHRLGLIPLDADPRHFEYMSENDVPNERNTIVYKLHVSCKKGSPRLTAQACIVFRRMLIDIFYRIKFSHSFLCTVKSGDLEWLPEGSRLPLASPAQSRYKQKTYTSFSQSQKDILEKPLGVKFKDITIARLGPGQVVFRKEIKGDNAEKLVKKCPVNVFDIEDLGNVTIESTGGLPPEALFTEAVRILEEKCERVISGLS

SEQ ID NO: 31325 - protein, 367 aa, Sulfolobus solfataricus P2
MFDPASFVEEIGPQLRQKLGNEKVLAAVSGGVDSTTAAVLAYNLLGDKVIPVLVDTGFLRKNEAEKIKDYLSNILPNLIIVDKKETFISEIEGIDDAEMKRKRFRELFYSTISSLMKKFNARYLMQGTIAADWVETQGGIKTQHNVLVQIGIDTEKEWGFTLIEPLADLYKNEVRELARYLKLPKEISERQPFPGPGLLVRAVGKLTREKLEVVREANDIVEKYLDPFNYSQYFAVSFESYGNLVNLDGIDAFLYKARATGVKGDVRAYGNIAKIECSNINNVKNIIDTLVKYDITHVLCTLDERNSGKYSVAIRAVTTEDFMTADYVRIPKEILSKISSEILQKIPNVKEVLYDVTSKPPATIEFE

SEQ ID NO: 31326 - protein, 324 aa, Yersinia pestis KIM
MMTTYALVGDVGGTNARLALCAVATGEILQAKTYSGLEYESLEDVIKQYLSEHQAKVTDACIAIACPITGDWVAMTNHTWAFSIAAMQQNLGLDHLEVINDFTAVSMAIPVLPAQDVLQFGGTQPQPGKPVAVYGAGTGLGVAHLVNVDRRWISLAGEGGHVDFAPNSEEEDQILAVLRQELGHVSAERVLSGPGLVNLYRAIVISDARLPEKLAPKDITARALADSCTDCRRALSLFCVIMGRFGGNLALNLSTFGGVYIAGGIVPRFMEFFKASGFRAAFEDKGRFKDFLQDIPVYMITHPQPGLLGAGAYLRQKLGYELSS

SEQ ID NO: 31327 - protein, 378 aa, Glycine max
MSRAMCNPSMVSRSVLGSQTSSKSVTETMSGSHEFVIKGYSLTKGMGIGKYIVSETFIVGGFQWAIYFFPDGRDPKDNAAYVSVFVALHSKSTNVRALFDLTLLDLCKKGEHKVHSHFSHSLTIGPYTLINHGSMWGYTRFFKRRHLETSNFLKDDCLKINCTIAVLVSSIDSSQLNTIQVPESDIGEHFGMLLEDEESFDVTFSVGGERFHAHKLVLAARSTMFETQFFNAMKKDDQEIVVIDMEPKVFKALLHFVYRDTLLEDEELFMLDSSFFPSFSESFIAKLLAAGEKYGLPRLMLMCESILCKDISVDSVAYIFALADHYCATHLKSICQKFSAENFDAVMHSDGFEYLKKNCPLLQSELLKTGVGCEKEFS

SEQ ID NO: 31328 - protein, 277 aa, Nostoc sp. PCC 7120
MFRLETPSMSFTNKTIVLTGASAGIGRMLAISLSQQDANLVLAARNQEALEQTMTACTNYPGKVIAVHTDVTQAEACQQLIERAIATFGQIDILINNAGIGMLTRFDEVTDISIFEQVMQANYLGAVYCTHYALPYLKASQGQLVAISSICGKTGVPTRTGYVASKHAMQGFFDTLRIELHSTGVDVLVVSPGFVATDIRQRALGADGKPLGKSPRDETQGNMSVDECVRQIIWAMERRKREHIMTLKGKVIPWAKLILPGFVDRIVAATIRKTTST

SEQ ID NO: 31329 - protein, 240 aa, Rhodococcus sp. RHA1
MSDEGRPHDQAPAQASKASRVTEQIGVRKGLFGVRGSGDTSGYGRLVRPVLLPGSTPRPFGGYFDDVADGLGAALAESGVGFEVAIESVVVFRGEVTFGVRREFLPLVARVLRDEPDLRFEMCLGVNGVHFPQDAGRELHAVYPLLSITHNRRIRLEVAAPDADPHIPSLYEVYPTNDWHERETYDFFGIVFDGHPSLTRIEMPDDWPGHPQRKDYPLGGIPVEYKGAEIAPPDERRGYN

SEQ ID NO: 31330 - protein, 438 aa, Rhodococcus sp. RHA1
MSEDTVFTVAGQDWDDVVDAVKASSGGGGSEGGEERIVVNMGPQHPSTHGVLRLILEIEGETVTEARCGIGYLHTGIEKNLEYRTWTQGVTFVTRMDYLSPFFNETAYCLGVEKLLDITDEVPERASVIRVMLMELNRISSHLVALATGGMELGAVTAMLFGFRERELVLDVFEMITGLRMNHAYIRPGGLSQDLPEGAVEKVRELLALMPERLRDMENLLNDNRIWKGRTQGIGYLDLTGCMALGITGPMLRATGLPHDLRKSQPYCGYENYEFDVSTDTGCDAYGRYLIRVDEMKESLKIVEQCLDKLRPGPIMAEDKKIAWPADLTLGPDGLGNSPGHVREIMDSSMESLIHHFKLVTEGFRVPPGQVYVAVESPRGELGVHMVSDGGTRPFRVHFRDPSFTNLQSVAATCEGGMVADVIAAVASIDPVMGGVDR

SEQ ID NO: 31331 - protein, 345 aa, Sulfolobus solfataricus P2
MVEGFSPMKSVIMENGKAVIKELPLPKLQQGDVLVKMKACGLCGTDIEKICGQYTASQPILGHEPTGIIQESTVDWLKPGDRVFAHHHVPCYECYYCKKGSPTMCPYYRKTNLDPGGFSEYFRVPAWNVARGGVLKLPDNVSFEEGAFIEPLATVIRAQKRVAIDNGDTVFIVGIGPMGLLHAMMAKVNKAGVIIASDVSDFRTEFGYKVGINYSLNAKKVNVVDEVKRLTDGRGADVTIIASGSPSAIVSGLNATRKGGRVLLFGVPYKGTILNYDISDLLNNEISIIPSNAAVEEDTKEALAIIANKKIDVTKLITHRFSLDEFNEAVRIGKEGNAIKVIIYS

SEQ ID NO: 31332 - protein, 422 aa, Legionella pneumophila subsp. pneumophila str. Philadelphia 1
MHIHKIQAREILDSRGNPTIEADVTLTTGIIGRASVPSGASTGSREACELRDNDPKRYAGKGVQKAVKHVNNEINQALQGLSVEDQENLDRILCQLDNTENKSHLGANAILATSLACARARALSLNQPLYMTLNQGDMMTMPVPMMNILNGGAHADNNVDIQEFMIMPIGAPDFPVALQMGTEIFHVLKSVLKKQGLNTAVGDEGGFAPNIQSNRQALDLLSEAIEKAGFRLGEDIVFALDVAASELFNEGFYHMYSENQKFDSHQLIEYYANLISSYPIVSIEDGLDEKDWSGWKQLTTHLGNKVQLVGDDLFVTNPKILREGIAQGIANAILIKVNQIGTLSETRQAIKLAYDNGYRCVMSHRSGETEDTFIADLAVASGCGQIKTGSLCRTDRTAKYNQLLRINELASLPYAGKNILKR

SEQ ID NO: 31333 - protein, 199 aa, Gibberella zeae PH-1
MIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKSFASENHLSFIETSALDASNVELAFQNILTEIYRIVSSKALDSGDSAQATIGAGTNISLSKPADDDAAKGGKCC

SEQ ID NO: 31334 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDRLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEEGTDFDKVAKGAYVVYENAADFDTILIATGSEVNLAVSAAKELASQGENIRVVSMPSTDVFDKQDAAYKEEILPNAVRRRVAVEMGASQNWYKYVGLDGAVLGIDTFGASA

SEQ ID NO: 31335 - protein, 568 aa, Xylella fastidiosa Dixon
MSSSSIEDIKGKSHRLRGSLLESLANPTTGALRESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLISRAHADLYTDAAHLSEHLLPNTRAYYEIWLDEKKVAGAGEEEEPIYGPHYLPRKFKIGFAAPPINDVDVFANDLGFIAVIVDKTLLGYNVTIGGGMGTTHGDPDTWPRIGNIIGFITRADLITISTAIVTTQRDFGNRTLRKRARFKYTIDDRGLDCIVGEIQQRAGITLQPARPFVFEHNGDRYGWIEGEDGHWHLTLLLPAGRIADTEGSTLLSGFREIAQLGIGEFRMTPNQNVVIAGISPGQRAAIDALVTQYGLDTGNRAPTALARHAMACVALPTCGLAMAEAERYLPDFNAKLQPILEKYGLAETPILLRISGCPNGCSRPYLAEIALVGKAPGRYNLMLGGDQRGQRLNTLYRENITETEILAALEPLLGRYQQKRLPSEGFGDFLHRTGIIALPPYPTHRHVISSTLQA

SEQ ID NO: 31336 - protein, 374 aa, uncultured archaeon GZfos17F1
MDEKTIGSTLYDLKSKDTPYERVLSSMCTYPHPVAVAAHQQFIETNLGDPGLFAGTAEIEHEVVRMMGTLFGNPDAHGYVTTGGTESNIQAIHAIKTARKVRDPNIIVPASAHFSFDKVADILGIDVLKADLDPEFRADISSVEDLINETTIGIVGIAGTTEFGQIDPIKELSDLALSKNIFLHVDAAFGGFVIPFLTEKYEFDFTLPGVTSIGADPHKMGFATIPSGGLLFQDSSYLNRLSVDTPYLTVNSQQTLSGTRSGASAASAYAVFKHLGRTGYERIVQRCMELTYELVARASESGIEPLIDPVTNVLVLDVPDADSVRSALKKRGWDVSITRDPRALRLVIMPHISSENLNLFADDLADVVKWMSAN

SEQ ID NO: 31337 - protein, 121 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEML

SEQ ID NO: 31338 - protein, 283 aa, Methanothermobacter thermautotrophicus str. Delta H
MITGKTHVTGIMGHPLGHSLSPIMHNAAFRSLGMDWIYVPFPVKPENLKAAVEGLRALGVEGVNVTIPHKEAVLEYIDDIHGTAALIGAVNTLKFDDGTVRGYNTDASGCLRALEEVTSVEGSSVLILGAGGAARACAFQLAEKGASDITILNRTPEKARLLAEDMADKLGFEASYGGYELIQGSVKSADILIDTTPVGMHPHTDDRPLVGAELMHEGLVVHDLVYNPQRTVLLREAERASAIPVSGIRMLLYQGVEAFRIWTGRDPPLDVMEDALKRVLNRD

SEQ ID NO: 31339 - protein, 449 aa, Prosthecochloris aestuarii DSM 271
MQKKTSINAREIALLTLVECEREEVKSEQALHRYLNKYKTARNDSALATELVNGILRFRQSIDSIITAFYHHKLKKASPFLVNILRIGVYQLRYLDRIPDWAAVSQCVDLARKYKGQHIARIVNGVLRSVAANPQKTVSSLEMQNPLQQLAAATSHPEWMLERWMARYGEDRTRRVTSYNNTPPLFGLRINTLKTNKEAMLKAFADASVEFIETGLPSFLLTKDFHRTEPFITLGLLTVQNPVQALPCLLLDPEEGETVLDMCAAPGGKSTFLAELMHNSGKVIAVDRYPNKCRTIRERASQMAISVITTIDSDARNVPAGISPAKILLDAPCSGTGVLARRPELRWKMNREKITQLVALQESLLNHAATLLPAGGVLVYSTCSIEEEENMLQIDRFLQKHPEFIAESHPRGLPGPCHELSGHPGAYLTLPGDHEGFDGGFAQRLRKQA

SEQ ID NO: 31340 - protein, 538 aa, uncultured archaeon GZfos17G11
MPVIKLYNADLENLTGVSIERIKERLPLLCADVERIESDSLDVEFFPNRPDLFSVEGVARTMKQFLDIKPGLATYNVDKSGIEMVVETSVLEVRPYIVCGVVRDLHFDSSTIESLMLLQEHLHRGIGRNRAKVSVGVHDLGKVKPPFRYLAVDPGFSFVPLDYEEEMSMAEILERHPKGVAYKYILEDKTNYPLILDSRGGVISFPPIINAERTRVTESTTDIFLDVTGLDDNVSVALNIIACALAERGGQLQSVVLRYPDAEMETPSLAPKTMETSVADVNSLTGLELSAEDCKKCCERMGLSAKLKLDGRLDVIIPAYRSDILHPWDIIEDIAIGYGYDRIKPDIPGTMVIGAVHPIEDKKRQVREIMTGFGYFEVLTFTLTSERKQFELMLRKRHEEEEVQVASPISTEHTMLRSTIMPNLLEILALNQHRDLPQRIFEVGPVLLNIKEKYRLAAVSTHANANFAEVRSVVDSVLKEMCMDEVELSESEDGAFLAGRRADIKVDGKRIGVFGELHPAVILNFGLDHPVVGFEVGV

SEQ ID NO: 31341 - protein, 384 aa, Oryza sativa (indica cultivar-group)
MEKALVLIVGAGPSGLATAVCLGQLSIPYVIIEREDCTASLWRKHTYDRLKLHLAKEFCEMPHMPYPEDTPTYIPKIQFLRYMDDYVEHFNICPKFNSSVESCLYDDVQKYWVVTTHDQVNGMVSKYAARFLVVASGENSAGNIPSIPGLEDFSGHVIHSSSFRSADSYAAQRVLVVGCGNSGMEIAYDLSSHGANTSIVIRSPLHVMTKELIHMGMKLASWSLPVKFVDFILVVLAYLWFGNLSKYGIVRPNMGPLLLKAKTGRSAVIDVGTVELIKKGDIKVFGPISCIKGNVVEFDDGKESYFDAIVFATGYTSTANNWLKNGEDMMNKEGMPKKDFPNHWKGSNGLYCVGFARRGLSGIAHDAKNVANDIKALLDSMAPF

SEQ ID NO: 31342 - protein, 240 aa, Triticum aestivum
MTVVDAETRFHVLAVDDSVIDRKLIEMLLRTSSYQVTTVDSGSKALEVLGLRDEGDDSSSSSSPPSSSAPDHHQEVGVNLIITDYCMPGMTGYDLLRRVKGSSSLKDIPVVIMSSENVPARISRCLEDGAEEFFLKPVKLADMKKLKSHLVRRKQPQLQPQTHEKPQPQPQQQQQKPQPEQQLKAEQAPAEPAAEEEAVTAGGITGDCGGGSRKRKAAMMEQDGASTSLSSGSSGLAVET

SEQ ID NO: 31343 - protein, 429 aa, Salinibacter ruber DSM 13855
MASIQRVTARQILDSRGTPTVEVDVTTGEGVLGRAAVPSGASTGAYEAVELRDGDADRYHGQGVLRAVGHVNDAVADALHGMSVLEQVAIDDTLRALDGTEDKSNLGANAILGASLAAAKAGAATLGVPLYRHLGRATARTLPVPLMNILNGGEHADNNVDMQEFMIAPAGADSFSEALRTGAEVFHTLASVLQDRDYSTAVGDEGGFAPDLGSNEEAVELILDAIEKAGYTAGSDVFVALDPAAAEMVEDEAYVFWKSDPDTERSSEDMVEYWAEWVDRYPILSIEDAMDEDDWDGWAMLTDAIGDEVQLVGDDLFVTNTKRLTRGVEEGCGNSILIKPNQIGTLTETLNAIETAHTHGFTAIISHRSGETEDTTIADLAVATGTGQIKTGSASRSDRVAKYNQLLRIEEQLGATAHYPRLDAFPLTN

SEQ ID NO: 31344 - protein, 1058 aa, Rhizomucor miehei
MPSSTRILGTSSAFRSYSALVGKGIHHAARLSTRNPIEMFVGVIILASFSYVCLYNLARTSDIFSGTNMRLYPATVYAPSNGLEFSPVDSSFVDKTAQKIHLRQITVTAEELQDHLSSVERFQKYLENDVYVPDGTRQFSYSKGLCYSTNENCFSASTDKDTSILTLSFAFDASNAMRRDLANQWENKVAKLPPGELVSQAQQGYGDNLLVWFFIITRNVVFRLKELIEMADNVDIIVILAGYIMMIATFVSLYINMRRMGSRYTLATAVTVNGLFSFMLALLTVHALGVEPSPVVLAEAIPFLVVTVGFERPYKLTKRVFEYSKEAPITRQDVRETIMRAVDAVALPIARDCVIEIMVLGLGAKSAIVGLREFCVLSAFLLAYDVVFLFTWYTAVLALKLELRRIREISGSSKASSQGGAPQPSGVSFIRKTVVKALSDDNAAGTTTTPQDMQKSDGFFIGHVKLLMIVAFVSMHIFEFCTAFQSGPQVDVSQPAVSSVLSQLLQEHRASPHAAKPLLVEVFPPLLFRVPSTNNGVLPESISKTLDALSEVYEVYVQHPVISKWITIGLCVSLFLNTYLFNVAKQPKQISEKPEAETVVAPPKPKVVAPPPPPAPTGTIRSVDECLALIKTPEALNDEEIIQLVNAGKIASYALEKMLGDMQRAVSIRRALISRASVTRTLETSLLPLKDYHYEKVFGACCENVIGYMPLPLGVAGPLNIDGIPTHIPMATTEGCLVASTARGCKAINAGGGATTIVTADGMTRGPCVEFPNITRAGECKRWIENEGYEVIADAFNATSRFARLRKLKVTLAGKLVFIRFSTTTGDDMGMNMISKGCEAALSVLAEEFPDMQIISLSGNYCTDKKPAVINWIEGRGKSVVAEAIIPGPIVEKVLKTTVSALVELNTSKNLIGSAMAGALGGFNAHAANILTAIYLAAGQDPAQNVESSNCITLMKAVNDGKDLHISCTMPSHRKIGTVGGGTILPPQQAILDMLGVRGPHPTNPGDNARRLARIICAAVMAGELSLCAALAAGHLVKAHMAHNRATQAPAPGSCIKS

SEQ ID NO: 31345 - protein, 188 aa, Rhodococcus sp. RHA1
MTKFLGPIAGFGVTFSTMFKKSNTEFYPEEKVPTAPRYHGRHQLNRYADGLEKCIGCELCAWACPADAIYVEGADNTDEERFSPGERYGQVYQINYLRCIGCGLCIEACPTRALTMTNEYEMADDNRAGLIYEKDRLLAPLEPGMVESPHPMAPGATAEDYYRGTVTGGAAAAAQDESEVDDTAGDRP

SEQ ID NO: 31346 - protein, 295 aa, Pseudomonas fluorescens Pf-5
MPTTQIHGIIGYTVTPFGPNGEGLDLDALGRSIDRMIDAGVHAIAPLGSTGEGAYLSDAEWDQVSEFSIRHVAKRVPTIVSVSDLTTAKAIRRARFAEAKGADVVMVLPASYWKLSEAEILAHYQAIGASIGVPIMLYNNPATSGTDMSVELILKIFHAVENVTLVKESTGDIQRMHKLQLLGEGQVPFYNGCNPLALEAFAAGASGWCTAAANLIPQLNLDLYQAVLSNDLARARALFYRQLPLLDFILKGGLPATVKAGLELAGLPTGEPRKPVFALNESGRQQLQTLLQSLG

SEQ ID NO: 31347 - protein, 178 aa, Solanum lycopersicum
METSARSVDPLVVGKVIGDVLDMFVPVVDFTVEYASKQISNNGVEIKPAEAAQKPRVHIKGSLHSNNLYTLVMADPDAPSPSEPTFREWLHWIVTDIPEGGDASQGREMVEYMGPKPPAGIHRYVFTLFRQKEAEQVPHKPPQGRSNFKTRQFASDNGLDLPVAALYFNSQKEHAAHH

SEQ ID NO: 31348 - protein, 322 aa, Schizosaccharomyces pombe 972h-
MSSLEQLKATGTVVVSDTGDFESIAKYKPQDATTNPSLILAASKKPQYAALVDAAVDYAKAKGGSINSQIEIAFDRLLIEFGTKILAIVPGRVSTEVDARYSFDTQTTIEKARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKKFGYKTIVMGASFRNVGEIKELAGVDFLTISPALLEQLNNSTDAVPKKLDASKASSLNLEKVSYLTDEPKFRFDFNNDEMAVVKLSTGIAAFAKDADTLRTILKAKLEA

SEQ ID NO: 31349 - protein, 116 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLV

SEQ ID NO: 31350 - protein, 487 aa, Oryza sativa (japonica cultivar-group)
MAAHGRAAAHGDERDAEAASCHGGRAGEGNGGVRWRPWSRRWRCSGVGRATATEVEGGGGRGRTVRRRDVAGHGARRDGEEFPWRQGSAAWGGNEARKGGSTGGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGILICQDVLFCTQTALTTGASISLSAFFDEINDFCGRQIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 31351 - protein, 549 aa, Hordeum vulgare subsp. vulgare
MAAAATRRAASSLVSRCLLSRPAASPAAVPSALRRADGARGLLPGLLQRFGTAAAAEEPISPSVQVGETQLLINGKFVDAASGKTFPTLDPRTGEVIARVSEGDAEDVDRAVVAARKAFDEGPWPKMTAYERSRILLRFADLIEKHNDEIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIISGFGPTAGAALAGHMDVDKIAFTGSTDTGKVILELSARSNLKAVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDDMKIAQEEIFGPVQSIFKFNDLNEVIKRANASQYGLAAGVFTNNLDTANTLTRALRAGTIWVNCFDIFDAAIPFGGYKMSGIGREKGIDSLKNYLQVKAVVTALKNPAWL

SEQ ID NO: 31352 - protein, 510 aa, Saccharomyces cerevisiae
MPTSGTTIELIDDQFPKDDSASSGIVDEVDLTEANILATGLNKKAPRIVNGFGSLMGSKEMVSVEFGKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSLAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 31353 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVAAAKELASKGEKVRVVSMPSTDVFDKQDAAYKEEILPNAVRRRVAVEMGASQNWYKYVGLDGAVLGIDTFGASA

SEQ ID NO: 31354 - protein, 390 aa, Anabaena variabilis ATCC 29413
MQFAKRLEKIPPYLFAEINRKREALIAQGVDIINIGVGDPDKPTPAHILQAMREAIDEASNHNYPPYEGTQEFREAAVKWMERRFGVVDLNPNTEVVSSIGSKEAIHNTFLAFVEAGDYTLIPDPGYPVYRTSTIFAGGEPFTMPLKAENKFLPDLDLIPEEVARKAKMLWVNYPNNPTGALATLEFFEELVAFCQQHSILLCHDHAYSEMAYDGYKPPSVLQIPGAKDIAIEFHSLSKSYNMTGWRIGFAVGNAYAIQGLSQVKTNVDSGVFKAIQKAAIAAYNTDEVELQAVMSVYQNRRDIIVKGLQSLGWPIEPPKATLYVWVPVPPGYTSTEFTTLLLDKCGIVVPPGVGYGVSGEGYFRIALTICEERLHEAIQRMQDAGIRYS

SEQ ID NO: 31355 - protein, 1081 aa, Geobacter metallireducens GS-15
MPKRTDIKKILIIGAGPIVIGQACEFDYSGTQACKALKEEGFEVVLLNSNPATIMTDPDFADRTYVEPVTPDVLAKIIEKERPDAVLPTLGGQTALNTAVAVAENGTLEKFGVELIGAKLPAIKKAEDRTLFKEAMEKIGLSVPRSGLAHNYTEAMEVIKTVGFPAIIRPSFTLGGTGGGIAYNMEEYEKMAMGGIDASPTDEILVEESVIGWKEYELEVMRDTADNVVIICSIENFDPMGVHTGDSITVAPAQTLTDKEYQILRDAALKIIREIGVDTGGSNIQFGINPRNGRLVVIEMNPRVSRSSALASKATGFPIAKIAAKLAVGYTLDEIRNDITRETPACFEPTIDYVVTKIPRFTFEKFPAADSTLTTQMKSVGEVMAIGRTFKESFQKALRSLEIGSAGFESRLFTNGDTRRALSAKEQQLVQDKLRVPNWERLWYLGDAFRCGMSIDEIFQFTAIDPWFLHNIKQIIEKEEDLRTVDLAAETRENLAAIVREAKQYGFSDKMLGRFWGKNDEEIRQLRLSLGVKPVFKRVDTCAAEFVAYTPYLYSTYEEECEAEVTDRKKIMILGGGPNRIGQGIEFDYCCVHGVFALGEDGYETIMVNCNPETVSTDYDTSDRLYFEPLTYEDVLSIVDLEKPQGVIVQFGGQTPLKLSVALEKAGVPIIGTSPDAIDRAEDRERFQEMLHKLNLLQPENGTARSFEEAEEVANRIGYPVVVRPSYVLGGRAMEIVYDVENLRRYMTTAVQASPEHPILIDKFLDKAIEIDVDALCDGTEVVIGGIMEHIEEAGIHSGDSACCLPPHSISPELVEEIRRQTTVMALELNVKGLMNVQYAIKDGTIYILEVNPRASRTAPFVSKATGRPLAKIAARIMAGKSLKELGVAGDIVPKHMSVKEAVFPFVKFPGVDTILGPEMKSTGEVMGIGSDFATAFAKAQLGANVKLPRSGKVFISLHDADKKHIVDSAKKLYNAGFRLVATRGTAAYLKEKGVEVEVINKVLEGRPHIVDAIKSGQVCMVLNTTQGAQAVADSFSIRRESLMHNVAYFTTVAGANAAAEGIIAMINGELDVKPLQEYLA

SEQ ID NO: 31356 - protein, 118 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEY

SEQ ID NO: 31357 - protein, 119 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYE

SEQ ID NO: 31358 - protein, 269 aa, Neisseria cinerea
MTTISRYTVFGNPVAHSKSPQIHQQFALQEGVDIEYGRICADIGGFAQAVSIFFETGGCGANVTVPFKQEAFALADEYSERASAAGAVNTLILLENGKLRGDNTDGIGLSNDITQVKNIAIECKTILLLGAGGAVRGVIPVLKEHRPARIVIANRTHAKAEELARLFGIEAVPMADLNGGFDIIINGTSGSLSGQLPAVSPEIFRNCRLAYDMVYGDAAQAFLNFAQSNGAAEVSDGLGMLVGQAAASYSLWRGFTPDIRPVIEYMKAL

SEQ ID NO: 31359 - protein, 269 aa, Neisseria flavescens
MTTLPRYAVFGNPVAHSKSPQIHRQFALQEGVDIEYERICADIGGFAQAVSTFFETGGCGANVTVPFKQEAFDLADEHSERALAAGAVNTLILLKNGKLRGDNTDGIGLANDITQVKNIAIEDKTILLLGAGGAVRGVIPVLKEHRPARIVITNRTHAKAEELARLFGIEAVPMADLNGGFDIIINGTSGGLSGQLPAVSPEIFRDCRLAYDMVYGEAALAFLNFAQSNGAAEVSDGLGMLVGQAAASYHIWRGFTPDIRPVIEYMKAL

SEQ ID NO: 31360 - protein, 269 aa, Neisseria gonorrhoeae
MHALPRYAVFGNPAAHSKSPQIHQQFALQEGVDIEYGRICADIGGFAQAVSTFFETGGCGANVTVPFKQEAFHLADEHSDRALAAGAVNTLVWLEDGRIRGDNTDGIGLANDITQVKNIAIEGKTILLLGAGGAVRGVIPVLKEHRPARIVIANRTRAKAEELARLFGIEAVPMADVNGGFDIIINGTSGGLSGQLPAVSPKIFRDCRLAYDMVYREAAKPFLDFARQSGAKKTADGLGMLVGQAAASYALWRGFKPDIRPVIEHMKAL

SEQ ID NO: 31361 - protein, 269 aa, Neisseria lactamica
MTALPRYAVFGNPVAHSKSPQIHRQFALQEGVEIEYGRICADIGSFAQAVSTFFGTGGCGANVTVPFKQEAFDLADEHSERASAAGAVNTLILLENGKLRGDNTDGLGLVGDIVKVQNTEVEGKNILLLGAGGAVRGVIPVLLAQNPARIVIANRTRAKAEEVAARFGIEAVPMADLNGGFDIIINGTSGGLNGQIPDIPPDIFQNCALAYDMVYGEAAKPFLDFARQSGAKQTADGLGMLVGQAAASYALWRGFKPDIRPVIEYMKAL

SEQ ID NO: 31362 - protein, 503 aa, Panax ginseng
MAIRIPTRQLFIDGEWREPAKKNRIAIINPATEQIIGNIPAATSEDVDIAVEAARRALARNGGSDWASASGAYRAKYLRAIAAKITERKSELAKLETLDCGKPLEEAAWDIDDVAACFEYNADLAEALDGKQKSPISLPMETFKSYILKEPIGVVGLITPWNYPMLMATWKVAPALAAGCAAILKPSELASVTCLELGEVCKEVGLPPGILNILTGLGPEAGAPLASHPHVDKIAFTGSTATGSKIMTAAAQQVKPVTLELGGKSPILVFEDVDLDKAAEWTIFGCFWTNGQICSATSRLLVHESIAAEFLDKLMKWTKNIKISDPLEEGCRLGPVVSGGQYEKVMESISTAKKEGATILCGGARPKHLEKGFFIEPTIISDVTTSMQIWREEVFGPVLCVKTFRTEDEAIELANDTRYGLGGAVISNDLERCERVTKALQSGIVWINCSQPCFCQAPWGGKKRSGFGRELGEWGLDNYLSVKQVTQYVSDEPWGWYQSPSKL

SEQ ID NO: 31363 - protein, 269 aa, Neisseria mucosa
MNTVPRYAVFGNPVAHSKSPQIHRQFALQEGVEIEYERICADTGGFAQAVEAFFADGGRGANVTVPFKQEAFALSDEHSERALAAGAVNTLILLENGKIRGDNTDGIGLTDDISKRLGVELSGKTVLLLGAGGAVRGVIPVLKEYRPARIVIANRTHTKAAEMAAHFGIEAIPLDELEGGFDIIINGTSGGLSGQLPAVSPKVFEHCTLAYDMVYGEAAEPFLAFARQSGAKQTADGLGMLVGQAAASYRLWRGFAPDVLPVVQYMREL

SEQ ID NO: 31364 - protein, 372 aa, Arabidopsis thaliana
MGNPVDNKFTWVIKNFCSVSPKPIYSDQFLIGGNKWHILAYSKKRDGHQFLCLDLELVDCEFLPSEWRKVVKVSFTVVNFFSKKLSRQIGLKHCFNKKERSKGGSLFHLSELTDKKSGFLVDGEVEIVAQITVLETDRRFHVSKDYNMEMQCWDGMATTLVENKELNDDDKAGLVNVKGFQVLPSQLGIVNRIFEKHPETALECCTKNQELRASYINVIFSLIKLLYKGAQEHSTHDLSDAEGALAYMKNLGFKLDWLEKKLDEVKEIKKKCERVTEMEKELHDLMNKHTNSLFVNKKEPSALLQHARRIDNTSKTILSEILTSESNTTLVTRLVNDELKIIVEVDVLQVIGKLDVPLKKIMQNDDGSVSRD

SEQ ID NO: 31365 - protein, 148 aa, Brassica napus
MAFRIASQLRSTGKKIGGSRRFATTVADGTKETYNKFSVTGEFAPVAIIGGFVALAVAMAGHSLKQQLMHAPGVSTRKNRRAAVAEVDDPDNCVSSADKYINKSWLRKVGQIQDKSSAILSDPTRPNPFTTPRNAETLKSVGVAPKGI

SEQ ID NO: 31366 - protein, 177 aa, Solanum lycopersicum
MPRERDPLVVGRVVGDVLDPFTRTIGLRVIYRDREVNNGCELRPSQVINQPRVEVGGDDLRTFFTLVMVDPDAPSPSDPNLREYLHWLVTDIPATTGSSFGQEIVSYESPRPSMGIHRFVFVLFRQLGRQTVYAPGWRQNFNTRDFAELYNLGLPVAAVYFNCQRESGSGGRRRSAD

SEQ ID NO: 31367 - protein, 175 aa, Solanum lycopersicum
MPRDPLIVSGVVGDVVDPFTRCVDFGVVYNNRVVYNGCSLRPSQVVNQPRVDIDGDDLRTFYTLIMVDPDAPNPSNPNLREYLHWLVTDIPAATGATFGNEVVGYESPRPSMGIHRYIFVLYRQLGCDAIDAPDIIDSRQNFNTRDFARFHNLGLPVAAVYFNCNREGGTGGRRL

SEQ ID NO: 31368 - protein, 140 aa, Solanum lycopersicum
MPRVDPLIVGRVIGEVLDPFTRSVDLRVVYNNREVNNACVLKPSQVVMQPKVYIGGDDLRTFYTLIMVDPDAPSPSNPNLREYLHWLVTDIPATTDTRFGNEIVCYENPTPTMGIHRFVLVLFRQLGRETVYPPGWRQNF

SEQ ID NO: 31369 - protein, 478 aa, Arabidopsis thaliana
NISAATITPLTASPPYNAGIVRLAVGWTIIGPFRFQGPDKFFRTRAEKYKSTVFRTNIPPTFPFFGNVNPNIVAVLDVKSFSHLFDMDLVDKRDVLIGDFRPSLGFYGGVRVGVYLDTTEPKHAKVRTYVALLLLRFAMETLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFGLTRDEAIQNLLFVLGFNAYGGFSVFLPSLIGRITGDNSGLQERIRTEVRRVCGSGSDLNFKTVNEMELVKSVVYETLRFSPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRYDTITGDSGSIKAVVKAK

SEQ ID NO: 31370 - protein, 372 aa, Arabidopsis thaliana
MSFFRSKTSKTETQQPSSYGQQQDAMYSSYGTVSDEVLLQIHGCRAHLINGSEAVELAAGDFELVQVLDSNVALAMVVRIGNDLQWPVIKDEPVVKLDSRDYLFTLPVKDGEPLSYGITFFPIDENDIVFVNSIELLDDFLRENSCFSSSPSSSSSSSSSSSSSVNNGIDWKEFAPKIEDYNNVVAKAIAGGTGHIIRGMFKCSNAYTNQVHKGGEIMITKAEKKNGASSKRNATTNKNQINKNLQRVRKLSRATEKLSKTMLNGVGVVSGSVMGPVVKSKPGKAFFSMVPGEVLLASLDALSKETNSFCYVQSSTRMVSERLGESAGEATKDVLGTVGHAAGTAWNVFNIRKAFSPSSSVTSGILKNASRK

SEQ ID NO: 31371 - protein, 302 aa, Pseudomonas fluorescens Pf-5
MSTQPVSNQYAMQDPLTQYPQPEFPDQPQTAPGIDQDMIPRPDHGEHSYHGFGRLLGRKALITGGDSGIGRAAAIAYAREGADVAINYLPEEERDARQVIELIKAAGRKAVALPGDISDERFCRDLVRRAHEQLGGLDILVNVAGKQVAQEDIADISTAQFDATLKTNVYALFWICQAALPLMPAGATVINTASIQSYQPSASLLDYATTKAAIVAFTKALAKQVIGRGIRVNAVAPGPIWTVLQPSGGQPREKIPQFGLQTPMKRPGQPAECAPLYVLLASQESSYITGEVFGVTGGNPLP

SEQ ID NO: 31372 - protein, 635 aa, Rhodococcus sp. RHA1
MTITSFRNVAIVAHVDHGKTTLVDAMLRQSGAFEERAELVDRVMDSGDLEREKGITILAKNTAVHKHHADGSVTVINVIDTPGHADFGGEVERGLSMVDGVVLLVDASEGPLPQTRFVLRKALAASLPVILVVNKTDRPDARIEEVVSESHDLLLDLASDLDDEAAEAAELALDLPVLYASGREGKASKVQPENGHAPDAENLDALFEVLLNYVPAPKGNVDAPLQAHVTNLDASAFLGRLALVRIHNGELTKGQTVSWCREVDGEPVVTKAKITELLATKGVERQPAEKAVAGDIVAVAGFPDIMIGDTLADLENPVPLPRITVDQPAISVTIGTNTSPLVGRVSGHKLTARMVKSRLDQELVGNVSLKVLDIGRPDAWEVQGRGELALAILVEQMRREGFELTVGKPQVVTRQVDGKVHEPFEELTIDSPEEYLGAITQLLANRKGKMVQMANHGAGWVRMEFIVPSRGLIGFRTDFLTETRGTGIANAVFHGYAPWAGEIRARHTGSLVSDRTGSVTPFAMIQLADRGTFFVEPGADTYEGMVVGINPRQEDLDINVTREKKLTNMRQSSADVMETLAKPIKLELEGAMEFCAGDECVEVTPEVVRVRKVHLSATDRARERSRSKARDKAAL

SEQ ID NO: 31373 - protein, 120 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEM

SEQ ID NO: 31374 - protein, 411 aa, Nostoc sp. PCC 7120
MGLGINLFGHNPPFIQTAISEQLQQGMHIGVQNTLAGEVAQLISELTGAERVTFSNTGTEAVMTAVRIARAATKRPKIAIFTNSYHGHFDSVLVRATMTEYAKKAARRIIAAKSGSFIGRLAQPIQALFTANLNPKAVPAAPGIPNSAAADVLILEYGNEHSLKLIRKHRRELAAVLVEPVQSRCPELQPREFLQQLRQITQELGIVLIFDEMVTGFRIHPGGAQAHFGVKADIATYSKIVGGGLPLSVIAGKASYMNYIDGGQWQFGDDSTPQVPTTFFAGTFCKHPLALAAARATLQHLKISGIELHNELNQRTTQLVNDLNTHMTQQGIAIKFTSFGSFFAVAASQSAVPPMAINLLSYHLITKGIHLRQGDKGGFLSTAHTEEDINLIKKAFIDSINELRNEGFINN

SEQ ID NO: 31375 - protein, 215 aa, Schizosaccharomyces pombe 972h-
MTSAIEEEREILESIYPEEFKCINDSTFEITQPIDREESNCDNPPSLIFTCQLSEAYPDEVPDVKITFSEPHPWLGEEEIERLKQVVAQNAEECLGMAMIFSLCSVAKEETNAILIEQSQRETQAIEERHRKEAEQENKKFHGTPVTVESFTEWKKGFDAWRNEQLKLEQESKLKEALSAASSSNARKAILEKRMTGRELFENNLVKLDDVEGEA

SEQ ID NO: 31376 - protein, 131 aa, Zea mays
LISGGRGRDLMPRKTNSDAPFSASRSPPLCSYLGGGAMFRSDLSEDQRGQGLGHFSPPPCPVFFSMGGEYGPEYVDKRAFVARLFRALGGAEKIEIEWGNPALSPRGQEAVVALVDFFKRGGPQGGGAPRG

SEQ ID NO: 31377 - protein, 502 aa, Sinorhizobium meliloti 1021
MLHQKIVENPYKQKYGNFIGGEWREPVAGRYFDNTTPITGGTLCEVARSDAADIEIALDAAHAAREKWGRTSTTERSNILMKIAARMEDNLELLARAETWDNGKPIRETMAADIPLAIDHFRYFAACIRAQEGSIGEIDHDTVAYHFHEPLGVVGQIIPWNFPILMAAWKLAPALAAGNCVVLKPAEQTPGSILVWAELIGDLLPPGVLNIVNGFGLEAGKPLATSPRIAKIAFTGETTTGRLIMQYASQNLIPVTLELGGKSPNIFFADVASEDDDFFDKALEGFAMFALNQGEVCTCPSRALVQESIYDRFMERAVKRVEAIRQGNPLDEATMIGAQASSEQLEKILAYIEIGKEEGAEVLTGGGRNVLEGDLSGGYYVKPTVFHGHNRMRIFQEEIFGPVVSVTTFKTEAEALEIANDTLYGLGAGVWSRDANRCYRFGRAIEAGRVWTNCYHAYPAHAAFGGYKQSGIGRETHKMMLDHYQQTKNMLVSYSPKALGFF

SEQ ID NO: 31378 - protein, 207 aa, Ralstonia metallidurans CH34
MTRTKKNPPLRVGVGGPVGSGKTTLLEMLCKAMRDRYDLVAITNDIYTKEDQRLLTISGALPAERIMGVETGGCPHTAIREDASINLEAVDRMLAKFPDADVVFIESGGDNLAATFSPELSDLTIYVIDVAGGEKIPRKGGPGITKSDLLVINKTDLAPYVGASLEIMESDARKMRGERPFVMGSVKSGQGLDQVIAFIERQGMLDV

SEQ ID NO: 31379 - protein, 269 aa, Neisseria polysaccharea
MTALPRYAVFGNPVAHSKSPQIHQQFTLQEGVDIEYGRICADIDGFAQAVSTFFETGGCGANVTVPFKQEAFALADEHSDRALAAGAVNTLILLKNGKLRGDNTDGIGLVNDITQVKNIAIEGKTILLLGAGGAVRGVIPVLKEHRPARIVIANRTHAKAEELARLFGIEAVPMADLNGGFDIIINGTSGGLSGQLPAVNPEIFRSCRLAYDMVYGDAAQTFLNFAQSNGAAEVSDGLGMLVGQAAASYHIWRGFTPDIRPVIEYMKAL

SEQ ID NO: 31380 - protein, 269 aa, Neisseria pharyngis
MNTIPRYAVFGNPVAHSKSPQIHRQFALQEGVEIEYERICADIGGFAQAVEAFFANGGRGANVTVPFKQEAFALSDEHSERALAAGAVNTLILLENGKIRGDNTDGLGLTDDIAKRLGVEISDKTVLLLGAGGAVRGVIPVLKEYHPARIVIANRTHAKAAEMAVHFDIDAVPLDELEGGFDIIINGTSGGLSGQLPAVSPKIFEHCTLAYDMVYGEAAEPFLAFARQSGAKQTADGLGMLVGQAAASYRLWRGFAPDVLPVVQYMREL

SEQ ID NO: 31381 - protein, 632 aa, Streptococcus pneumoniae
NLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 31382 - protein, 543 aa, Burkholderia xenovorans LB400
MPHSCLPGPICAVRKTALQRAFMSFDSLGLSEPLVRAVHELGYTTPTPIQTQAIPAVLNGGDLLAGAQTGTGKTAGFTLPILQRLNSSPAVANGSGKRAVRALILTPTRELAAQVEESVRAYGKYLKLKSTVMFGGVGINPQIGALRSGVDIVVATPGRLLDHMQQKTIDLSHLEILVLDEADRMLDMGFIHDIKRVLAKLPPKRQNLLFSATFSDEIKTLADNLLDSPALIEVARRNTTAETVAQKIHPVDRDKKRELLTHLIKQHNWFQVLVFTRTKHGANRLAEQLTKDGISALAIHGNKSQSARTRALAEFKDGTLQVLVATDIAARGIDIDQLPHVVNYDLPNVPEDYVHRIGRTGRAGATGEAVSLVCVDELQLLKDIEKLIKRPVPQEVVAGFEPDPTAKPEPILRRGQGGGGGGGGRSPRQGQGAPKRDDARRDGAGSAKPAQRSGQRPANGQQQPKPQGAKPAGNGGQPRRDGQRHDDRPRAVAHEGSAAQHAPRKPQAAKPQGGNPGALLGGTKPRNDAPRGGQPTRSGQRGR

SEQ ID NO: 31383 - protein, 554 aa, Streptomyces coelicolor A3(2)
MIEPHAPAPPGSPPSWGGPCGPEAPARLPVRPAVGRFLVLAGVFVCAACGLVYELELVALASYLIGDSVTQASVVLSVMVFAMGLGSLAAKRLRGLAAAGFGALEAALALVGGSSAMLLYAVFAWTGGWGGLWADGPRILLVAFSLAIGVLIGAEVPLLMELIQRVRRQDPGGAVADLFAADYVGALVGGLAFPFVLLPFLGQLTGALLTGTVNAVVGAALVLGLFRRDLTRRARWLLLTANAVVLALLATATVLADDFERAARHAVYGQDVRVAVRTGVQEVVLTGDADGRPLDLFLDGRLRVRGSDERSYHEALVHPAMGGPHARVLILGGGDGLAAREVLRHPGVRRVDVLEADPGLARLARHDPGLSTLNEHAYGDARVRVLSGDAFHRLRATPSATYDVVISDLPDPGVTASTKLYSQEFYGLLRRVLAPDGRLAVHAGPVDARPRAFWTVDATLRAAGLPAVAYRVGARDTGPGPGSVPGPRRAAAGPPAPRGWGFLLAARTAPAPRLDPAAPRPHSLTPDSLARGVREAARTQMAGLPPSTLVHPRF

SEQ ID NO: 31384 - protein, 152 aa, Zea mays
MTGILRDFLESSGVVVGSTDDILLYTLSEEELFELFQIVSSQLSFIWNEFLKFHRTHKDKVMGYLHDMWDINRKAEWSIWIIHSKIEIPHRYLRSMNDDSPRHLIRISSSRKVHHDPIQNSMSQAELHRKSIAQMKSSMSWLFRNIVLARIF

SEQ ID NO: 31385 - protein, 396 aa, Streptomyces coelicolor A3(2)
MTSMSSSARPLLNRRLAEFGTTIFAEMSALAVRTGAINLGQGFPDTDGPEEVREAAVRALRDGRGNQYPPGPGVPELRAAVAGHQQRRYGLSYDPDTEVLVTAGATEAIAAALLALLEPGDEVVALEPYYDSYAACIAMAGGTRVPVTLRPHEGTFRLDLDELRDAVTDRTRLLLLNTPHNPTGTVLTRDELAAIAELAVERDLLVVTDEVYEHLVFGTAEHIPLASFPGMRERTVTIGSAGKTFSFTGWKVGWVTAAPALLTAVRSAKQYLTYVASGPFQYAVAEALALPESYFAAYRQDMEAKRDLLAAGLAEAGFGVYRPAGTYFVTTDIRPLGERDGFAFCRSLPERAGVVAVPNAVFYNHREEGAPFVRFAFCKRLPVLEEAVGRLKTLSA

SEQ ID NO: 31386 - protein, 280 aa, Triticum aestivum
  misc_feature (193)..(193): Xaa can be any naturally occurring amino acid
  misc_feature (230)..(230): Xaa can be any naturally occurring amino acid
  misc_feature (253)..(253): Xaa can be any naturally occurring amino acid
MHPTRWELSHMVDLQAAALVISSGRPGRSGILQYDGELKLPSKYLVSPPLIERTSGEYLVKNGVRTFACSETVKFGHVTFFWNGNRSGYFDETREEYVEIPSDSGITFNEQPKMKAPEIAERTRDAILSGKFDQVRINLPNGDMVGHTGDIEATVVACKAADEAVKMVLDAVEQVGDIYLVTADHGNAEDMVXRNKAGQPMLDKSGSIQILTSHTLQPVPVAIGGPGLHXGVRSGSDIQTPGLRNVCGTVMNXHGLQALADYRRPSSNRRQVKKHALFEA

SEQ ID NO: 31387 - protein, 124 aa, Oryza sativa (japonica cultivar-group)
MEAVKPRWYERTLVLAVQRVFFNAYFLGYLLSPKLAHRVVGYLEEEAIHPYTEYLKDIEAGKIENVPAPPIAIDYWRLPAGATLKDVVIVRADEAHHRDVNHFASDVHFRGMDLKDTPAPLDYH

SEQ ID NO: 31388 - protein, 559 aa, Oryza sativa (japonica cultivar-group)
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLRAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMVMIAKALEYEDFDKFDRVRVPKIRYAGMLQYDGELKLPSHYLVSPPEIERTSGEYLVKNGIRTFACSETVKFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 31389 - protein, 540 aa, Prochlorococcus marinus str. MIT 9301
MSKISSKNIKSLSVPQSPVVLAILDGWGYRKEKSDNAIKSASTPIMDSLWHAYPHTLISASGSDVGLPDGQMGNSEVGHLTIGSGRIIQQELVRISNIVKNNQLGLVNELKEMAASLKKNNSTLHITGLCSDGGVHSHIDHLLGLIKWASDNKLKKVAIHIITDGRDTPAKSALKYLNQIESCIKKYNVGEIASICGRYWIMDRNLLWDRTEKAYTNLTDPDIQITNFSPKDYIEKSYAKNITDEFIEPIRMSENYLKDGDSLICFNFRPDRARQIVKALSLNQFSDFERKNYPNLEFVTFTQYDPNFPVKVAFPPESLNNFIGQIVSENGLKQYRTAETEKYPHVTYFFNGGVEIPLPGEERHLIPSPRVATYDMKPEMSAEELTISCSKAIKSGNYAFVVINFANPDMVGHTGNMDATIKAIEKVDKCIGQIVNATGEMGGSIVITADHGNAEVMKGSEGEPWTAHTINKVPLILIEGEKRKIPNMGNEINLRENAGLADIAPTLLQLLNLPVPGEMTGKSLIQEIELKGYNKVVQHV

SEQ ID NO: 31390 - protein, 451 aa, Salinibacter ruber DSM 13855
MLLCSEKTPAWAGPRGLLQKRSRADSLNAGLSQRPACLRPCPFGRDGHAVSIPLRLSPHTFFDMADQESVTELTTDKAPIKARGLEGVIALESELSSIDGDKGQLIYRGYDIHDLADHASFEEVVYLLRHGELPTQSELDDFSSHLRSERALPAPILNLLRETPADAHPMAVLRTAVSALALYDEEADTMEEAANHRKADRILAQIPTIIAAFDRLRKDKEPVAPLDHGSMAHNFLYMLNGEKPGAAAEDTFDVCLVLHADHGLNASTFTSRVIGSTLSDMYSAVSGSVGALKGRLHGGANQEVMRMLLDIDEKGADPTSYIRDRLDADERVMGFGHRVYNTMDPRAAILRTMVKELSEEAGDMKWYKYTTKIHETMTEETGIDPNVDFFSGPTYYQLGLDPDLFTTIFALSRTAGWTAHLLEQWADNRLIRPRAQYVGARDRTVAPIAER

SEQ ID NO: 31391 - protein, 193 aa, Arabidopsis thaliana
  misc_feature (29)..(29): Xaa can be any naturally occurring amino acid
  misc_feature (53)..(53): Xaa can be any naturally occurring amino acid
  misc_feature (76)..(76): Xaa can be any naturally occurring amino acid
  misc_feature (115)..(115): Xaa can be any naturally occurring amino acid
  misc_feature (131)..(131): Xaa can be any naturally occurring amino acid
  misc_feature (146)..(146): Xaa can be any naturally occurring amino acid
  misc_feature (151)..(151): Xaa can be any naturally occurring amino acid
KTITVASSMVSSATMVASPAEATMVAPFXGLMSSVAFSATRKVNNEITSITTXNRRANCMQEWPPIVKKKFETLSXYLPDLTESELLNEVEYLIRNNCIPCVEFKLEHFFVYASXHGNSPVYYDGRHLNNXNLPLFSSTESDQVLXTVIEXNNRHPNGFITIIEIELMRQAESIIFIVYEPSSFTGEILSAFA

SEQ ID NO: 31392 - protein, 207 aa, Avicennia marina
MLRVMKKSFKDSLKALEADIQHANTLASDYPTEHDGACLQMRLSYSPCAHLFLFLVQWADCHLAGVLGLIRILIYKAYEDGKTTRSICERKASLREFYGVIFPSLLQLHRGITDVEERKQRVIIPQLNTRRRDEMAKGKLSEIEIEREEECAICMEMNSKVVLPSCSHSMCMKCYRNWRARFSVVPVLSRQSKEDEFWGALDLHKPL

SEQ ID NO: 31393 - protein, 663 aa, Shigella flexneri 2a str. 2457T
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKALL

SEQ ID NO: 31394 - protein, 420 aa, Picrophilus torridus DSM 9790
MKGDDLFSEALKLFPSGVNSPVRFYRPVPVMFERGRGSRIYDVNGKEYIDYSLGFGPMILGHADPDVASAIKRQADNGILFGSITENEVRLGNIIKNHVKSIEKMRFTNSGTEATMHAIRLARGYTKRKYILKMEGGFHGAHDYALIKSGSGTMTFGVPSSNGVPEEITKTVLVGKYNDENSIESLFNEYGNDIAAVITEPILGNIGVINPEPGFLEFLREITNKYNSLLIFDEVITGFRFAFSGYQDIINIKPDITTMGKIIGGGAPIGLFGSSSEIMDLISPSGNVYESGTFSGNPLSMAAGIAAMEKLQGMDYSRINNYTADLVKSLYDIFNDKNIDVNINHYGSMFQIFFNKNEVKTYDDAIKSDKDRFFKFFKKMLDHNVYLPPSQFETNFVSFAHGRDDLNKTIEAAKEAVSCI

SEQ ID NO: 31395 - protein, 344 aa, Zea mays
MLDLWSAILTGSSERADGSRSSISMWTKITSTDSWRWCLGLIYIVAVASIWIAASYIVQSVVDAGVSPFLITYICNSLFVVYIPIVEAARYFEDSIGDLWTKLKFKDAESLQQASDMESVNLLQSGGHEINVASDQSQTRLSGDASVPDTCFPAQAELTVVDCSKGLDAKGRWTRARVAQLTFNLSLRYTTVTSNTILSSTSSLFTFLVALVFLGETFTWLKLISVLLCMGGTIIVSLADSSSSVNAIATNPPLGDFLSIVSAGLYAVYITLIRKKLPDEKEGQGQVSMAQFLGFLGLFNMLFFFPVALVLNFAKLEPFHRLTWEQAGLVVGKGRFALHSWKFY

SEQ ID NO: 31396 - protein, 180 aa, Sinorhizobium meliloti 1021
MTAVQSELISAIRSIPDYPKPGVMFRDITTLLGNPRAFRRAIDELVHPYAGTKVDKVAGIEARGFILGGAIAHQLSAGFIPIRKKGKLPHDTVRIAYSLEYGVDEMEMHRDAVAPGDKVILVDDLIATGGTAEGAAKLLKQMGADIVAACFIIDLPELGGRKKLEALGVNVRTLIEFEGH

SEQ ID NO: 31397 - protein, 117 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVE

SEQ ID NO: 31398 - protein, 334 aa, Xylella fastidiosa Dixon
MIPTPTRDAPNIPSFLAADVGGTHVRVSVVAAAPTCASPPQLFDVRTYRCADYPSLSTILNDFLGTRSAVRDCVIASAGFQRSDGTVITTNLPWPLSPHRLRADLNLAEVSLVNDFEALAYATEDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 31399 - protein, 368 aa, Oryza sativa (japonica cultivar-group)
MAVDDAEDDQLASMSTEDIVRASRLLDNEIRDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQVTHEDFNEGIIQVQAKKKSSLNYYA

SEQ ID NO: 31400 - protein, 399 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDPRAELFQAAKGA

SEQ ID NO: 31401 - protein, 376 aa, uncultured archaeon GZfos18B6
MEERGISKQELESFLKEQKQRDLTYRKVLSSMCTYPREIAVYAHNLFLDSNLGDSGLFPGTKEIEDELIRMIGALLGNENAHGYISTGGTESNIQAIRAIRNRKRKEGLQQMNIIVPKTAHFSFDKIEDLLSLEVKKAGLDDELRVDVNLVEELIDDNTISIVGIAGTTEFGQIDPIKELADIAHNSDIFLHVDAAFGGFVIPFLDAEYQFDFSLDAVSSISVDPHKMGMSTIPAGCILFRDESYLADLAVNTPYLTTNEQCSLIGTRSGAPVAATYAVLKYLGRNGLRAIVDECMLLTRMLVRGAKAMDIYPVIEPVTNVVTLRFPDVDRVAKALEARGWRVSTTRAPKALRLVIMPHVTEDTIELFLNDLACVT

SEQ ID NO: 31402 - protein, 122 aa, Idiomarina baltica OS145
MVEETIFTKIINREIPADIVYEDDHALAFKDINPQAPVHLLIIPKKAIATINDIEEEDAGLVGHLYLVASKLAVQFGFAKDGYRCVMNCNEHGGQSVYHIHLHLLAGKPLGWPPYTDTPKQV

SEQ ID NO: 31403 - protein, 474 aa, Arabidopsis thaliana
MAATLTGSGIALGFSCSAKFSKRASSSSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 31404 - protein, 389 aa, Ralstonia metallidurans CH34
MAESNLAPLNPPPSRLPNVGTTIFTVMSALAAEKNAVNLGQGFPDFDCDPRIVDAVTHAMRTGHNQYPPMAGVPQLRQAIAAKIAKLYEHTYDWNTEITVTAGATQGLLTAILCAVHPGDEVIVLEPCYDSYLPAIELAGATAVPVTLEAPLFRIPFDKLAAAITPRTRMIMINTPHNPTGTIWREEDMQQLADLLAGTDILLLSDEVYEHMVYDGQQHESVARHPELARRSFVVSSFGKTYHVTGWKVGFVAAPAALSNEFRKVHQFNVFTVNTPVQYGLADYMADPAPYLNLSAFYQAKRDYFRAGLAGTRFKLLPSDGTYFQCVDYSAISDMSEADFSMWLTREIGVAAIPVSAFYSTPRESGVVRFCFAKKEETLKLALDRLAKL

SEQ ID NO: 31405 - protein, 313 aa, Parvularcula bermudensis HTCC2503
MADKQFGSDGFTAEHLPDLTGKTFAITGANSGIGLEAARYLGGRNATVLMLCRNASKAESARNALRQSAPGGKYETISLDLADFSTLSPATDAIRQATDRLDGLILNAGVMMLPRRQITKDGFEMQYQVNVLSHFALAAALADLVETASGRFVWLSSIAHHYAKHPKLTDLGYAAGYSPTSSYAKSKLADLMLGLELHRRLSAAGKSAGSYIAHPGYSDTNLQSAGPGAILGTLIKPFTMIFSQPAEKGALPTVLAAAYPKAQPGVLYGPTGFQEMKGPVGEAAIKPWAKDPQVAKQLWSVCEEATGREWSMA

SEQ ID NO: 31406 - protein, 325 aa, Shewanella oneidensis MR-1
MAEMNMLQAVNEALSIAMQADERMVVFGEDVGHFGGVFRATSGLQEKFGRARCFNTPLTEQGIAGFANGLASNGMTAVAEIQFADYIFPAFDQIVNESAKFRYRSGNEFNVGSLVFRTPYGGGIAGGHYHSQSPEAYFTQTPGLKVVVPRNPAQAKGLLLASIRDKNPVVFFEPKRLYRASVGDVPAGDYEIELGKAEVLREGKDITLVAWGAQMEIIEKAADMAAKEGISCEIIDLRTLAPWDVNTVADSVKKTGRLLVNHEAPLTGGFAGEIAATIQQECFLYLESPISRVCGLDTPYPLVHEKEYMPDALKTFEAIKASVNF

SEQ ID NO: 31407 - protein, 311 aa, Parvularcula bermudensis HTCC2503
MPIQEADFIWKNGELIPWAEATTHVLTHALLYGTCAFEGSRAYQTHKGTCIFRTAAHVERLIYSSKIYHIPVPYTADEIIEATRRTVRENNLPEAYIRTNVYLGYGEMSPAAVNAPTDVTIAAFPWGRYMGADAIEQGVPAAISSWRRLAPSTMPAGAKLAGNYLSSRLIALEARRAGVTEGIGLTAEGMVSEAGSANLFVVKGGRLITPPVAASILNGITRDTVITLAKDQGIDVVEQEMPRELLYGADELFFTGTAAEITPINRVDGLPVGPASGENARPITGALQKAFFGLFTGETSDKWGWLDPVEA

SEQ ID NO: 31408 - protein, 839 aa, Pseudomonas putida
MKFGFIAHPTSTGLLHQVKLVDMLDRTLEEQAWGYQAERWQQRNLVPFIDFGRIVSACGAECSGMLQFVPLTAEQMLRQPRAIAERVLQGVAALKAEGAELVGLGGFTAIVGNRGVATMQQAEVAVTTGNSLTAFAAYANLMDSLRLLGIAAADAEVAVLGYPGSIALAVARLLAEQGCRLRLVHRGNAQQAQAHLEYLPSQYHAQVTLHDNLEDCYAQVRFYVAATSSGGLIDPRRLLPGSVVLDAALPKDVMDVPHQRRDILLVDAGLVSASPAVHLGLRSLGLEPKRSLNGCLAETMILALEGRAEPFSLGRELPVHKVLEIGRIAERHGFSPSPMTHDGEVLASEAFDRLHRHHHPRRALRASDATDEPLALRREVLNSFAEHINPVLREFYRFNHIERVFSQGQGCWLTDLDGRRFLDFVAGYGCLNTGHNHPAISQALQGYLQAQFPTFIQYLSAPLHASLLAQRLAALAPGGLNRVFFSNSGTEAVEAALKLALAASDKRSVVYCDNGYHGKTLGALSVTGRAKHRTPFEPLLPRCDSLPFGDLHALRRRLEQGDVAAFIVEPIQGEGGVILPPPGYLAGVRALCDEFDCLWILDEIQTGLGRTGKLFACEWDNTAPDIMVLSKSLSGGLVPIGATLSRDAVWERAYGDIDSFALHTSTFGGGNFAAAAALAALDVLEQDGLCANAAEVGAFLQAGLQHLVDRYPFLVAVRGRGLMLAIEFHQDMRGGVQALVKELAGRIPGQAMATYRMLSGAARAHLEAAAQALEQNLEDMFVLRFMTKLSEEHGVLTFVTANNNRVMRIQPPLVLTREEAECFLSAFASVCEDLATFQS

SEQ ID NO: 31409 - protein, 140 aa, Brassica napus
MEVQSSNNGGHSSFSSLRVYLNSLSSTPSRLARRAVSVSTSSDEMSRVRAVSGEHMRRTLRWYDLIGLGIGGMVGAGVFVTTGRASRLYAGPSIVVSYAIAGLCALLSAFCYTEFAVHLPVAGGAFSYIRITFGEFPAFF

SEQ ID NO: 31410 - protein, 451 aa, Shigella flexneri 2a str. 2457T
MTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 31411 - protein, 896 aa, Candidatus Kuenenia stuttgartiensis
MTTVIIDGKRVEADPSQTILEAARRVGIRIPTLCHDPRLKPSGACRICVVEVEGKDNLAASCATPVSEGMKVSTRSEAVLRSRRLNLELLWSNHPNDCLTCDKAGECSLQNLMYEYDVKTSRFVKQNPVPAPDESNPAIYRDMNKCIMCGKCVRICDEVQGQHVWTFSDRGIKTRVSTAFEKSMQDGGCVFCGHCVSVCPVGALMDKPVMKKARSWETRKVRTVCSYCGVGCSLVLHIKNNEILQVTADINSAPNYGSLCVKGRYGFEFYSSKDRLKTPLVRDNINEPFREASWEEAIGLVAKRFSEIKKKYGPDSFGCLSSSRGTNEENFLAQKFTRVVMGTNNMDNCARVCHAPSVTGLRAALGSGAATNSLADIEGAEVLIVSGSNTTEAHPVAALKIKKAVRQNGAKLIVIDPRKIELVKYADIHLQLRAGTNVALINGLLHVIIKEGLQNDDFIERRTENFEMLKQVVSKYTPEETEAITGVPKEDIIKAARMYAGTNKGMIIYGLGMTEHKAGSHGVMSLANLALITGNVGRPNTGINPLRGQNNVQGSCDMGALPDVYACYQRVDDPEANRKHAEAWKVKKLPEKPGLKEPQMYRAIESGDLKAMYIIGYDPAISQADINKVRASISKLEFLVVQELFMTETAKLAHVVLPTSCYFEKDGTFTNAERRVRRLHKAIPLPEGTKSDWDIICSIATAMGYPMSYNHPSEIMDEIAKLTPDMAGINYKRLEGDGLVWPVWDMNHPGTPILHKDTFKRGRGMFNDLMYTPSEELPDEEYPLLLTTGRRLYQYNNGSMSLRNPEICAINSEEFMEIHPADAAKLDIKSGEKVKVSSRRGSLEVKTELTEKSRLGSVFLSFHYPETPTNVLTGPGEDMLALTPEYKVCAVKVEKM

SEQ ID NO: 31412 - protein, 609 aa, Ashbya gossypii ATCC 10895
MPTISVYKQQLFDLLGKNYSNEEFDELCFEFGIELDEDTTEEALKNNEEPELKIEIGANRYDLLCIEGIAQSLNEYVGRAETPKYKLAAPTTKLYIEPSTEQIRPYAAAAILRNIKFDERSYASFIALQDKLHSNLCRNRTLVAMGTHDLDSIQGPFHYKALPPTDFKFVPLFQSKELTGKEVVDLYKTPEQKNNLGRFVHIIENSPVYPVIFDSQDQVCSLPPLINSERSKISIDTRNVFIEVTATDRTKAEVVLNQLVAMFSRYCEDKFSVEAVEIVSEHNNESRITPNFTERKINVSAEYINSCLGLQLSLEEICACLKKMSLHGKPAGNDKDTIEVSIPITRPDILHPCDVLEDAAVGYGYNNLPKHNKLSNANFVAAPLPINKVSDIFRIASSQASWLEVLPLTLCSHDENFKFLRLEDDGTTAVKLANPKTAEYQVVRTSLLSGILKTVRENRKQALPIKVFESGDVVFKNPALERKAYNERHWAAVYVGKNSGFEIIQGLLGKIMQTFRTSWLPDYGKDSDGRGYWIEEDTSIPTYFPGRGAKVMFRSRQGAEVKQIGHLGVLHPEVMNNFEIPYAGILRRIELRGFLVDEPFVSLYIGFDA

SEQ ID NO: 31413 - protein, 379 aa, Sporosarcina ureae
MILVTLEQTLQDDKASVLDKMVEHEQILFCHDKATGLQAIIAVHDTTMGPALGGCRMAPYKTMDLALKDVLRLSKGMTYKCAAADVDFGGGKSVIIGDPLKDKTPEKFRAFGQFIESLNGRFYTGTDMGTTLEDFVHAMKETNYIVGKPVEYGGGGDSSIPTALGVFYGIKATNQNLFGDDKVEGRKYSIQGLGKVGYKVAEHIINEGGNVIVTDINEQAIADIQKLGGSAVRVVSSEEIYSQQADVFVPCAFGGVINDDTLKVLKVRGISGSANNQLAESRHGELLREKGILYAPDYIVNGGGLIQVADELYGTNPARVLAKTENIYTSLLEVFHQAEQDHMTTATAADRMCEKRIADAKNRNSFFTQSNRPKWNFHQ

SEQ ID NO: 31414 - protein, 561 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVS

SEQ ID NO: 31415 - protein, 118 aa, Arabidopsis thaliana
MARVVKIDSAESWNFYVSQAKNQNCPIVAHFTALWCIPSVFMNSFFEELAFNYKDALFLIVDVDEVKEVASQLEVKAMPTFLFLKGGNAMDKLVGANPDEIKKRVDGFVQSSRVVHIA

SEQ ID NO: 31416 - protein, 139 aa, Mesorhizobium sp. BNC1
MQASELRFAPPSADKSALEEGRLFTPRFDANGLITAVVTDAGDGTLLMVAHMNAEALAKTLETGIAHYWSRSRSSLWKKGETSGNLQHVESISTDCDQDAVLLKVRVGGEGATCHTGRRSCFYRNVKVEDGRPILTENG

SEQ ID NO: 31417 - protein, 468 aa, Oryza sativa (indica cultivar-group)
MVQIEPLEVSLEAGNQADSALLDDDGRPRRTGTFWTASAHIITAVIGSGVLSLPWATAQLGWVGGPAVMVVFGGVTYFTATLQAECYRTGDEETGARNYTYIGAVRAILGGANAKLCGIIQYANLVGTAIGYTIAASISMQAIKRAGCFHANGHNVPCHISSTPYMLIFGAFEIVFSQIPDFHEIWWLSIVAAVMSFTYSGVGLGLGIAQTVADGGFRGTITGVTNVTATQKAWRSLQALGNIAFAFAFSNVYTEIQDTIKAPPPSEAKVMKQASLLSIVATSVFYALCGWMGYAAFGNAAPDNLLTGFGFFEPFWLVDAANVAIAVHLIGAYQVYCQPVFAFVERKASRRWPDSGFVNSELRVGPFTISAFRLAWRSVFVCFTTVVAMALPFFGVIVGLLGAISFWPLTVYLPTEMYIAQRGVRRGSALWIGLRALAVAGFVVSAAATTGAVANFVGDFMKFRPFSG

SEQ ID NO: 31418 - protein, 345 aa, Streptomyces coelicolor A3(2)
MTMATTATRSDTPGSDFARLSKKVADAGLLGRRPGYYTLRITAVTGLYAAGWAAFVLVGASWWTLAIAAFLAVMYGQVALVAHDMAHRQVFRRRRASELSGRIAGASIGMSYGWWQDKHTRHHANPNTEDLDPDIGPDLLVWSPDQARAATGLPRLLGRWQAFLFFPLLTLEGFNLHVASGRAMANRRLKRRALDGALLLAHCAVYLTALFWVLPPGMAIAFLAVHQCLFGVYLGSAFAPNHKGMPILTADDRPDFLRRQVLTSRNVNGGLFTDLALGGLNHQIEHHLFPSMPSPNLRKARAIVRRYCRDLGVDYAETGLVASYRLALTSLHDAGTPLRRTRVRA

SEQ ID NO: 31419 - protein, 304 aa, Sulfolobus tokodaii str. 7
MLAIRLARGYTKREKILKFDGNYHGAHDYALINAGSAVSEFNVIISSGIPTSIINTVIVCKYNDLDCVEKHLRTEEIAGVIVEPVMGNMGVILPEQDFLNGLRELTKTYNSVLIFDEVITGFRLGLSGAQGYFKVIPDLTTLGKIIGGGLPIGAVTGKKEIMSNLTPEGKVFNAGTFNANPLTMAAGIATIEVLETTNAYDIANKASKEIAEELDNSLSKKNFKYTINRIQSMFQFFIGISKVTNADDARLANKDLYVKIHEKLLKLGVFIPPSQFETIFTSSSHSDEIVNLTIEAIHKVVSEI

SEQ ID NO: 31420 - protein, 565 aa, Medicago truncatula
MAPAAIVTNGTTTVTPTVTTRFASVYSEVQNSRVDHKLRLPSVLQAPFAIVDGPKSSAAGNPDEIAKLFPYLFGQPSAALVPAGENTALPHRKLKIGVVLSGGQAPGGHNVISGIYDYLQQSASGSTLYGFKGGPAGIMKGKYVELNSDYIYPYRNQGGFDMICSGRDKIETPEQFKQAEETATKLDLDGLVVIGGDDSNTNACLLAENFRSKNLKTQVLGCPKTIDGDLKSKEVPTSFGFDTACKIYAEMIGNVMIDARSTGKYYHFVRLMGRAASHITLECALQTHPNITIIGEEVAAKKLTLKNVTDYIVDVICKRAEDNYNYGVILIPEGLIDFIPEVQHLIAELNEILAHETVDEGGLWKKKLTDQSLELFEFLPQAIQEQLMLERDPHGNVQVAKIETEKMLIEMVETELGKRKQEGKYNGEFKGQSHFFGYEGRCGLPTNFDANYCYALGYGAGALLHSGKTGLISSVGNLCAPVEEWTVGGTALTSLMDVERRHGKFKPVIKKAMVELEGAPFKKFASLRDEWALKNCYTSPGPIQFTGPGSDAVSHTLLLESGFQI

SEQ ID NO: 31421 - protein, 369 aa, Medicago truncatula
MDPNNNHFNNQNYSNYPFNYENPNNYPNPNQFFNQRPQNIPNFGFPPNFNQSSSVPNFHPYYGSMMRYPSQTPPFNGSMPMENDNFHNVGATQYPEFSTQITPSGMAIADEVTPEDSTPKSKRSKEPAWNTQQNLVLISAWIKYGTSSVVGRNQRGETYWGKIAEYCNEYCSFDSPRDLVACRNRFNYMSKIINKWIGAYESAKRMQGSGWSEDDVLTKAQELFAGGKNIQFTLNEEWHALRDQPRYGSQMGGNVGLGSSGSKRSHEDSVGSSARPMGREAAKKKGKMKSKGETLEKVEKEWVQFKELKEQEIEQLKELNLVKQQKNKLLQEKTQAKKMKMYLKLRDEEHLDDRKKELLEKLERELFEN

SEQ ID NO: 31422 - protein, 366 aa, Arabidopsis thaliana
MSPSMIAPVMEEENKKYQKGVKHLCENGLTKVPTKYIWPEPDRPILTKSDKLIKPNKNLKLPLIDFAELLGPNRPHVLRTIAEACKTYGFFQVVNHGMEGDVSKNMIDVCKRFFELPYEERSKYMSSDMSAPVRYGTSFNQIKDNVFCWRDFLKLYAHPLPDYLPHWPSSPSDFRSSAATYAKETKEMFEMMVKAILESLEIDGSDEAAKELEEGSQVVVVNCYPPCPEPELTLGMPPHSDYGFLTLLLQDEVEGLQILYRDEWVTVDPIPGSFVVNVGDHLEIFSNGRYKSVLHRVLVNSTKPRISVASLHSFPLTSVVKPSPKLVDKHNPSQYMDTDFTTFLQYITSREPKWKNFLESRKIHHV

SEQ ID NO: 31423 - protein, 782 aa, Oryza sativa (indica cultivar-group)
MPDLPCDGDGVCMVCRVASPPEVDLLRCSTCATPWHSPCLSKPPALADAAQWSCPDCSGDSTDAPPPAPAPLAPGSAGQLVAAIRAIECDATLSDQEKARRRQELLGGAAPAGADADDDEGDDVLEVIGKNFSCAFCMKLPERPVTVAFLTIRFYFCLGQTPCGHNFCLKCFQKWIHSGKRTCGKCRAQIPAKMAEQPRINSALVSVIRMAKVSKNANSAVSAAAYHYIRNDDRPDKAFTTERAKRAGKANASSGQIFVTIPPDHFGPILAENDPKRSIGVLVGDTWEDRLECRQWGAHFPHVAGIAGQSTHGAQSVALSGGYVDDEDHGEWFLYTGSGGRDLSGNKRTNKEQSSDQKFEKLNAALRISCLKGYPVRVVRSHKEKRSSYAPEAGVRYDGVYRIEKCWRKISVQGKFKVCSDIYGDRPRPLPKVDELKGATDISERKGTPSWDFDEKEGWKWVKPPPISRKPNLSGDPATDKEIRRVARRAQMSVAERLLKEFGCSICKQVMKEPLTTPCAHNFCKLCLVGTYGSQSSMRERSRGGRTLRAQKIVKKCPSCPTDICDFLENPQINREMMDLIESLQRKAVEEGDTKTSSDVSNGAESSGDDGNNEALEKGEDDSSLKDDGKVVKAVVVIKEEDLQPKKSKGEDEKEQGDKKMDSADVVDIAVEKKQATKRASEKAEKKQARKRKGDAVATNDGKRMKTGGDAMETAAEEDAPLSGGTPVKRNSRKSSEVDAKGGGGSPVVSSPRRVTRSSAKASGEADGSPATRTRRATRAEA

SEQ ID NO: 31424 - protein, 512 aa, Coprinopsis cinerea okayama7#130
MVLNFTSLASIPTSTSFPTPSSFLSLNPGKSATWLYTTGAIVVSLLALEQAVYRYKKRHLPGASWTIPIIGKFADSMSPSMENYKKQWASGDLSAISVFNIFIVMASNNEYARKILNSPSYAKPCLVHVAPQVLCEDNWVFLNGKPHVEYRKGLNQLFTRRALSIYLPIMEGSARKHISKWIEQGKDGKAHAIMMTARFLNMDTSLRVFCGNHLPEHAAAEINEKYWLITQAFELVNFPLAIPGTKVWKAIQARKAAMQWLELAASRSKIAMAEGKEPECMLDEWVTILADPNYKGRKEFSDREMALVLLSFLFASQDAMSSGLIYAFQHLADHPEVMQKVREEQERVRKGNYEIPLTLDLLDQMTYLHAVVKESMRVKPPVVMVPYRATKAFPIAENYTVPAGSMVIPSFFNSLHDSSVYPEPEAFQPERWLDPNSTANAHPKNYLVFGSGPHRCIGIDYAMMNMALVLATASAMMVWEHEITPLSNEVEIIATLFPKDGCRLKFTPCHHG

SEQ ID NO: 31425 - protein, 389 aa, Streptococcus pneumoniae TIGR4
MDLTKRFNKQLDKIQVSLIRQFDQAISEIPGVLRLTLGEPDFTTPDHVKEAGKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 31426 - protein, 336 aa, Shewanella oneidensis MR-1
MTIRVAINGYGRIGRNVLRALYESEKAYPIKIVAINDLGDASINAHLTKYDSVHGRFNAKVEHDAEAIYVNGDKILTFQERDPGKLPWNDLQVDVVFECTGIFTSKESVQPHLAAGAKKVIISAPGKNVDATVVYGVNNNVLTSDMTVISNASCTTNCLAPFAKPLNDEIGIESGLMTTIHAYTNDQRLSDVYHTDLRRARAAALSMIPTKTGAAAAVGLVVPELQGKFDGLAVRVPTVNVSLVDLSFIASRDTTVEEVNAIIERAASVAPLSEVLAVNKEPLVSIDFNHNAFSSNFDATQTRVNGRLVKVMAWYDNEWGFSNRMLDNAVALMNAK

SEQ ID NO: 31427 - protein, 265 aa, Glycine max
MAHPPLDPYYLYQQQDERSNINTLFVSGLPDDVKAREIHNLFRRRPGFDSCQLKYTGRANQVVAFATFFNHQSAMAALHALNGVKFDPQTGSVLHIELARSNSRRKRKPGGEAYVVIDKRSTGEPDLQGSSSDDGDSDPDEPSDSGDNQGDIAIMTSDETAVGSDNAVSVEQHGKGSAGGLCSTLFIANLGPNCTEDELKQAFSVYTGFNMVKMRSRGGMPVAFVDFEETDQAAKVVEELQGSLLPSSDRGGMHIEYARSKMRKR

SEQ ID NO: 31428 - protein, 381 aa, Glycine max
  misc_feature (58)..(58): Xaa can be any naturally occurring amino acid
  misc_feature (102)..(102): Xaa can be any naturally occurring amino acid
GSSGRLIKVRDGGTDWGWGVAVNVVKKPSGGGYIVDTLLHCSPVSNENSFRSKPCPPXPVEKGEMHVASVQLPLISALGQLRVSIPSDLRPLEARQSILLAXQELGNRFSQGLPKLNPVKDMDVRDSEIVELVNQVEELEKKLVAHPMHKHQDMDQIKCFERKAEVNHEVQQLKTKMRDSQLQKFREELKNRSRVLKKLGHIDADGVVQLKGRAACLIDTGDELLVTELMFNGTFNDLDHHQVAALASCFIPGDKSTEQIQLRTELARPLQQLQDSARRIAEIQHECKLDINVNEYVESTVRPFLMDVIYSWSKGANFADVIQMTDIFEGSIIRSARRLDEFLNQLRAAANAVGEADLEKKFAAASESLRRGIMFANSLYL

SEQ ID NO: 31429 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMNEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVAAAKELASKGEKVRVVSMPSTDVFDKQDAAYKEEILPNAVRRRVAVEMGASQNWYKYVGLDGAVLGIDTFGASA

SEQ ID NO: 31430 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRKWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPVLENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASA

SEQ ID NO: 31431 - protein, 380 aa, Bacillus badius
MSLVEKTSIIKDFTLFEKMSEHEQVVFCNDPATGLRAIIAIHDTTLGPALGGCRMQPYNSVEEALEDALRLSKGMTYKCAASDVDFGGGKAVIIGDPQKDKSPELFRAFGQFVDSLGGRFYTGTDMGTNMEDFIHAMKETNCIVGVPEAYGGGGDSSIPTAMGVLYGIKATNKMLFGKDDLGGVTYAIQGLGKVGYKVAEGLLEEGAHLFVTDINEQTLEAIQEKAKTTSGSVTVVASDEIYSQEADVFVPCAFGGVVNDETMKQFKVKAIAGSANNQLLTEDHGRHLADKGILYAPDYIVNSGGLIQVADELYEVNKERVLAKTKHIYDAILEVYQQAELDQITTMEAANRMCEQRMAARGRRNSFFTSSVKPKWDIRN

SEQ ID NO: 31432 - protein, 168 aa, Haloarcula marismortui ATCC 43049
MVASLMVLYGPYTTLTIARSDRDVVQEHLLRDGHSERWGQFELPAEATVVGLAGKTGERSDAFNDIAQSFERDLKLRYGGATVADLAQVLEYGGLFGYPVTSGYPNGKLRVHFESAPLAYLVEAAGGASSDGSQSLLDVEPDGIHDRTPTFLGNAELVDELEAALSET

SEQ ID NO: 31433 - protein, 428 aa, Oryza sativa (japonica cultivar-group)
MSKAAAAASLPPPPPEVAHLVDQLQRHHLAPDASLLSSCAHSDLLQAREEVASERARYLEALAVYAEAIAMVEEYQHAISTGVANAGKKLNCSPQVYESLEHHLAVAEAAQRLRLPLLSQDGDVHEEEIEKLSTLSRSSFDSTMTSAAPSSSSISTSYNNYSSTASAATVAAAPGTGGSEPVEPGVGGVPDRFLGITSDYLYQVQQEQPAMTVDMVDYQRTLAREIEARLEAKCDALADLFAMDERDSSSISQISSARLPERVKLIIEEIEKEEALLLDDLASMDRKFAEHYNVLEQILAVLIQFVKDKKLEHQHQYDDLKKTWLIKRCRTMNAKLSYLEHHLLRDTYTKETVPALHRIRKYLVEATKEASNSYTEAVSRLREYQGVDPHFDVIARQYHEIVKKLEGMQWTIHQVEMDLKPHHDHADV

SEQ ID NO: 31434 - protein, 366 aa, Thermoactinomyces intermedius
MKIFDYMEKYDYEQLVMCQDKESGLKAIICIHVTTLGPALGGMRMWTYASEEEAIEDALRLGRGMTYKNAAAGLNLGGGKTVIIGDPRKDKNEAMFRALGRFIQGLNGRYITAEDVGTTVEDMDIIHEETRYVTGVSPAFGSSGNPSPVTAYGVYRGMKAAAKEAFGDDSLEGKVVAVQGVGHVAYELCKHLHNEGAKLIVTDINKENADRAVQEFGAEFVHPDKIYDVECDIFAPCALGAIINDETIERLKCKVVAGSANNQLKEERHGKMLEEKGIVYAPDYVINAGGVINVADELLGYNRERAMKKVEGIYDKILKVFEIAKRDGIPSYLAADRMAEERIEMMRKTRSTFLQDQRNLINFNNK

SEQ ID NO: 31435 - protein, 1082 aa, Ralstonia metallidurans CH34
MPKRTDIKSILIIGAGPIIIGQACEFDYSGAQACKALREEGFKVILVNSNPATIMTDPNTADVTYIEPITWEVVERIIEKERPDAILPTMGGQTALNCALDLHRHGVLDKYKVELIGASPEAIDKAEDRQKFKDAMTKIGLGSAKSGIAHSMDEAVAVQSRIAQETGTAGYPIVIRPSFTLGGTGGGIAYNREEFEEICKRGLDLSPTRELLIEESLLGWKEYEMEVVRDKADNCIIICSIENLDPMGIHTGDSITVAPAQTLTDKEYQILRNASLAVLREIGVDTGGSNVQFSINPTDGRMIVIEMNPRVSRSSALASKATGFPIAKVAAKLAVGYTLDELKNEITGGQTPASFEPSIDYVVTKVPRFAFEKFPAADSHLTTQMKSVGEVMAMGRTFQESFQKALRGLEVGVDGLDEKSTDRDEVIEEIGEAGPDRIWYVGDAFRLGMSLEEVQSETDIDPWFLAQIEDIVKTEGLVRNRTLESLSTAELRHLKQKGFSDRRLAKLLKTDAKAVRLARVAQNVRPVYKRVDTCAAEFATNTAYMYGTYEAEHGECEADPTSNKKIMVLGGGPNRIGQGIEFDYCCVHAALALREDGYETIMVNCNPETVSTDYDTSDRLYFEPLTLEDVLEIVDKEKPVGVIVQYGGQTPLKLALDLEANGVPIIGTSPDMIDAAEDRERFQKLLQDLGLRQPPNRTARAEDEALRLAEEIGYPLVVRPSYVLGGRAMEIVHEPRDLERYMREAVKVSNDSPVLLDRFLNDAIECDVDALCDGTRVFIGGVMEHIEQAGVHSGDSACSLPPYSLSQATVDELKRQTAAMAKALNVVGLMNVQFAIQQRNGEDIVYVLEVNPRASRTVPYVSKATGLSLAKIAARCMAGQSLDSQGIGEEVVPPYYSVKEAVFPFNKFPGVDPVLGPEMRSTGEVMGVGKVFGEALFKSQLAAGSRLPEKGTVLITVKDSDKPRAVTVARMLHDLGYPIVATRGTASAIEAAGIPVRVVNKVKDGRPHIVDMIKNGELALVFTTVDETRTAIADSRSIRIAALAARVPYYTTIAGANAAVEGLKHMQNLEVYDLQGLHKQLA

SEQ ID NO: 31436 - protein, 167 aa, Oryza sativa (indica cultivar-group)
MAATHPLLLLLLAAAAAVVLVVAATPAAASGNGTSTPTAYEMLERYDFPRGILPVGVEGYELREDGSFEVYFPRDCEFMLARTWLVRYGARIAGAAASGRLTSLQGVYVKVLFVWLPVGEVDRSGDTLSFYIGPVSTSFPLSDFAHSPHCRGYDHLPAAAAAAAAAL

SEQ ID NO: 31437 - protein, 413 aa, Arabidopsis thaliana
  misc_feature (152)..(152): Xaa can be any naturally occurring amino acid
MAVEYVCCSPNFFIHIAVIVFLVLFAGLMSGLTLGLMSLSLVDLEVLAKSGTPEHRKYAAKILPVVKNQHLLLVTLLICNAAAMETLPIFLDGLVTAWGAILISVTLILLFGEIIPQSICSRYGLAIGATVAPFVRVLVFICLPVAWPISKXLFRRAELKTLVDFHGNEAGKGGELTHDETTIIAGALELSEKMVKDAMTPISDIFVIDINAKLDRDLMNLILEKGHSRVPVYYEQPTNIIGLVLVKNLLTINPDEEIPVKNVTIRRIPRVPEILPLYDILNEFQKGLSHMAVVVRQCDKIHPLPSKNGSVKEARVDVDSEGTPTPQERMLRTKRSLQKWKSFPNRASSFKGGSKSKKWSKDNDADILQLNGNPLPKLAEEEEAVGIITMEDVIEELLQEEIFDETDHHFEDS

SEQ ID NO: 31438 - protein, 436 aa, Propionibacterium acnes KPA171202
MMSVPNKKPEGGPTATLILDGQEYTLPVIAGTTGDRVIDISNLRQLTGGVTTFDPAFANTASCRSAISWIDGEEGVLTYRGLPIETLAKERVSFVETAWLLIFGHLPTEAQRDDFRNRLTEYSALHRSMNLHFNAFPPNGHPMAIMSSMINAMSTHDRPRITDEESFTDAAAKLMSKVRTIAAASYKASIGEPAIYPRYDLKYVENFMHMMFSLPYRAYEPDPVAARALNLFFVLHADHGQNCSTSTVRMVGSSGANLFTSCSAGVCALWGDRHGGANVNAVLALQRIRNSGLTPRQYLAKAKDSGERISGFGHRVYRNWDPRARIFRSVVGPLLDTMHKPDPLLDVAMELEEAVLADDYFIERRLYPNVDFYSGIVLRALGIPLNMFTVMFAIGRMAGWIAHWKEVFEDPTTRISRPRELYDGPVSTPWVPRGER

SEQ ID NO: 31439 - protein, 445 aa, Mycobacterium avium 104
MGSSDQATAHARAQAASARLFDDACAVIPGGVNSPVRAFTAVGGTPPFITAARGCRLTDADGNHYVDLVCSWGPMILGHAHPAVVEAVAKAAASGLSFGAPTPAESELAAEMIARVAPVERIRLVNSGTEATMSAVRLARGFTGRAKIVKFSGCYHGHVDALLADAGSGVATLGLPSSPGVTGATAADTIVLPYNDIDAVRQAFAEFGDQIAAVITEASPGNMGVVPPAPGFNAALRALTAEHGALLIVDEVMTGFRVSRSGWYGIDPVDADLFTFGKVMSGGLPAAAFGGRAEVMERLAPLGPVYQAGTLSGNPVAVAAGLATLRHADAAAYAALDANADRLARLLSDALTNAGVPHQIPRAGNMLSVFFTDTPVTDFASARATQTWRYPPFFHALLDAGVYPPCSAFETWFVSTALDDDAFDRIAAALPAAARAAAGADEGNS

SEQ ID NO: 31440 - protein, 333 aa, Triticum aestivum
  misc_feature (189)..(189): Xaa can be any naturally occurring amino acid
  misc_feature (241)..(241): Xaa can be any naturally occurring amino acid
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSVHVLGMRAAKSAGILCSYDPNVRLPLWPXARRRDGIMSIWTEATSSSEPQEVASLTRRTPPNEEDVPLVLVGGLQLLIATXGEKGVRTSPGFRGSGPGNRYSVTTAGPRVFAASSPYRFPEAPVSISGPPPRSSFPGAWGRWSTQGARRFRLRPTVGCSISRPTYIGVDAAVV

SEQ ID NO: 31441 - protein, 880 aa, Pseudomonas aeruginosa
MQDLDPVETQEWLDALESVLDREGEDRAHYLMTRMGELASRSGTQLPYAITTPYRNTIPVTHEARMPGDLFMERRDPLPLVRWNALAMVMRANKHDPDLGGHISTFASSATLYDIGFNYFFQAPTDEHGGDLVFFQGHASPGVYARAFLGRPHQRRNKLENFRQEVDGTACPPIRTPWLMPDFWQFPTVSMGLGPIQAIYQARFMKYLESRGFIPAGKQKVWCFMGDGECDEPESLGAISLAGREKLDNLIFVINCNLQRLDGPVRGNAKIIQELEGVFRGAEWNVNKVIWGRFWDPLFAKDTAGLLQQRMDEVIDGEYQNYKAKDGAYVREHFFGARPELLEMVKDLSDEEIWKLNRGGHDPYKVYAAYHQAVNHKGHPTVILAKTIKVYGTASGEAKNIAHNVKKVDSLRAFRDKFDIPVKDADLEKLPFYKPEEGSAEAKYLAERRAALGGFMPVRRQKSMSVPVPPLETLKAMLDGSGDREISTTMAFVRIISQLVKDKELGPRIVPIVPDEGRTFGMEGMFRQLGIYSSVGQLYEPVDKDQVMFYREDKKGQILEEGINEAGAMSSWIAAGTSYSTHNQPMLPFYIFYSMFGFQRIGDLAWAAGDSRAHGFLIGGTAGRTTLNGEGLQHEDGHSHLLASTIPNCRTYDPTYAYELAVIIREGSRQIEEQQDIFYYITVMNENYVQPAMPKGAEEGIIKGMYLLEEDKKEAAHHVQLLGSGTILREVEEAAKLLHNDFDIVADVWSVPSFNELRHDDLTLERWNRLHPGQKPKQSYVEECLGAPSRPVIASTDYMKLYAEQIRQWVPSKEYKVLGDGFGRSDSRKKLRNFFEVDRHWVVLAALEALADRGDIEPKVVAEAIAKYGIDPEKRNPLDC

SEQ ID NO: 31442 - protein, 908 aa, Prochlorococcus marinus str. MIT 9301
MLNLEEYFPFPLDDFQLEAIRAINSGNSVVLTAPTGSGKTLIGEFAIYRGLSHDSRVFYTTPLKALSNQKFRDFANQYGENKVGLLTGDVSINREAPILVMTTEIFRNMLYGEFDEFDDPLENLESVILDECHYMNDPQRGTVWEETIIHCPFRTQIIALSATIANADQLQNWIEKVHGPTVLINSDKRPVPLDFIFCSIKGLHPLLNNKGNGIHPNCKIWRAPKGQKMRGKVGRIMQPKSPSIGFVISKLAERNMLPAIYFIFSRRGCDKAIENIKDLTLVSYSEANMISQKLDVYLKNNQEAIKDKSQCEALKRGIASHHAGLLPAWKELVEELFQQGLIKVVFATETLAAGINMPARTTVISSLSKRTEDGHRLLFSSEFLQMSGRAGRRGKDTQGYVVTLQTRFEGAKEASALAISKPNSLESQFTPSYGMVLNLLQSYTLEKSKELIKRSFGSFLYLGESSGENIILENLDKDLIELKKITSNVSWKDFDAYEKLKNRLKEERRLLKILERQAAEKLSEEITNALPYIKDGSLISIKAPQIKRKIVPGLICKKIYESQKIKSLLCLTIDNLFILIKPSYIVSIFNDLDAIDVSGLEMPKMYFSGEVFRGDDMSQYYADRILEVSKKIDLQTPQYDLTMEVLAQQQQINNLEETVTDHPAHRFGDSRKLKKYRKRIIDVEQEINMRKKLLEDKENHNWRTFTDLIKILNHFGCLNNLELTEVGQTVGAIRSENELWIGLVLFSGYLDDLDPPDLAAIIQAICVDVRRPNLWCNFKPSLKVIDVFNELDGLRKLVASQQNKFHIEIPIYLETELTGIISEWARGKKWKDLVFNTSLDEGDVVRIIRRSIDVLSQVQYCIGVSNKLKSKAKLALKAINRFPVSESNDLIKVSEDINPATKRIENNS

SEQ ID NO: 31443 - protein, 546 aa, Pseudomonas aeruginosa
MSELIRVPDIGNGEGEVIELLVKPGDKVEADQSLLTLESDKASMEIPSPKAGVVKSIKAKVGDTLKEGDEILELEVEGGEQPAEAKAEAAPAQPEAPKAEAPAPAPSESKPAAPAAASVQDIKVPDIGSAGKANVIEVMVKAGDTVEADQSLITLESDKASMEIPSPASGVVESVSIKVGDEVGTGDLILKLKVEGAAPAAEEQPAAAPAQAAAPAAEQKPAAAVPAPAKADTPAPVGAPSRDGAKVHAGPAVRMLAREFGVELSEVKASGPKGRILKEDVQVFVKEQLQRAKSAVPAPRGAGIPPIPEVDFSKFGEVEEVAMTRLIEVGAANLHRSWLNVPHVTQFDQSDITDMEAFRVAQKAAAEKAGVKLTVLPILLKACAHLLKELPDFNSSLAPSGKALIRKKYVHIGFAVDTPDGLLVPVIRDVDRKSLLQLAAEAADLADKARNKKLSADAMQGACFTISSLGHIGGTGFTPIVNAPEVAILGVSKATMQPVWDGKAFQPRLMLPLSLSYDHRVINGAAAARFTKRLGELLADIRTLLL

SEQ ID NO: 31444 - protein, 166 aa, Brassica napus
ESNRDESYLRANEDAHDLLMSTHSALSRNSRGTHTSSTRSAMTNKFDVEELEMLLEAYFVQIDGTLNKLSTLREYVDDTEDYINIMLDDKQNHLLQMGVMLTTATLVMSAFIAVAGVFGMNITIELFKDEKAGPTRFAWTVIGGFIGSIFLYVGAIGWWKQKRLLE

SEQ ID NO: 31445 - protein, 336 aa, Picrophilus torridus DSM 9790
MFENMMDLGSLRHGDELIKRGFAKMTKGGVIMDVTTAEQARIAEKAGAVAVMALERVPADIRANGGVARMADPLKIKEIIDAVSIPVMAKVRIGHISEAYVLESLGVDMLDESEVLTPADPFFHINKKIYKVPVVCGARTFPEAVRRIFEGAAMIRTKGEAGTGNIIEAMRHIRKVNDGINVLLRLNESDMKKVAENIASSYFILRKETSKELFGYDNFPDMDDLYYGMDSDKIINGILKTLKEIKKYRRLPVVNFAAGGVATPSDAALMMKMGLDGVFVGSGIFKSKDPARMASAIVEAAENYEDYKTIADVSSGLQGMEGLEIDNIERLQERGW

SEQ ID NO: 31446 - protein, 219 aa, Xylella fastidiosa Dixon
MPPNAQHSPQTCDPKQMSSPLEYAKYLLSAHTIHQLPSDDGSEVAFAGRSNAGKSSVLNTLTRQNALARVSKTPGRTQQLVYFTVTPQRYLVDLPGYGYAKVPKELQIHWQTFIDSYFHQRQALRGLVVVMDIRHPLKEYDLQMLAYARQRGLPAQALLTKADKLGRGQQAQTLQKVRNELTKHFADHIDIQTFSSKSRQGVEQLHTVIETWLGLARSG

SEQ ID NO: 31447 - protein, 568 aa, Sinorhizobium meliloti 1021
MREANWGEAVGEVKSDIEIARAARKQPIMEVGAKLGIPPEHLLPYGHDKAKVSAEFIAAQNEKRNGRLILVTAINPTPAGEGKTTTTVGLGDGLNRIGKKAIVCIREASLGPCFGIKGGAAGGGYAQVVPMEDINLHFTGDFHAITSAHNLLSALIDNHIYWGNEQAIDIRRIAWRRVMDMNDRALRQIVGSLGGVANGYPRETGFDITVASEVMAILCLAMDIKDLEKRLGNIIIGYRRDKSPVFARDIKADGAMAVLLKDAMQPNLVQTLENNPAFVHGGPFANIAHGCNSVVATTTALKLADYVVTEAGFGADLGAEKFFDIKCRKAGLTPDAAVIVATVRAIKMNGGVKREDLGRESVEAVRKGCANLGRHIQNVKKFGVPVLVAINHFTSDTEAEVRAIKDYVRTLGSEAVLCKHWAEGSAGIEELAYKVVDLANAGHSQFSPLYPDEMPLFQKIETIAKDIYHASEVIADKLVREQLRTWEDQGYGDLPICMAKTQYSFSTDPNLRGAPTGHAVPIREVRLAAGAGFIVVITGEIMTMPGLPKVPSSERIRLNEQGYIEGLF

SEQ ID NO: 31448 - protein, 125 aa, Triticum aestivum
MAFWQARDFLFCGVCGTLLDFNSHRYASCPLCGFKRKAKDIEGKETRYAVTAEDIRRELKIKAFVVLESAPNLDIVVQRSLTERACPECNHHELEYYTKQLRSADEGQTIFYECPECGHAFNENT

SEQ ID NO: 31449 - protein, 411 aa, Xylella fastidiosa Dixon
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWSAAQGRLPEHRTIVTFRGSFHGRTLGAVTATAQPKYQEGYEPLPGGFRYVDFNHIEALEAAMVGGDVAAVMLEPIQGEGGVMPVVPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLVSVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRFGG

SEQ ID NO: 31450 - protein, 408 aa, Oryza sativa
MALHAAPPPPPPFTAGRLPTTSRRPCFSAGRIFRCSLPAAAARPRNAAFLAPLRTSSAVCTKAVSNSDGTPGTSSSPHVVCFGELLIDFVPTVNGVSLAEASAFKKAPGGAPANVAVGIARLGGSSAFIGKPQFELGRNIEKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 31451 - protein, 456 aa, Ashbya gossypii ATCC 10895
MGQILSNPVIDKEQGRSGDALTAYGMCAMQGWRMSMEDSHIVDLDISPEGSDDHIAYYCVFDGHGGASVAQFCGEQFSRILQQQKDFGGDAPNFARALVAAFIAADEELLKDPVLANDHSGCTATTLLVSHKQQLLVCANSGDSRTVLSTDKNAKALSFDHKPTLRSEQSRIMAADGFVEMDRVNGNLALSRAIGDFEFKSNPNLAPHEQIVTCVPDVLEHKLDYEKDEFVILACDGIWDCLSSQECVDLIHYGIQQGMGLQDIASRVIDVCCSPTTEGTGIGCDNMSFIVVALLRENETEDQWFERMRAKKYQGLLSFEAQRRKVFSYHYDFINEDDDNLFDISTKRPEERNRGSGSLPPMHATTREDPDEEDGANPADGRQHLYSLEELINAGGIQITQGGNNTSYIHGSALSEVLASLVGATGGIVARPAQRADAEDNVSEEQDGKKLEEIQE

SEQ ID NO: 31452 - protein, 260 aa, Brassica napus
SGVHIIDSLTRLANPDDEEDYISPRRESNKISLKIGKVQQENEEKPEEMTKRSSVLILGAGRVCRPAAEFLASVRNISSQQWYKTYLGGEQRDVRVIVASLYLKDAKETVEGMPEVEAVQLDVSDSESLLKYVSEVDVVLSLLPASCHASVAKTCIELKKHLITASYVDDETSGLHEKAKHAGITILGEMGLDPGIDHMMAMKMINEAHIRKGKVKSFTSYCGGLPSPAAANNPLAYKFSWNPAGAIRAGRNPAKYISNG

SEQ ID NO: 31453 - protein, 407 aa, Arabidopsis thaliana
MKSKKIDFSSKDIINNLPEPNLLCHILSFLPLKDSALTSLLSKKWRYLFAFRPNLDFDGLVNLHHREDSNRMFIDFLNRVLDRGELPSKVFMSESLVSLRIESQNVTAIDVEDVFLPKLKTLYLDTISIGKAGIGSDNVYFDFTNRSVSSKTFKRLKLCCIDYDQNPDTVSFDTPNLVYLEYSDYVAVKYPRVKFCSLVEASLNLQMTYDQCAQASYGFLVGNATDFLMGVSNVQILHLSDKSLEVLTFCCETIPVFNRLIHLTIKTHRHGEVGWESLPALLKNCPNLETLVFQGLHHKDTIKCEEVVGCLCKYFEDIPTCLSSSPVKVVKLEQDKHFLETMPNLEQMILYYNTPYDNDVLEVSKQLQILPRVASTKCKIQVISDNLSLSFSFSTSGLTFFNSTFPV

SEQ ID NO: 31454 - protein, 200 aa, Mesorhizobium sp. BNC1
MNEALRDLAGYIKEKLDGRVQDWMVAYDELTIFVEPGDIVDVLTFLKSDVQCQFFAFVDISGVDYPARERRFEVVYHLLSPRQNQRIRVKVSTDEETPIPSVIEVFPAANWYEREIYDLYGVLFTEHPDLRRILTDYGFEGHPLRKDFPLTGFVEVHYDDEAKRVVYQPVNLRQEFRNFDFLSPWEGTDYVLPGDEKAKQ

SEQ ID NO: 31455 - protein, 396 aa, Mesorhizobium sp. BNC1
MAETSIRNFNINFGPQHPAAHGVLRLVLELDGEVVERVDPHIGLLHRGTEKLIEYKTYLQAIPYFDRLDYVAPMNQEHAFALAIERLLGIDVPIRGQLIRVLYSEISRILNHLLNITTQAMDVGALTPPLWGFEEREKLMVFYERASGARMHAAYFRPGGVHQDLPEKLVEDIGKWIDPFLKTVDDLDELLTENRIFKQRNADIGIVSLEDAWAWGFSGVMVRGSGAAWDLRKSQPYECYPEMDFDIPVGKNGDCYDRYLIRMEEMRQSAKIMRQCVERLLGKERVGPVSNMDGKVVPPKRAAMKRSMESLIHHFKLYTEGYHVPAGEVYAAVEAPKGEFGVYLVADGTNKPYRCKLRAPGFAHLQAMDFMCRGHLLADVTAVLGSLDIVFGEVDR

SEQ ID NO: 31456 - protein, 137 aa, Escherichia coli O157:H7 EDL933
MLKRYLVLSVVTAAFSLPSLVYAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 31457 - protein, 497 aa, uncultured archaeon GZfos18C8
MRNVMPAGTLPADTLPAGTLPVAVAFGTCLTSCPYFAQASQTFNSVPSRITRCAFPRMLLPHISHCIGIAYHPIFHKGLCVVRIFSLIMDLEMDVDADIDSTEFSKYVVDRMQQLELKNNLLEKQYQKVETEKQLAEDQRLKYERELRKLRSELDKLKTTPQLVGTLVNVLEEGKSIVRSSTGPEFIVGSSQFIKDGDLKPGVQVALNKEHLSIVAVIPGSEDPLVQAMEVIESPDIDYNQIGGLDKQIEVLRGAVEFALTKPEIFERIGIDPPKGVLLFGPPGTGKTLLAKAVATRTDATFIRVVGSELVQKYIGEGARMVRDVFEMARKKAPAIIFIDELDSIGAVRLDDASSGGREVQRTLMQLLAEMDGFNSRGDVCILAATNRWDILDPALIRPGRFDRLVYVPIPDREARVKILLIHTKKMRLAGDVDFDRIVTLTEDANGATLRAIVMEAGMCAVREDADAVYQKDFEDAIKHIMNPEGMVDRYSEGMFV

SEQ ID NO: 31458 - protein, 353 aa, Coccidioides immitis RS
MVQPGAQGGSRKISFNVSDQYDIQDVIGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPLKALFPKTSDLALDLLEKLLAFNPVKRITVEEALRHPYLEPYHDPDDEPTAEPIPEEFFDFDKNKDSLSKEQLKVLIYEEIMR

SEQ ID NO: 31459 - protein, 117 aa, Propionibacterium acnes KPA171202
MSNIIDEIDKASMRDDIPEFRPGDSVKVHVKVVEGSRTRVQVFSGIVISRTGGGVQESFTVRKLSFGTGVERTFPLHSPIIDKIEVDRHGAVRRAKLYYLRGRRGKAAKIKERGSAR

SEQ ID NO: 31460 - protein, 947 aa, Saccharum officinarum
MAASVSGATICLQKPGSKGRRARDATSFARRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQNQDAGSILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGTGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 31461 - protein, 302 aa, Salinibacter ruber DSM 13855
MAHDMLFRGVAPALVTPFTSDDDIDEAAFRRLIDAQIEGGVSALVVLGTTGENPTITEDERRRIVDAALDAADGRVPVIVGTGTNNTDESVAFSKAAVDAGADGLLVVGPYYNKPSQAGFAAHVETIAAAAEAPIILYNVPGRTSFNIAPETALHLAEEVPHVAGIKEASGDIEQIDDLLAHRPDGFGVYSGDDEMTLPLLAMGGDGAVSVISNALPGPFCELVAAGLDDDLATARDRHAELLPAMRACFLETNPVPIKDVCAALGWMEPHVRLPLTPMDERSPVRQRVLSAFDDLIDVTVA

SEQ ID NO: 31462 - protein, 317 aa, Parvularcula bermudensis HTCC2503
MLSGQLESTNQVILDHLASSVPLIPEVARHLIAAGGKRLRPLMTLAAAELCGETGEGPRLLAGAVELIHAATLLHDDVVDESALRRGLRTANIVFGNKESVLVGDFLFARAFELMVRTGSIEVLGILSKASCIIAEGEVLQLTTSQNLETPQTIYLDVISAKTAALFAAAAEAGAVVAGGDAEKVAAMRAYGLNFGIAYQLVDDALDYQSSGAVLGKTAGDDFREGKMTLPVIRAYAASTSDEERQFWQRTIRDKDQRPDDFARANELMRRDRIVEACLQEARGYAEAAASSLAVFPVGDLRGTLEDLAIGSAERTT

SEQ ID NO: 31463 - protein, 634 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDTNRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQNAAYKEEILPNAVRRRVAVEMGASQNWYKYVGLDGAVLGIDTFGASA

SEQ ID NO: 31464 - protein, 163 aa, Mesorhizobium sp. BNC1
MSALAQAAKSLLLKEFFGAVVLSMRQFFAPKATLNYPHEKGPLSPRFRGEHALRRYPNGEERCIACKLCEAICPAQAITIEAGPRRNDGTRRTVRYDIDMVKCIYCGFCQEACPVDAIVEGPNFEFATETREELYYDKDKLLANGDRWERELARNIALDAPYR

SEQ ID NO: 31465 - protein, 162 aa, Zea mays
  misc_feature (90)..(90): Xaa can be any naturally occurring amino acid
  misc_feature (153)..(153): Xaa can be any naturally occurring amino acid
MAAPLRRSLPSLGRALLTPPTPAPARMLSAEASDALVEIKPGEIGMVSGIPEEHLRRKVLIYSPARTASQQGSGKVGRWKINFLSTQKWXENPLMGWTSTGDPYANVGEAGLTFDSAESAKAFAEKHGWNYVVRKRHAPLLRPKAYAENFKWXRGPPKAEQA

SEQ ID NO: 31466 - protein, 440 aa, Burkholderia xenovorans LB400
MSSQQQAAQLAQSAATLHSVPSYLNKDDLGPWGNYLRQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRTLSRGELERVTRRYTSEIGIIIGPNTDIPAPDVNTNEQIMAWMMDTYSMNQGQTATGVVTGKPITLGGSLGRREATGRGVFVVASEAARRIGVDIEGARIAVQGFGNVGGIAARLFQEAGSKLVAVQDHTGSLYKSTGIDAVALLEHVAKHGGVGGFPEADAVSNEEFWTVESDILIPAALENQITEKNAAKIRTKIVVEGANGPTTTAADDILHDRGILVIPDVVANAGGVTVSYFEWVQDFSSFFWTEDEINQRLERVMREAFAAVWQVSSEQKVSVRTAAFIVACKRILEARELRGLYP

SEQ ID NO: 31467 - protein, 442 aa, Sinorhizobium meliloti 1021
MSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGMNHVLYTNSGSESVDTALKVALAYHRAKGNGSRFRLIGRERGYHGVNFGGISVGGIVANRKMFGTLLTGVDHLPHTHLPAKNAFSRGEPEHGADLAAELERIVTLHDASTVAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYREEGLLTRAAELAPYWEEALHSLKDCPHVIDIRNIGLIGAVELEPIAGEPTKRAFSAFLKAYEKGLLIRTTGDIIALSPPLIIEKRQIDELFDKLRDVLKNNI

SEQ ID NO: 31468 - protein, 460 aa, Oryza sativa (japonica cultivar-group)
MEAAAPASHAAAARGRLRSRQYAVLGLTFAAYASFHASRKPPSIVKAVLSADWAPFSGPRGPHRLGELDVAFLSAYAAAMFAAGHLADRADLRGLLAAAMLASGATSAALGAAYFLGSASGVVQSAGWPCVVAVVGNWFGHASSRGTIMGVWNSHTSVGNIAGSVLSAAVLEFGWGWSFLVPAFVIAALGVVVLVFLIAHPMDAGLDIEAIEVEMNGGSGEEVELLGEDKKEDEDVLEVEAVAELPRAIGFLEAWRLPGVAPFAFCLFFSKLVAYTFLYWLPFYIRHNAVAGQFLSHKASGILSVVFDIGGVLGGISAGLLSDKIGARAVTSALFLFLSIPALILYRTYGSISMHHNIGLMFLAGYFVNGPYSLITTAVATDLGTQDAIKGNSRALATVSAIIDGTGSVGAALGPLLTGYISTRGWNSVFFMLIVSISLALVFLIRLAKDEIVSKISARH

SEQ ID NO: 31469 - protein, 165 aa, Burkholderia xenovorans LB400
MILIAMGVSGAGKTRIGEMLAERLHCAFTDGDAFHSAANKEKMHHGIPLTDEDRWPWLKTIRAAIEEKQTAGETAVFTCSSLKRSYRDVLRDGDKDVCFVYLKGSREVLEQRLTTRTGHFFDPSLLQSQLDTLEEPGADEAITVSIELSPEEIVDSVLIQVEARK

SEQ ID NO: 31470 - protein, 421 aa, Bacillus clausii KSM-K16
MEKMDENQEDKLDVLAATQSIIHKALKKLGYPDEMYELLKEPVRMLTVRIPVRMDDGSTKIFTGYRAQHNDAVGPTKGGVRFHPDVSEKEVKALSIWMSLKAGIVNLPYGGGKGGIVCDPRQMSFREVERLSRGYVRAISQIVGPTKDIPAPDVFTNSQIMAWMLDEYSRIREFDSPNFITGKPLVLGGSHGREAATAKGVTICIMEAAKKKGIDLEGARVIIQGFGNAGSFLAKFMADAGALVVGIADAYGALYAEEGLDIDYLLDRRDSFGTVTNLFKDTITNEELLEKDCDILVPAAIENQITSHNAGKLKAAIVVEAANGPTTLEATQILAERGILLVPDVLASAGGVTVSYFEWVQNNQGYYWTDEEVEGRLRTVLTEAFNNIYNLALRRKVDMRLAAYMVGVRRMAEASRFRGWV

SEQ ID NO: 31471 - protein, 336 aa, Staphylococcus aureus subsp. aureus MW2
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMENGTITGRMVIKF

SEQ ID NO: 31472 - protein, 359 aa, Nostoc sp. PCC 7120
MSKSRRIGILTSGGDCSGLNAVIRAVVHCASGKGWEVFGIRQATLGLMARPPQVSKLEIDQVDPLLTSGGTMLGTTNKGDPFAFPMPDGSFCDRSSEIIAGYHQLDLDALIGIGGDGSLAILRRLAQQGAINLVGIPKTIDNDIGITEHAIGFDTAVNIATEALDRLHFTAASHSRVMILEVMGRDAGHIALAAGIAGGADVILIPEILYSMDDICYHIKHRQEEGKNYCLIIVSEAVRTQDGEILTLTNRLGQSRYGGIGEYLADQISDRIGAETRVTVLGHIQRGGIASPLDRLVASAFGVAAVNLIEAAKYDYMVAWQNRQVITVPIEEAIAQYKAVNPEDALVKTARGLGIYLGE

SEQ ID NO: 31473 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 31474 - protein, 209 aa, Neisseria meningitidis serogroup B
MNLFQNAKFFTTINHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWLDAADAAASSPEEN

SEQ ID NO: 31475 - protein, 528 aa, Thinopyrum ponticum
MALEAAYHYLQRAVGHGTSTEALLLTVLLLLIIRVAWVRAFTTTTASTKCKQQLPPTPPGKLPIIGHLHLIGSHPHVSFRDLAAKHGRDGLMLVHVGAVPTVVVSTPQAAEAVLRTHDHVFASRPRNPVADIIRYNSTDIAFAPYGDYWRRARKVVNTHPLSVKMVYSKRHDREEEVRLVVAKICELAMAAPGKALDMTELLGGYASDFVCRAVLGESHRKHGRNELFRELTEISASLLGGFNLEDYFPRLANLDVFLRVVCSKAMGVSKRWDNLFNELIAEYEHGKEDNAEDFVHLLLSLKKEYGLSTDNVKAILVNMLEAAIETSFLVLEYSMAELINNRHVMAKVRKEVRESTPKGEKLDLIMEEDLSRMPYLKATIKEAMRIHPPAPFLLPHFSTNDCEVNGYTIPAGTRVIVNAWALARDPSHWERVEEFYPERFLQEGRDAEVDMYGKDIRFVPFGAGRRICAGATFAIATVEVMLANLIYHIDWELPSEMEAIGAKVNMTDQFGMTLRRTERLHLVPKIYK

SEQ ID NO: 31476 - protein, 359 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLFEELKLACKNIYAEDLFIRMERHILDTLDWDISIPTPASYIPVLDPIFFLVLDASMFVPNLFKFPASKIACSVMNIVNEHVGSFLLTHPSMESYRKDDNFLWPEDLDTVTSYMENMSKRYANEECTDLLFSSLGRISSILAKKYPEQCAMAAWCNMTEKDTERTL

SEQ ID NO: 31477 - protein, 480 aa, Haloarcula marismortui ATCC 43049
MLTGSEMGVVDENAAALGVPRKQLMESSGHAVARAVRTLADPGDQVTIVAGRGNNGGDALVTARFLDEYDLRVLLLGRPDAISTTIARENWDALQHAEYPTEPVKDSSAFDLGSPDIVVDAMLGTGIAGALREPEATAATAMNESDATVLSVDVPSGLDAETGRLAENAVDADHVVTFHDTKPGLPDLDVPVTVADIGIPDTAELFIERGDLTRLERDPASHKGDNGEVLVVGGGPYTGAPALTAQAALRSGADLVRVACPAVVAREIQSYSENLIMRPFDGDHLAPHHVDRLAELAADHDTLIVGPGLGNADATLDAVADLLSGFAGTAVVDADALSVVPDIETDADLVCTPHQGELLGMGGETAEDWRERADLVESFAAEVGQTLLVKGPYDIVSNGERTRVGRTGNPGMTVGGTGDVLAGVTGALASVQDPLDAAAIAAYTVGSVGDRVVDDRGYGLVATDLLDEIPSVLWQRDAEP

SEQ ID NO: 31478 - protein, 480 aa, Triticum aestivum
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 31479 - protein, 401 aa, Triticum aestivum
MATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 31480 - protein, 404 aa, Ashbya gossypii ATCC 10895
MTAQASDNIPNIRGRRPRGVSDHSGAKLPQYDPGSHPPGYFKPYMSAFRFKCREYLLPFTANQSDYIALLQRQYRTPWRDSYFAYTALLGSHMFYVIALPIPRWLGYGVVTRDLVYVLGYSIYITGYLKDYFCLPRPASPPCHRIALSKYTTKEYGAPSSHCANATAVTLLFLVYAWRSRMDCSALQFFLCLVLLAVYYVTLTLGRIYCGMHGLLDIVTGSAIGVFCFTVRLITRDYLSFDQATAQFSWWFPFFAVAIGLLMLFYHVEPVDPCPCFEDSVAFIGVITGIEAAEWLFPRLFHETTSQYLVFQWSYVAIPAACARIVAGILCVLLWKSVLSKKLVYSLLSVLMTDDRPAAHAEHPRTGHVRPLVPRIDILGRFFVYMGVPMTVIIVCPTVFALLGI

SEQ ID NO: 31481 - protein, 394 aa, Bacillus megaterium
MNKKTLKDIDVKGKRVFCRVDFNVPMKDGKVTDETRIRAAIPTIQYLVEQGAKVILASHLGRPKGEVVEELRLNAVAERLQALLGKDVAKADEAFGEEVKKTIDGMSEGDVLVLENVRFYPGEEKNDPELAKAFAELADVYVNDAFGAAHRAHASTEGIAQHIPAVAGFLMEKELDVLSKALSNPERPFTAIVGGAKVKDKIGVIDHLLDKVDNLIIGGGLSYTFIKALGHEVGKSLLEEDKIELAKSFMEKAKKNGVNFYMPVDVVVADDFSNDANIQVVSIEDIPSDWEGLDAGPKTREIYADVIKNSKLVIWNGPMGVFELDAFANGTKAVAEALAEATDTYSVIGGGDSAAAVEKFNLADKMSHISTGGGASLEFMEGKELPGVVALNDK

SEQ ID NO: 31482 - protein, 394 aa, Geobacillus stearothermophilus
MNKKTIRDVDVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKNDPELAKAFAELADLYVNDAFGAAHRAHASTEGIAHYLPAVAGFLMEKELEVLGKALSNPDRPFTAIIGGAKVKDKIGVIDNLLEKVDNLIIGGGLAYTFVKALGHDVGKSLLEEDKIELAKSFMEKAKEKGVRFYMPVDVVVADRFANDANTKVVPIDAIPADWSALDIGPKTRELYRDVIRESKLVVWNGPMGVFEMDAFAHGTKAIAEALAEALDTYSVIGGGDSAAAVEKFGLADKMDHISTGGGASLEFMEGKQLPGVVALEDK

SEQ ID NO: 31483 - protein, 407 aa, Ashbya gossypii ATCC 10895
MSAACLASWVVTACIVASVCSVVLSAHTMWSQLINYRKPQQQRLVLRIQLMVPIFSLTCFIAVVKPDIAMVLIDPVREIYESFVIYTFFSLLTLLLGGERNILVNLAPEQKRIQHPIPVVGRWVLPMVDMADPKAFLAVKRGILQYVWFKPVYCLGMSAFQVLEWDLGCKWLTLVYNASASWSLYNLALFWKCLYNELRKYNPWPKFLCVKLIIFASYWQGMVITLLHYLNVIQDCEGTNMGYVYHNVALCLEMVAFALAHRWAFSWTEYSAQNIPLGARMHFWYAVRDWLGWKDLIWDFRTTFIGSDYTYRNFDAANTNPEGRIKRINDGLRYTNCGAERHWINDKQPRYGSMDEDSWVDLASELPIYVPEDQNYPVVWDARSYRYTRGIRQLRENIIRERTSSAV

SEQ ID NO: 31484 - protein, 396 aa, Gossypium hirsutum
  misc_feature (195)..(195): Xaa can be any naturally occurring amino acid
  misc_feature (284)..(284): Xaa can be any naturally occurring amino acid
  misc_feature (301)..(301): Xaa can be any naturally occurring amino acid
MSLSLQSSPSSFLSSSLPKLRLGFANGCPSSSLLFKFNASFPAIRASSGFSSSLDTGLRTELDAVSTFSEIVPDTVIFDDFEKFPPTAATVSSSLLLGILSLPDTIFRNAVDLALADSTCSRLDNPELRLACFFNKALVNVGGDLAKLVPGRVSTEVDARLAYDTHGIIRRVHDLLKLYNEIDVPPERLLFKIPXTWQGIEASRLLESEGIQTHLTFVYSFAQAAAAAQAGASVIQIFVGRVRDWARNHSGDPEIEAAIQRGEDPGLGLVTKAYNYIHKYGHKXKAYGLQQFETKQDLFSXLGVDYIIAPLKILQSLKESITAPDEKYSYIRRLSPQSAANHDFTAEELTKWDQLSLASAMGPASMQLLAAGLEGYVNQANRVEELLDKIWPPPNV

SEQ ID NO: 31485 - protein, 503 aa, Triticum aestivum
MAMARCLLLLAIVSLAAAEGGGNNSTDSAGQVRLSCGASAPATDSDGRAWEGDSTSKFLASTNAGVAARASYQDPPLPSSVPYVTARVFASSHTYTFLVSPGRVFLRLYFYPADYGNRSASGALFGVTAGGVTLLRDFNASQAALALDAAYLVREFSLNVSSGGKLDVTFAPSPGASSHYAFVNGIEIVPTPDVFTAPVPTFANGGRPDRMPIRADTAFQTMYRLNVGGEAVSPADDSGRFYRTWNTDIPYIFGAAVGVSFEKDSNVTIRYPPSVPPHIAPEGVYASARSMGPYAQINLNYNLTWILPVDAGFYYLLRFHFCEVLYPITKVNQRSFFIYINNQTAQEQMDVIGRSGGIGVPVYTDYLVVTTGSGQTDMWVALHPDLSSRPEYFDAILNGLEVFKLQTYGSNNLAGANLPIPQKQPYQGEFKRKSAVAAAVGGAVAGGLLAVLIGCLCACGICRRGRKATSVVVCEPEAVPEQPAHHGLLSSTKSSALFKSGQT

SEQ ID NO: 31486 - protein, 2240 aa, Ashbya gossypii ATCC 10895
MVCAEAAGRHEANTNSMQAKLTDLIPTAPVTPALDADHGRLMTLELKDGTALQGYSFGAPVAAAGELVFQTGMVGYPESITDPSYEGQILVITYPMVGNYGVPDRQLMDELVESLPRYFESNRIHVAGLVVAHYTEKHSHWLAQSSLGQWLREEGVPAIYGVDTRALTKHLRDSGSMLGRLAVQKADANLQEATGDQWRACFDVPEWVDPNVQNLVAKVSVNEPRLYTPRLESAVRGPDGKILRVVAVDVGMKYNQIRCFVQRGVELLVVPWDYDFQEEEYDGLFISNGPGDPSVLTELASRLSGALLEKKTPIFGICLGHQLLARASGASTLKLKFGNRGHNIPCTSTISGRCYITSQNHGFAVDVDTLADGWKPLFVNANDGSNEGIYHTELPYFSVQFHPESTPGPRDTEFLFDVFINSILEHKNSGVLKSVEFPGGRVEDHLKAHPRQEPKKVLVLGSGGLSIGQAGEFDYSGSQAIKALKEEGIYTILINPNIATIQTSKGLADKVYFLPVTAEFVRKVILHERPDAIYVTFGGQTALSVGIEMKDEFEALGVKVLGTSIDTIITTEDRELFANAMDEINEKCAKSKAASTVDEALEAVKDIGFPVIVRAAYALGGLGSGFASNEQELVDLCNVAFASSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEVKNSVTQSTCACFEPSLDYCVVKMPRWDLKKFTRVSTLLSSSMKSVGEVMSVGRTFEEAIQKAIRSTDYSNLGFNETDMELNIDEELANPSDLRIFAIANAFAKLNYSVEKVWQLTNIDRWFLEKLHSLITFGREVEAFGTKEALPRSLMKQAKQLGFDDRQIAKFLNSNEVAIRRVRKEYGIVPFVKQIDTVAAEFPAFTNYLYLTYNASEHDLEFNDHGVMVLGSGVYRIGSSVEFDWCAVTAVRTLRQNNVKTIMVNYNPETVSTDYDEVDRLYFETINMERILDIYEVESSAGVVVSMGGQTSNNIAMSLHRENVKILGTSPEMIDSAENRYKFSRMLDQIEVDQPAWKELTSMEEAEDFANKVGYPVLVRPSYVLSGAAMNTVYSKDDLESYLNQAVEVSREYPVVITKYIENAKEIEMDAVAKDGEMIMHVVSEHVENAGVHSGDATLIVPPQDLDPETVRRIVDATAKIGRALKITGPYNIQFIAKNNEIKVIECNVRASRSFPFISKVIGVNLIEMATKAIMGIPVTPYPIEKLPDDYVAIKVPQFSFPRLAGADPVLGVEMASTGEVATFGHSKYEAYLKSLLSTGFKLPKKNILLSIGSYKEKQEMLPAVQKLYKMGYKLFATAGTADFISEHGIPVQFLEFLNEDDEKSEYSLTQHLANNKIDLYINLPSANRFRRPASYVSKGYRTRRMAVDYSVPLVTNVKCAKLLIEALARNLTLDVSERDAQTSHRTVTIPGLINISAYVPNISNVTQGPAELKEVTRLSVESGFTYSQIMPRSTVGPVITNATSLKAAQSVCENSAYTDFGFTVAATANNVEEVASLANQATALFIPYRELTNKVSLVAEHLKNWPVEKQIIAEAKTSDLASVILLASLQGRPIHITGVSHKEDLALIMTVKEKMNNVTCDVNIHSLFVSQDDYPEALFLPTKEDQDFFWRNLQEIDAFSIGSMPTLLATVTSNKVVTGLGIKEALPLLLSAVNDGRLTLEDIVERLHDNPAKIFNIPEQDAKVEIDLDFTFRHTKRWTPYTKGGLTGGVERVLLDGQTVVLSGDLVASAALGEAVVPTSNNYTSTPLLNAEPLHSFVPPSSSGKKRFSFSRERGNSFASAGDHEEAVIDQPLEQRLMSSRPPKELSPPSALRELVRAHNPFRGRNILSVNQFKRSDFHALFAVAQELRAAVEREGVLELMKGRLLTTIFYEPSTRTSSSFIAAMERLGGRTVNINTSASSVKKGETLQDTIRTLACYSDAIVLRHPDEMSAHIASKYSPVPIINGGNGSREHPTQAFLDLFTIREELGTVNGISVTFMGDLKYGRPVHSLCRLLKHYQVRINLVSPKELSLPDGLRNELIDAGLLGIESESLTPEIISRSDVLYCTRVQQERFEREEDYLRLKNTYIVDNKILAHAKQQMVVMHPLPRVSEIREEVDYDHRAAYFRQMRYGLFVRMALLAMVMGVNL

SEQ ID NO: 31487 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINAAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 31488 - protein, 352 aa, Oryza sativa (japonica cultivar-group)
MAPAIAKPLLSDLVAQSGQVPSSHIRPVGDRPDLDNVDHESGAGIPVIDLKQLDGPDRRKVVEAIGSACETDGFFMVKNHGIPEEVVEGMLRVAREFFHMPESERLKCYSDDPKKAIRLSTSFNVRTEKVSNWRDFLRLHCYPLESFIDQWPSNPPSFRQVVGTYSREARALALRLLEAISESLGLERGHMVSAMGRQAQHMAVNYYPPCPQPELTYGLPGHKDPNAITLLLQDGVSGLQVQRNGRWVAVNPVPDALVINIGDQIQALSNDRYKSVLHRVIVNSESERISVPTFYCPSPDAVIAPAGALVDGALHPLAYRPFKYQAYYDEFWNMGLQSASCLDRFRPNDQAV

SEQ ID NO: 31489 - protein, 212 aa, Triticum aestivum
MDTAAAGSPREGHRTVCSEPPKRPAGRTKFRETRHPLYRGVRRRGRLGQWVCEVRVRGAQGYRLWLGTFTTAEMAARAHDSAVLALLDRAACLNFADSAWRMLPVLAAGSSRFSSAREIKDAVAIAVLEFQRRRPVVSTSEMHDGEKDAQGSPTPSELSTSSDLLDEHWFGGMDAGSYYASLAQGMLMEPPSARTWSEDGGEYSAVYTPLWN

SEQ ID NO: 31490 - protein, 104 aa, Medicago truncatula
MSCRSMLIMSHWHFLWAIGMSHLRATSDPQIWKKGPTFGMPGVHVDGMDVLKVRQVAKEAIGRARRGEGPTLIECETYRFRGHSLADPDELCNPAGRDPISSLK

SEQ ID NO: 31491 - protein, 60 aa, Oryza sativa (japonica cultivar-group)
TAKIIRDRLRWCYRIEGVNHHQKCRHLVDQYLEATRGVGWGKDARPPELHDPKKVVEADE

SEQ ID NO: 31492 - protein, 528 aa, Thinopyrum ponticum
MALEAAYHYLQRAVGHGTSTEALLLTVLLPLIIRLAWVRAFATTTASAKCKQQLPPTPPGKLPIIGHLHLIGSHPHVSFCDLAAKHGRDGLMLVHVGAVPTVVVSTPQAAEAVLRTHDHVFAPRPRNPVADIIRYNSTDIAFAPYGDYWRRARKVVNTHLLSVKTVYSKRHDREEEVRLVVAKIRELATAAPGKALDMTELLGGYASDFVCRAVLGESHRKNGRNEPFRELTEISASLLGGFNLEDYFPRLANLDVFLRVVCSKAMGVSKRWDNLFNELIAEYEHGKEDNAEDFVHLLLSLKKEYGLSTDNVKAILVNMFEAAIETSFLVLEYSMAELINNRHVMVKVQKEVRESTPGGEKLDLIMEEDLSGMPYLKATIKEAMRIHPPAPFLLPHFSTNDCEVNGYTIPAGTRVIVNAWALARDPSHWERAEEFYPERFLQEGRDAEVNMYGKDIRFVPFGAGRRICAGATFAIAIVEVMLANLIYHFDWELPSEMEAIGAKVDMSDQFGMTLRRTERLHLVPKIYK

SEQ ID NO: 31493 - protein, 254 aa, Brucella melitensis 16M
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPIWAIGTGLTPTVQDVRAAHAFMREQLIERFGAKGAHLRLLYGGSVKPSNAAELLGVADVDGALVGGASLKAADFLAICETYRNL

SEQ ID NO: 31494 - protein, 266 aa, Coprinopsis cinerea okayama7#130
MFVRQYKLHVMTLAGQSVTCFSPDQDPGFGIRNVAWHPNGLFLVVGGWDDKIHILDCLSWSPVGVLELSSRISGSVTVWREPSRWLEATEGRGFLSYEKLQGTQTLQVNRVDLTRPYPKSGILQLEFNITGSLLLVRFGLLNTLPCVFPLQETTPNVLHIFDFPSPKDQFLPRLRTVLIHSQPILHARWNPVRKGNLALCCGTQSVYTWSDEWVGEAGQQEDMAECIGVPAKQFETKDIKWSPDGKGIILMDREQFCCSFEVEEEF

SEQ ID NO: 31495 - protein, 264 aa, Triticum aestivum
  misc_feature (54)..(54): Xaa can be any naturally occurring amino acid
MAVDYGSREERWSLAGTTALVTGGSKGIGHAIVEELAGFGARVHTCSRNAVELXEECRRRWGEKNLQVTVSVCDVSIRADREKLMETVRETFNSKLDILVNNAGQLLFKPTTECTVVEYSNLLTTNLESSFHLSQLAHPLLIHASIAGGGSIINMSSIGGSIGYAGSAIYATTKGAMNQLTRSLATEWASDKIRVNGIAPGFVTTDMLKDIDTEYVKKEHSKTPLGRSGKPMEIASAVSFLSMPAASFITGQVICIDGGRTISA

SEQ ID NO: 31496 - protein, 262 aa, Rickettsia sp. ARANHA
LAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQW

SEQ ID NO: 31497 - protein, 409 aa, Methanobacterium bryantii
MSLPFYTIDDFNLEDKTVLVRVDINSPVDPSTGSILDDTKIKLHAETIDEISKKGAKTVVLAHQSRPGKKDFTTLQQHAKALSNILNRPVDYIDDIFGTAAREEIKRLKKGDILLLENVRFYPEEILKRDPHQQAETHMVRKLYPIIDIFINDAFAAAHRSQPSLVGFAVKLPSGAGRIMEKELKSLYGAVDNAEKPCVYVLGGVKVDDSIMVLENVLRNGSADYVLTTGLVANIFLWASGINLGKYNEDFIINKGYIDFVEKGKQLLEEFDGQIKMPDDVAVCVDNARVEYCTKNIPNKPIYDIGTNTITEYAKFIRDAKTIFANGPAGVFEQEGFSIGTEDILNTIASSNGYSIIGGGHLAAAANQMGLSSGITHISSGGGASINLLAGEKLPVVEILTEVKMKGRK

SEQ ID NO: 31498 - protein, 410 aa, Methanothermus fervidus
MFKFYTMDDFDYSGSRVLVRVDINSPVDPHTGRILDDTRMRLHSKTLKELVDENAKVAILAHQSRPGKRDFTTMEEHSKVLSNILDMPVTYVEDIFGCAARESIRNMENGDIILLENVRFYSEEVLKRDPKVQAETHLVRKLSSVVDYYINDAFAAAHRSQPSLVGFPLKLPSAAGRLMEREVKTLYKIIKNVEKPCVYILGGVKIDDSIMIMKNILKNGSADYILTSGLVANVFLEASGIDIKEKNRKILYRKNYKKFIKMAKKLKDKYGEKILTPVDVAINKNGKRIDVPIDDIPNFPIYDIGMETIKIYAEKIREAKTIFANGPAGVFEEQQFSIGTEDLLNAIASSNAFSVIAGGHLAAAAEKMGISNKINHISSGGGACIAFLSGEELPAIKVLEEARKRSDKYI

SEQ ID NO: 31499 - protein, 415 aa, Penicillium chrysogenum
MSLSNKLPVTDVDLKGKRVLIRVDFNVPLDENENVTNPQRIVGALPTIKYAIDNGRKAVVLMSHLGRPDGKVNPKYSLKPVVPVLEELLGKSVTFTEDCIGPQTEETVNKASDGQVILLENLRFHAEEEGSSKDAEGKKVKADKADVDRSASLTALGDVYVNDAFGTAQRAHSSMVGVDLPQKAAGFLVKKELEYFAKALESPARPFLAILGGAKVSDKIPVIDNLLPKVNSLIIIGGMALTFKKTLENVKIGNSLFDEAGSKILGEIVEKAKKHNVEIVLPVDYVTADKFSADATVGSATTQRIPDGYMGSDVGPESVKLYQKTIAEAKTILWNGPPGVFELKPSPRPTEATLDAAVKAAESGSIVIIGGGDTATVAAKYKAEDKISHVSTGGGASLELLEGKELPGVAALSSK

SEQ ID NO: 31500 - protein, 480 aa, Haloarcula marismortui ATCC 43049
MTQMAAARNGTVTEEMERVAEREGVDPAFVRQQVADGQAVIPANVGHDSLDPMIIGREFATKVNANIGNSEETSDIEGELEKLHTAVHYGADTVMDLSTGRNLDEIRSANVTHSPVPVGTVPIYEAVKRASDPSEITHELLLDVIEKQAKQGVDYMTIHAGVRMEHLPLTDGRKTGIVSRGGSILAKWIEENGMENPLYTKFEAICEIFREYDVTFSLGDGLRPGCLADAGDDAQFAELDTLGELTRTAWKHDVQVMVEGPGHVPMDQVAEQVERQQEVCDGAPFYVLGPLVTDVAPGYDHITSAIGATEAGRAGAAMLCYVTPKEHLGLPEKSDVRDGLAAYRIAAHAADVANGREGARDWDDALSEARYAFDWREQFDLALDPDRAREYHDQTLPGDNYKEARFCSMCGVEFCSMRIDQDARSDGDMESIEADADDRTPLEDSSAAAVNRPPVGTHDGADIPGPDADMPADTEGSADD

SEQ ID NO: 31501 - protein, 416 aa, Hypocrea jecorina
MSLSNKLSITDVDLKGKRVLIRVDFNVPLDENKKITNNQRIVGAIPTIKHALDNGAKAVVLMSHLGRPNGAVNPKYSLKPVVPELERLLGKPVTFARDCVGPEVESIVNDADNGAVILLENLRFHIEEEGSAKDKDGNKTKADKAKVEEFRKGLTALGDIYINDAFGTAHRAHSSMVGVDLPQKAAGFLMKKELDYFAKALESPQRPFLAILGGAKVSDKIQLIDNLLDKVDTLIVCGGMAFTFKKVLNNIPIGTSLFDEAGAKTCPSCREAKAKNVKLVLPVDYITADKFDKDANTGTATDESGIPDGWMGLDCGEKSIELYKEAIADAKTILWNGPAGVFEFDKFANGTKATLDAVVEGCKNGKIVIIGGGDTATVAAKYGVEDKLSHVSTGGGASLELLEGKELPGVVALSSK

SEQ ID NO: 31502 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRITTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 31503 - protein, 309 aa, Escherichia coli K12
MIQQGDLMPQSALFTGIIPPVSTIFTADGQLDKPGTAALIDDLIKAGVDGLFFLGSGGEFSQLGAEERKAIARFAIDHVDRRVPVLIGTGGTNARETIELSQHAQQAGADGIVVINPYYWKVSEANLIRYFEQVADSVTLPVMLYNFPALTGQDLTPALVKTLADSRSNIIGIKDTIDSVAHLRSMIHTVKGAHPHFTVLCGYDDHLFNTLLLGGDGAISASGNFAPQVSVNLLKAWRDGDVAKAAGYHQTLLQIPQMYQLDTPFVNVIKEAIVLCGRPVSTHVLPPASPLDEPRKAQLKTLLQQLKLC

SEQ ID NO: 31504 - protein, 135 aa, Zea mays
  misc_feature (23)..(23): Xaa can be any naturally occurring amino acid
  misc_feature (40)..(40): Xaa can be any naturally occurring amino acid
  misc_feature (49)..(49): Xaa can be any naturally occurring amino acid
  misc_feature (57)..(57): Xaa can be any naturally occurring amino acid
  misc_feature (69)..(69): Xaa can be any naturally occurring amino acid
  misc_feature (122)..(122): Xaa can be any naturally occurring amino acid
RTYMNARIPKRSTQDEAKEQIAXDLAQDWNAVFQRSINTXLLTEMVRGXRMLTIRYXFDTNATINYPDXKGTLETTVHAESTLSDLTESGEERCFACKLCKSICTAQAITTDAAERLDCSGXTSRYDIVMINCIY

SEQ ID NO: 31505 - protein, 646 aa, Arabidopsis thaliana
MSSNSWADVSESERAPSGGGWGYSRPSRTNYVPPHLRSRTPSSEFVAPSPGNNDRGGYGGANSGYGGRGQGYGGRGSGYGGRGGPVGGWNARSGGWDRRDTETNPFGNDGNADPAVNEQENTVINFEAYEDIPIETSGDNVPPPVNTFAEIDLGEALNLNIQRCKYVKPTPVQRNAIPILAAGRDLMACAQTGSGKTAAFCFPIISGIMKDQHIERPRGVRGVYPLAVILSPTRELACQIHDEARKFSYQTGVKVVVAYGGTPVNQQIRELERGVDILVATPGRLNDLLERGRVSLQMVRFLALDEADRMLDMGFEPQIRKIVQQMDMPPPGVRQTMLFSATFPREIQRLASDFLSNYIFLAVGRVGSSTDLIVQRVEFVHDSDKRSHLMDLLHAQRENGNQGKQALTLVFVETKKGADSLENWLCINGFPATTIHGDRSQQEREVALRSFKTGRTPILVATDVAARGLDIPHVAHVVNFDLPNDIDDYVHRIGRTGRAGNSGLATAFFNDNNTTMAKPLAELMQEANQEVPDWLTRYASRASFGGGKNRRSGGRFGGRDFRRESFSRGGGGADYYGGGGGYGGVPGGGYGAMPGGYGPVPGGGYGNVPGGGYAPYGRGGGAYYGPGGYGTVPNQGYGPGVASAWD

SEQ ID NO: 31506 - protein, 193 aa, Ochromonas danica
AGGISEMAELHKDVRTKTDALDSAGNTTAAIGKGFAIGSAALVSLALYGAFVVRIRVSSHNSDSHVEILQPMTFAFLLIGSMLPYWFSALTMKSVGDAAIEMVKEVQWQFEQNPELLNPNGTARPDYSRCVAISTKSALREMIAPGALVMLAPLVAGTFFGVHAVYGLLTGALLSGVQLAVSMSNTGGAWDNA

SEQ ID NO: 31507 - protein, 1405 aa, Mycobacterium avium 104
MNTMCAYCGVGCGMVLQITTDPQTGRRHVAKSVGNKEHPANFGRLCTKGATTADLLAAPGRMDSAHARAGRGEPLEPIGTDQAITRCAKQLRAIIDEHGPDAFAMYVSGQMSLEAQYLANKLTKGFIGTNQIESNSRLCMASAGSGYKLSLGADGPPGSYQDFEHADVFFVIGANMADCHPILFLRMMDRVKAGAKLIVVDPRRTATAEKADLFLQIAPGTDLALLNGLLHLIVENGHTDGEFIAEFTEGWEVMPSFLEQYTPDRVSEITGIPEQDIRAAAQLIGEADNFMSCWTMGLNQSTHGTWNTNAICNLHLATGAICKPGSGPFSLTGQPNAMGGREMGYMGPGLPGQRSVASAADREFVEDVWGVPRGRLRTEVGTGTIDMFSRMADGQIKACWIICTNPVASVANRKTVLAGLERAELVIAQDAYLGTETSEYADVLLPAALWAETEGVMVNSERNITLSQPAVAAPGGAMPDWQIIARIACEMGFSEAFSYSCAEEVFEEIKRFWNPTTGYDLRGVSYERLRRQPLQWPCPPQSTADRNPIRYLNDGVSQTQLVREDGTVPRLAFPTPSGRAVFFARPHLQPEEMPDDDYPFLLNTGRLPHQWHTMTKTGKVAKLNKLNPGPFVEIHPDDAARLGIGEHDRVEIASRRGRAVLPAVVSDRVRPGNCFAPFHWNDAFGEYLSINAVTNDAVDPISNQPEFKACAVTLTKVAVSHPDSAIGTGPSAGHDTPESAPTEVREISVSQVDALGELLGVATSFKPEFNELGRSYLAGMLTGLRSDVGRRAGGVPTLPPSAPFDSRTRLWVDGLLAGLFSRADASQQAALPEPPQPAAQQPPAAPAGATPAPERAPVVVLWASQTGNAEELAADVAAQLAAAELPVALHSMDDFPAAELAATRELLLITSTTGDGDAPDNGSGLWRALTGDAAPRLGNTRYAVLALGDSNYDDFCGHGRKLDARLAELGATRIAERVDCEPDYEQAAAKWVADVIEALTRTPTAVGGDGGATVSARTSPVAAPSRPNTPAPHTYSKKHPLITDMVRNTTLNGPKSTKDVRHLVFNLPEDAVSYEAGDALGVWPRNSDELVDEWLAVTGLDGQTPVEVGEHGLMSLRSALTERIEIAHISRDLVRFVQERTGDAKLAELLKPENKRALADWTWGRQSIDLLAQLPVSASAHEWLRVLKRLQPRLYSISSSPKACPGEVHLTVSPVRYNFQGVPRRGVCSTYLAARSPGDRVAVYLQPSSNFRPPSDPDTPMIMIGPGTGIAPFRGFLQERRALGHRGPNWLFFGEQHAATDFYYRDELEQMREDGFLTELDLAFSRDQQHKVYVQHLMRNRGKQLWSWLQDGAQLYVCGTADPMAKDVDRALCDIAAEFGNLDPDAAKAYVQSLSADKRYHRDVY

SEQ ID NO: 31508 - protein, 425 aa, Brucella melitensis 16M
MTAIIDIVGREILDSRGNPTVEVDVVLEDGSFGRAAVPSGASTGAHEAVELRDGGSRYLGKGVEKAVEVVNGKIFDAIAGMDAESQLLIDQTLIDLDGSANKGNLGANAILGVSLAVAKAAAQASGLPLYRYVGGTNAHVLPVPMMNIINGGAHADNPIDFQEFMILPVGATSIREAVRYGSEVFHTLKKRLKDAGHNTNVGDEGGFAPNLKNAQAALDFIMESIEKAGFKPGEDIALGLDCAATEFFKDGNYVYEGERKTRDPKAQAKYLAKLASDYPIVTIEDGMAEDDWEGWKYLTDLIGNKCQLVGDDLFVTNSARLRDGIRLGVANSILVKVNQIGSLSETLDAVETAHKAGYTAVMSHRSGETEDSTIADLAVATNCGQIKTGSLARSDRTAKYNQLIRIEEELDKQARYAGRSALKLL

SEQ ID NO: 31509 - protein, 461 aa, Brucella melitensis 16M
MPIEILMPALSPTMEEGKLSKWLKKEGDKVTSGDVIAEIETDKATMEVEAVDEGTIGKLLVDEGTEGVKVNTPIAVLLGDGESAADIGSAPAAKAEAAKEEPKAEENKADAVPAAPKAPAVEVASDPDIPAGTEMVSLTVREALRDAMAEEMRRDPDVFIMGEEVAQYQGAYKITQGLLDEFGPKRVVDTPITEHGFAGVGVGAAFAGLKPIVEFMTFNFAMQAIDQIVNSAAKTLYMSGGQMGAPMVFRGPSGAAARVAAQHSQCYAAWYSHIPGLKVVMPYTAADAKGLLKAAIRDPNPVIFLENEILYGHHFDVPKLDDFVLPIGKARIHKQGKDATIVSFGIGMTYAVKAAEELAGQGIDVEIIDLRTIRPMDIATVVESVKKTGRLVTVEEGFPQSSVGTEIATRVMQQAFDYLDAPILTIAGKDVPMPYAANLEKLALPSVAEVVEAVKAVTYTA

SEQ ID NO: 31510 - protein, 274 aa, Brassica napus
  misc_feature (259)..(259): Xaa can be any naturally occurring amino acid
MGSSGNVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISESFEKGTVHLIGLLSDGGVHSRLDQVQLLLKGFAERGAKRIRVHILTDGRDVLDGSSVGFVETLESELAELRSKGVDAQVASGGGRMYVTMDRYENDWTVVKRGWDAQVLGEAPHKFKNALEAVKKLRAEPKANDQYXPFVIVDDSGKAVVDR

SEQ ID NO: 31511 - protein, 447 aa, Brucella melitensis 16M
MPINITMPALSPTMEEGNLSKWLVKEGDKVAPGDVIAEIETDKATMEVEAVDEGTVAKIVVPAGTEGVKVNALIAVLAEEGEDVAAAAKGAGAAPKAEAPKDEPKPAEAKKEAAAPAAAPAPARSEQPAVAPAVNKGERVFASPLARRIAKDAGVDISAVKGSGPHGRVIQRDVEAALASGGAKAVSAQAESAAAPKPMSDDAILKLFEDGSYEVVPHDGMRKTIARRLVESKQTVPHFYLTIDCELDALLALRSQINAAAPMLKTEKGEVPAYKLSVNDMVIKATALALRDVPEANVSWTEGGMIKHKCSDVGVAVSIPGGLITPIVRHAESKTLSVISNEMKDMARRARDRKLKPEEYQGGSTSVSNLGMFGVKDFAAIINPPHATIFAIGAGEERAVVKKGEIKVATVMSVTLSTDHRAVDGALAAELAQAFKRHIENPMGMLV

SEQ ID NO: 31512 - protein, 339 aa, Zea mays
MEITTLKTQLSSEFDMKDLGAARKILGMEIRRDRKSVWQIQEGLVGYVDSDYGAYLKKRRSLTGQSVICLTKDQMFHERTKHIDIKYHYICEIVAEGDDWEHEEIFTDDDEVVDVDIEQRPELADPEASPPEIKQDDNEDELGCSDNLSKSGQELKRLLRRAAGENESDVDDKSTYEDDLPSPKPAPKLVPKSEPDDSSPAKPTPSGHAQSATPSSKSTQKRKSGGGDANISNGAPSKKIKMEHETGTLAVKDENPSYLEPTSKASLSARRESSPITEEEVRTVLRAISPTTSQDLVSRFKTRLITQEDKKAFLGIVTKISRILKHNGGRYIVLRHEHM

SEQ ID NO: 31513 - protein, 950 aa, Glycine max
MSSIVKGIFIRSTADVCKNSMVLKKQSEIVGRRSTRVQWQLHLRSKSNTWKRGSRRSYQPPIRGQAILTPATPPTTKKRVFTFGKGRSEGNKAMKSLLGGKGANLAEMATIGLSVPPGLTISTEACQEYQQNGKKLPDGLWEEVLEGLQFVENEMGAILGNPLKPLLLSVRSGAAISMPGMMDTVLNLGLNDEVVAGLAAKSGERFAYDSYRRFLDMFGDVVMDIPHSLFEEKLEKLKHTKGVKLDTDLTTYDLKDLVEQYKNVYLEARGEKFPSDPKKQLELAVKAVFNSWDSPRAIKYRSINQITGLKGTAVNIQSMVFGNMGNTSGTGVLFTRNPSTGENKLYGEFLINAQGEDVVAGIRTPEDLEVMKSCMPDAYKELEGNCEILEKHYKDMMDIEFTVQENRLWMLQCRSGKRTGKGAFKIAVDMVNEGLVDIRSAIKMVEPQHLDQLLHPQFEDPSTYKDKVIAVGLPASPGAAVGQVVFTADDAEEWHAQGKSVILVRNETSPEDVGGMHAATGILTARGGMTSHAAVVARGWGKCCVSGCSDILVNDAEKVFVVGDKVIGEGEWISLNGSTGEVILGKQPLSPPALSDDLEIFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVRELTSDTGMKEEEIFSRIEKLSEVNPMLGFRGCRLGISYPELTEMQARAIFQAAVSVSNHGITVHPEIMVPLIGTPQELRHQVNLIRNVADKVLSEMGSSLSYKVGTMIEVPRAALVADEIAKEAEFFSFGTNDLTQMTFGYSRDDVGKFLPIYLSGGILQHDPFEVLDQKGVGQLIKICTEKGRAARPNLKVGICGEHGGEPSSVAFFAEIGLDYVSCSPFRVPIARLAAAQVAV

SEQ ID NO: 31514 - protein, 437 aa, Zea mays
RFQKCQYARTRLVRTGGRGWGLVADENIMAGQFVIEYCGEVISWKEAKRRAQAYETQCLKDAYIIYLNADESIDATRKGNLARFINHSCQPNCETRKWNVLGEVRVGIFAKQNIPFGTELSYDYNFEWYGGVMVRCLCGAASCSGFLGAKSRGFQEATYLWEDDDDRFSVENIPLYDSADDEPTSINKEILVSSDGMVTQYSNISRVQSTENPGNTGTNEFAPIIVDELTTSSNGLAPMNVEPLTVSSNEFTPSNAMPMVARLVENGSTGYSAQDTHDASQNSAPKAANHANQTGPQNNSNHSTLVPVKPAPKRRGRKPKRVVHKQLDIPDICDRLTSSVACEEILYCEEVKNHAVSEIDALYDEIRPAVEEHERDSQDSVSTSLAEKWIEASCRKYKAEFDLYAAVLKNVASTPLRSKDDVGPREQNGLKYLENGS

SEQ ID NO: 31515 - protein, 203 aa, Capsicum annuum
MNPEYDYLFKLLLIGDSGVGKSCLLLRFADDSYLDSYISTIGVDFKIRTVEQDGKTIKLQIWDTAGQERFRTITSSYYRGAHGIIIVYDITDQESFNNVKQWLSEIDRYASENVNKLLVGNKSDLNDNRAVSYDTAKAFADEIGIPFMEASAKSATNVEQAFMAMAAEIKNRMATQPASNNAKPPTVQIRGQPVNQKSGCCSS

SEQ ID NO: 31516 - protein, 570 aa, Aspergillus oryzae
MFSGSSSPPKDKSNSVPHSGAVDTQSLSVHPEEGSAAQTSKSLLSGGFFTRRTSEDQAPAGEKKRRSSTVTKAATFFTNAKNSLSLSSSPRESSSFNYTVRSPQTLQSLGSMDPALSVPQGSLNNSAGDSLPTPRSSFKVGVTEDRNRKCRRTMEDTHAYLYNFLGTPAPLARADGENEAGSSLAPDEASSVVETDNGYFAIFDGHAGTFAAEWCGKKLHLILEDIMKKNPNTPVPELLDQTFTTVDQQLEKLPVKNSGCTAVIALLRWEDRIPSSHSATGSSALAPAAAAAAAAKGDSNSEADDTPTQATSSGPSILPKLQEKAIRQRVLYTANVGDARIILCRNGKALRLSYDHKGSDENEGKRIANAGGLILNNRVNGVLAVTRALGDAYLKDLVTGHPYTTETVVQPDSDEFIILACDGLWDVCTDQEAVDLVRNVPDAQEASKILVDYALARFSTDNLSCMVIRLDTNRVKEVINKTAEPIGVAGDPSMDVEHGVSEADKIIEGARKSMANADIADDGETAEKGKNDILHKMVDGEPGPEMSLDDSNDAPTVSHLNKTNANNGIP

SEQ ID NO: 31517 - protein, 422 aa, Synechococcus elongatus PCC 6301
MSPETVLAAVDAAIASPFSTDAFDACVMQTYGRFPLALERGEGCRVWDTQGRSYLDFVAGIATCTLGHAHPELVDAISDQIRKLHHVSNLYYIPEQGQLAAWLTANSCADRVFFCNSGAEANEAAIKLARKHGNTVLEAENPIILTAQASFHGRTLAAVTATGQPKYHKGFQPLVQGFRYVPYNGLAAPEATLAELDAAGETVAAILLEPLQGEGGVNPGDRAYFQAVRQLCDQRRMLLILDEVQVGMGRSGQLWGYENLGIEPDAFTVAKGLGGGVPIGALLVKASCNILQAGEHASTFGGNPLACRAGLAIAQVMERDQLLANVQARGEQLRAGLQELVDRYPNLLAGVRGWGLINGLVLRNDPNVTPIALVKAAIEQGLLLVPAGAEVVRFVPPLIVSAAEIDEALAMTERALLAIAGE

SEQ ID NO: 31518 - protein, 647 aa, Vibrio vulnificus CMCP6
MSNRKQARLEAKQFIDTLSVQPYPNSTKVYVEGSRSDIRVPMREISLADSLVGGTKEAPIFQPNEAVRVYDTSGVYTDPTHQIDLYNGLPKLREEWIAERADTEVLDDVSSVYTKERLEDETLDELRYGNLPRIRRAKAGYCVTQLHYARKGIITPEMEYIALRENMGRAKYQDEVLTQQHAGQSFGANLPKEITPEFVRREVAEGRAIIPSNINHPESEPMIIGRNFLVKVNANIGNSSVTSSIEEEVEKLVWSTRWGGDTVMDLSTGRNIHETREWILRNSPVPIGTVPMYQALEKVNGVAENLTWEVMRDTLIEQAEQGVDYFTIHAGLLLRYIPMTAKRVTGIVSRGGSIIAKWCLAHHQESFLYTHFREICEICAKYDVALSLGDGLRPGSIADANDEAQFAELRTLGELTKIAWEYDVQVIIEGPGHVPMHMIKENMDEQLKHCHEAPFYTLGPLTTDIAPGYDHITSGIGAAMIGWYGCAMLCYVTPKEHLGLPNKEDVKTGLITYKLAAHAADLAKGHPGAQVRDNALSKARFEFRWQDQFNLSLDPDTARAFHDETLPQESGKVAHFCSMCGPKFCSMKISQEVREYAKGQQGEAGQAIEVKLLDDPLEGMKQKSAEFKASGSELYHPAVSHEEVAEG

SEQ ID NO: 31519 - protein, 603 aa, Ashbya gossypii ATCC 10895
MSERGEDLYPLALLMDELKHDDIANRVEAMKKLDTIALALGPQRTRDELVPFLTEVAQDDEDEVFAFLAEQLGKFVPYVGGSKYATLLLPALEILASTEETLVRDKAVSSLNNIAQELSQEQLFREFIPLIENLATNEWFSSKVSACGLFKAVLVRVEDDKFRKELLALFLQLTQDDTPMVRRAAGRNLPTLIDLLTQNIDLSTSGDWDYISNMFQRLVSDNQDSVKFLAVDVLISILKFFNKKKDSTHTKGLLHSAIQLVSDEAWRVRYMSADRFEDLASQFISDPAYIDELISPFLALCEDNESDVRKAIAKQIPGFAKLLPNSAVILKKLLPVVQTLCMDENETVRASLASEITGLAPLLSKQEAIDNLIPILLNMLKDEFPDVRLNIIAKLKVVNEAIGIDFLTENLLPAITELAKDDNWRVRMAIIEYIPLLAEQLGVDFFDQQLADLCLSWLWDAVYSIRHAAVINLKKLTEIFGSAWSRDQIISCLLKSDSQVLENFVYRITLLSALTELVPVVSSAVITEKILPFINHLSTDGVPNIRFNAAKSYAVIVEALGKNYADLSNEVILPNLEKLCQDNDVDVRYFAGQSLEKCKSILG

SEQ ID NO: 31520 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLSEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 31521 - protein, 323 aa, Bacillus clausii KSM-K16
MKLADIYKAFQGDIEFIEAELERTLSAKHPVLKEASTGLLKAGGKRIRPVLVLLAGKFGDYQLDRLKHIAVTLELIHMGSLVHDDVIDNAPLRRGRETVMSRWDNRVAMYTGDYIFGHAIETTKAFSDKRVHTIISDVMNQICRGEIEQIRDQYNWDQGLRIYLRRIKRKTALLIAVSCQLGAIVSGATDELQKNLYYFAYFLGMSYQIMDDILDFVGTNEQLGKPAGGDLRQGNVTLPALYAIEHTPGFKQRLEKSLTKESSLEMDMEPLLNEVRTSGGIEYAQAMSDRYLHKANTLLMGFPDIDAKRHLIEVASYIGRRKY

SEQ ID NO: 31522 - protein, 147 aa, Bacillus clausii KSM-K16
MERTYVMVKPDGVQRNLIGNIVSRFEQKGYTLAAAKLVTLSKETAETHYSEHRERPFFGELVSFITSGPVFAMVWEGEGVIKAARQLIGATNPSEAAPGTIRGDLAVNVGMNVVHGSDSPESAEREIAIFFKEEELNDYQKDSNKWV

SEQ ID NO: 31523 - protein, 576 aa, Xanthomonas axonopodis pv. citri str. 306
MSLRLRGHGAARGNALGRARVRQSHTLEVAEQRVPANQVETQLQRLHAAIASARVEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSTLSHSAILARSLHLPLVVGVSDALQRIEDGDVLIVDAGSGQVIVDPKPEHLRDYRERLRALAKEQRELGRLRSKPTRTRDNVDITLLANAESLEDVANAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILQLRKQLKKLTAQLREEGHEIAEHIPLGAMIEVPAAALALDCFIDDIDFLSIGTNDLVQYLLAVDRNNEALGELYSPLHPAVLRLIAQVIATGRTYGKPVAVCGEIAGDPRFVPMLLALGLTEFSLHPATLLEVRRAVRDTHLGDLRVHGEKLLRARDRKGIEKWLTGHAQGLLR

SEQ ID NO: 31524 - protein, 402 aa, Triticum aestivum
  misc_feature (89)..(89): Xaa can be any naturally occurring amino acid
MPALGTLSAGGAAAGVAGLLRLRRGPALASPLPAAARAGAVHDGAQLVWGRQLRPALVLPAGLLPLQASKRLTLRPPAASAEPAGEAKXPGLLEKYPAITTGFFFFMWYFLNVIFNILNKKIYNYFPYPYFVSVIHLLVGVVYCLLSWAVGLPKRAPINATLLKLLFPVALCHALGHVTSNVSFATVAVSFAHTIKALEPFFNAAATQFVLGQTVPLSLWLSLAPVVLGVSMASLTELSFSWKGFINAMISNISFTYRSIYSKKAMTDMDSTNVYAYISIIALVVCIPPALIIEGPQLMQYGLNDAIAKVGMTKFVSDLFLVGLFYHLYNQIATNTLERVAPLTHAVGNVLKRVFVIGFSIIIFGNKITTQTGIGTCVAIAGVALYSYIKAKIEEEKRAKAA

SEQ ID NO: 31525 - protein, 725 aa, Glycine max
MAPNPRVVAAFTAMANLGIHESKVKPVLKKLLKLYDKNWALIEEESYRALADAIFEEEENKVNEPDQNNKNKNGVVDDEEAHTHGEPVRPLKRLRLRGQEGQSLRPLTSSGPSSAAFPLKAPKLEDGAVPESSSRRQPQSMAALSDGNARIGARHVPPQDAVVDKGKKPISPQLTPRARRSLAEPTVEAGAALLANNKMPHPFILIKPKDEPVDGIPDYEIPLAVIPPEPSSGGDSLMGAAGKKDCHDTVVSQCRDENVEHEYVFPSSNEEATSNVDVALSSMGEEQSVKITQTDDVSKESETNDSPIVRGNKDSVIANGSISVESSAMAELQVPSSIPCSSDLDNAVPAPKKVGMNGFLQSDSGKELEHPIIPNSRTLVVVPKHQLTNDDVRAVHDVNDLTKGEERVKISWVNNTTNDFPPPCHYIPRNLVFREAYVNISLSRIGNEDCCSTCMGNCVLSSKSCSCTNKTGGEFAYTAKGLLKEEFLDECIALNRDPQNYFYCKACPLERSKNDDCLEPCKGHLKRKFIKECWSKCGCGKHCGNRVVQRGITCKLQVFLTSDRKGWGLRTLEDLQKGAFVCEFVGEILTIKELHERRLKYPKNGKYTYPILLDADWGSGTVKDREALCLYAASYGNAARFINHRCLDANLVEIPVEVEGPTHHYYHFAFFTSRKVAAQEELTWDYGINFDEHDDQPIELFQCRCSSKFCRNIKRLNRSMRSSSS

SEQ ID NO: 31526 - protein, 171 aa, Ralstonia metallidurans CH34
MIYILMGVSGSGKSTVGQMLADRLHCGFHDADSFHSDANKAKMHAGIPLTDDDRWPWLDAMRAAIDAARAEGRTHVFTCSALRQVYRDRLLPADGGVTFVFMKGDASTIGSRLSARTDHFFNPALLQSQFETLEEPCDALVLDIRRTPEALVEDILEKCPPASAACSGKAP

SEQ ID NO: 31527 - protein, 388 aa, Oryza sativa (japonica cultivar-group)
AFKEIKVPPPLSPPSSPPMSSGPPQRSKRWLYAIVISSIALLFIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 31528 - protein, 882 aa, Rickettsia conorii str. Malish 7
MIYDMKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSKVSMPGMMDTILNLGMNNEVCNALADSCGDKRFALDSYKRFLEMYGSTVLSIPSDLFEQICEKHKMQADIHKDSDITVELLEKIIDDFKRLHIKYTKQLINDPYEQLESAIKAVLHSWMSNRAVIYRKINNISEDCGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGIVTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEKLEQRYRYKFSFTLGTMIELPRAALGSKKIAKEVDYFSFGTNDLTQTTYGISRDDIASFLPYYLEEKIFESDPFTTLDEEGVGELIDIAIKRGKSSNANLKLGACGEHAGNPASIEFFHRMNLNYVSCSPYRIPIARIAAAQAKIKHG

SEQ ID NO: 31529 - protein, 245 aa, Aspergillus oryzae
MNVIEWAFGKRMTPAERLRKHQRALDRTQRELDRERTKLENQEKKLVQDIKKSAKNGQIGACKIQAKDLVRTRRYTCHATSLYMSGYELMDIAGSRYIQKFYQMRTQLQAISLRIQTVRSNEQMMQSMKGATMLLGSMNRQMNLPALQRIAMEFERENDIMDQRQEMMDDAIDEATGMEGEDEDSEDIVKEVLDEIGVDLSQALGETPTDIQKTAVGETRVAQPVGAGGSSADDDLQARLDSLRR

SEQ ID NO: 31530 - protein, 633 aa, Phalaenopsis equestris
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILRTTLVELGRTLDLVECALWMPSRTGLNLQLSHTLNNQIPVGSVVSINLPVVNQVFNSSCAVRIPHTCPLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVFLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNIMKGHIWPESEGIGKGCTTIFIVKLGISEDPAHRFQHKLLPPIRAGQSEADAFGSKPTPTDLIPLKNRYQRSL

SEQ ID NO: 31531 - protein, 165 aa, Aspergillus oryzae
MARPIVFFDIAVNGTPQGRIEFELFSDVTPRTAENFRALCTGEKGFGYKGSSFHRVIPQFMLQGGDFTRGDGTGGRSIYGETFPDENFQLKHDRPGLLSMANAGPGTNGSQFFITTVVTDWLDGAHVVFGQVTKGFELVKLIESFGTPQGTPRARVQITESGQLQ

SEQ ID NO: 31532 - protein, 119 aa, Zea mays
MSKRHRKENQATSGPVIPQYVYRKMVLMFTEPGSSALSTEKHELLINYILVLTLYADDFRSDPKDICEDLKMTRQMIKPYYDQLGCKSSSAGAFKSSVMTLPAPLKFPKEATRRKRRRF

SEQ ID NO: 31533 - protein, 104 aa, Nostoc punctiforme PCC 73102
MSIYVGNLSYQVTEEDLKQAFAEYGTVSRVQLPTDRETGRPRGFAFVEMESDTQEQAAIDALDGAEWMGRDLKVNKAKPREDRSSSPRGSWGGGNARRNNNNRY

SEQ ID NO: 31534 - protein, 706 aa, Trichodesmium erythraeum IMS101
MLQERIDIHPTHSHGDFKLRSGKPFPFGATMVSGGVNFSIFSSYATSCTLVLFQKGALKPMAEIPFPEEFRIGNVYCMIVFDLDVENIEYGYRMDGPNNFHEGQWFDKSKILMDPYAKIIGGRDVWGKTPNWDDIYQHRGRIPYDDFDWENDRPLEIPPQDQIIYEMHVRSFTAHPSSGVKHPGTFAAIREKIPYLKELGVNAVELMPIYEFDEFENSRPSPITGEMLYNYWGYSTVGFFAPKAGYAATGKLGMQMDELKTLVKDLHKNGIEVILDVVFNHTAEGNENGPTISFRGIDNKTYYMLTPEGYYFNFSGCGNTINCNNPIVRNVVLDCLRYWASEYHIDGFRFDLASILGRDPWGAPLANPPLLETLAFDPILANCKLIAEAWDAGGLYQVGSFPAFGRWAEWNGKYRDAIRKFIKGDCTVGEMAQRIQGSPDLYAWQGRGPATSINFITAHDGFTLADLVSYNDKHNEANGENNNDGANDNESWNCGAEGWSDDPGINALRSRQMRNAIAIMMVSQGVPMLLMGDEIGRSKNGNNNTYCHDSELNWLNWELLETNAELFRFVKNCVAFRKAHPILKNQNHFRNQDYVGSGKSDITWHGTQAWNADWSDNSRTLAFMLCGKHATEVTKQDNDIYVAMNMHWDSLWFNIPGLSDGKHWHIFVNTACASPEDVWELGSEPVLENQHGLLLGDRSIVILVSK

SEQ ID NO: 31535 - protein, 510 aa, Listeria monocytogenes str. 1/2a F6854
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSVDAEVAFKPIEMKNVIGEVLSNEGLAQLRIAETEKYPHVTFFMNGGRNEEFPGESRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 31536 - protein, 802 aa, Arabidopsis thaliana
MLRRLGWLIGLSQRSRQTKSIDAEPYVARVKPVLMIDTVQEIAIYIHRFHNLDLFQQGWYQIKISMRWEDGDNNSCGIPSRVVQYEALDSTSNDSYGVWKIDDKDSSFLTQPFRIKYARQDVRLCMMVSFTMPLERYEGSATSAVILKFELLYSPIMEDIPVTHSDACAAAVHEFRIPPKALSGVHSYCPVHFDTFHAVLIDVSVHVSVMKSAAYKRPAILSSDASNGKNLTSGNIQSSKKAFTQIASADKKLVSFVKALLGARDTLLEEMQRLSKAVGQTVDLSEFVSSMDNALLSDSGSTGKSVEVEGSGQGKLQNNLEKLNGPFDLASDDWLHNFSKEHLSRTFHLLGTQLHYLWNTFLTLHRDNYTKILEYLRDIWTKDRRAEWSIWMVYSKVEMPHHFISGMEDISNHSSHKRVSTGLKLNDPAQVASTRAELHRRSIAQMRINNRAIQDMHIFGDPMRVPIVIIERVWNAPRRTFSDNSYMRHVDRIDSSLLNGHDDESGTKKHINPQHTGRELKIVVFVHGFQGHHLDLRLIRNQWLLIDPKIEFLMSEANEERTHGDFREMGQRLAQEVVSFFKRKKDKHARYGRLKNIKLSFVGHSIGNVIIRAAIADSLMDPYRKYFHTYISLSGPHLGYLYSSNSLFNSGLWLLKKLKSTQVIHQLTLTDDPDLQNTFFYKLCKQKTLCSFKNIILLSSPQDGYVPYHSARIESCQPASFDNSKRGVAFLEMLNNCMDQIRGPSPETPHHQRVFMRCDVNFDTTLYGRNLNSFIGRAAHIEFLESDVFARFIMWSFQDLFR

SEQ ID NO: 31537 - protein, 1041 aa, Yarrowia lipolytica CLIB122
MDDLFDVFDGPVDQPPVKRQRTDNDDKSNDKSNDIKKEVKEDKNDKTDKNKDKDNKIVGAQASVLDEARIATMDSFEKTAEREVDDAENGVDSSDGKVKLQHQVRHQVAVPPGYDYKSISDHVIVDPARTYPFTLDPFQAVSIQSIDRHESVLVSAHTSAGKTVVAEYAIAQCLRNKQRVIYTSPIKALSNQKYRELLEDFGDVGLMTGDVTINPNASCLVMTTEILRSMLYRGSEVMREVAWVIFDEIHYMRDTERGVVWEETIILLPDTVRYVFLSATIPNALQFAEWIVKIHQQPCHVVYTNFRPTPLQHYLFPSGGDGIHLVVDERSQFREENFQKAMGQLQNKDGETKKQAGGGKGVTGNSDIYKIIKMIMMKNYNPVIVFSFSKKDCEALAMKMSKLDFNTADEHAMVQKVFTNALSQLSEDDRSLPQIKHILPLLKRGIGIHHSGLLPILKEVIEILFQEGLLKCLFATETFSIGLNMPAKTVVFTGVRKWDGKALRWVSGGEYIQMSGRAGRRGLDDRGIVILMLDEQMEPAVAKGMVKGEADRLNSAFHLGYNMILNLMRVEGISPEYMLERCFFQFQNVSQIPELEDKRREVEAEAEAIKITNPNVKEYYDLKESIASYGEDMRHIITHPSNVLSFLQPGRLVEVKDEIEDGGKKVQRDFGWGAVVSFAKVPPKLQLQKNLSDHEIYIVDVLLPVKEGSLSSKQPNSIRPDLENGQFEVVPVTLKSLKAIANIRIVLPKSLKSASERRVVAKSIKEVKRRFPDVPQLDPIENMKIKDETFQSLIKKMEVLEGKLAKNPFASEPDRDEVYAEYAGKMALEKKVKELSDDIAKHYSILQLDELKNRKRVLRRLGFIEDDVIQLKGRVACEISSGDELLLTEMLFNGNFNDLTPEVTAALMSCFVFDEMTKEQPKLRAELDTPLKAMQEVARNVAKVSRECKLDVVVDDYVNKFKMQLMDVVYAWCNGASFSQICKMTDVYEGSLIRMFRRLEELLRQMAMAAKTIGNEKLEDKFNLALEKIKRDLVSAASLYL

SEQ ID NO: 31538 - protein, 360 aa, Triticum aestivum
MALEARLRLPLAGPTPATAFLSGSNPKPSHISFSLKPTSTSLSAANAPPIVVVGSANADIYVEVDRLPLVGETVAASAGHSLAGGKGANQAACGGRLALGPTYLVARVGDDANGRLLEGALADAGGVRLDRVARAPGAPSGHAVVMLMPDGQNSIIIVGGANMESWAPEVDPEDLDLIRQAGVLLLQREIPDWVNIQVAQAAKGAGVPVILDAGGMDAPVPRELLELVDIFSPNETELARLTGMPTETFEQISQAAGACHKMGVKEVLVKLGSQGSALFVEGEEPIRQAIIPATEVVDTTGAGDTFTSAFAVALVEGKPKKECMRFAAAAASLCVRVKGAIPSMPDRETVMSLLESVQAE

SEQ ID NO: 31539 - protein, 346 aa, Cucumis sativus
MNRIVIRSLLRGLLHSRNFGSVAGVPGGARMQLTFAAVASPGTRHQSLSDGGFQWRRFLTSSKAVAEEQGKVKLEQGVKDIENNQEKEKEKDNALVSSYWGIYRPKITREDGSEWPWNCFMPWETYRADLSIDLGKHHQPKTFLDKVAYRVVKLLRIPTDIFFQRRYGCRAVMLETVAAVPGMVGGMLLHLKSLRKFQHSGGWIKALLEEAENERMHLMTMIELVQPKWYERLLVITVQGVFFNAFFVLYLMSPKLAHRIVGYLEEEAIHSYTEYLKDINEGKIENVPAPAIAIDYWRLPKDARLKDVITVIRADEAHHRDVNHFASDIHFQGKELRESAAPLGYH

SEQ ID NO: 31540 - protein, 251 aa, Listeria monocytogenes str. 1/2a F6854
MRKPIIAGNWKMNKTAAKAGQFAEDVKNNVPSSDAVESVVAAPALFLQELVRLTEGTNLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 31541 - protein, 396 aa, Listeria monocytogenes str. 1/2a F6854
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEAAIAELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 31542 - protein, 379 aa, Oryza australiensis
MATAGKVIKCKAAVAWEAGKPLVIEEVEVAPPQAMEVRVKILFTSLCHTDVYFWEAKGQTPMFPRIFGHEAGGIVESVGEGVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 31543 - protein, 336 aa, Listeria monocytogenes str. 1/2a F6854
MTVKVGINGFGRIGRLAFRRIQNVEGIEVVAINDLTDAKMLAHLLKYDTTQGRFDGEVEVHDGFFKVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMETASDSETFGYTSDQVVSSDIKGMTFGSLFDETQTKVLTVGDQQLVKTVAWYDNEMSYTAQLVRTLEYFAKIAK

SEQ ID NO: 31544 - protein, 636 aa, Oryza sativa (japonica cultivar-group)
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPKEKAKAETRDWLNNVVSDLENQIDNFEAEVEGLSIKKGKQRPPRLVHLEKSITRHKAHIKKLESILRLLDNDELSPEQVNDVKDFLDDYVERNQEDFDEFSDVEELYSTLPMEKVEALEDMVSLAPSSLVKGVASVSTTAVLSTKSSVATSPTQATVSAAPSLSVSQDQAEETASQESNPESAPQTPPSKVGSQPSVPVVPTTISTSTAAVSVSAETISSPVRPIVPTTTAAVLPASVTARSAPENIPAVTSAPANSSSTLKDDDNMSFPSRRSSPAVTEIGLGRGITRGLTSQGLGSAPISIGPVSGNGSVSALTDLSKRNMLNTDERINSGGISQQLISPLGNKAQPQQVLRTTDTISSDSSNTNESTVLGGRIFSPPVVSGVQWRPQNTAGLQNQSEAGQFCGRPEISADQREKYLQRLQQVQQQGSLLNVSHITGISQKQFPSQQPNPLLQQFNSQSSSISSQAGIGLGQVQVPESGHTKSEEQQQSFAEDVSVESVATAGANKHMSEDDTKIPFS

SEQ ID NO: 31545 - protein, 462 aa, Xanthomonas axonopodis pv. citri str. 306
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 31546 - protein, 158 aa, Oryza sativa
MVVGLINANPVVYEKKERRSRQAPETTDENAAEAIDQLEIFDHIRDIKDPEHPYSLEELNVVTEDSVEINDELSHVRVTFTPTVEHCSMATVIGLCLRVKLMRSLPPRYKVDIRVAPGSHATETAVNKQLNDKERVAAALENPNLLDIVEECLSPTFA

SEQ ID NO: 31547 - protein, 186 aa, Brassica rapa subsp. pekinensis
YIGLKQRRATGQEYAEFLHEFMCAVKQNYGEKVLVQFEDFANHNAFDLLSRYMDSHLVFNDDIQGTASVVLAGLIAAQKVLGKSLADHTFLFLGAGEAGTGIAELIALKISKETGAPIEETRKKIWLVDSKGLIVSSRKESLQHFKQPWAHEYEPVKDLIGAVNAIKPTVLIGTSGVGQTFTKEVV

SEQ ID NO: 31548 - protein, 576 aa, Silicibacter sp. TM1040
MDDMARILITSALPYINGIKHLGNLVGSQLPADLYARYNRGRGHEVMFLCATDEHGTPAELAAAKAGKPVADYCAEMHAVQADIAKRFGLSFDHYGRSSSPQNHALTQHFAGKLEEAGLITEVSEKQVYSNADGRFLPDRYIEGTCPNCGFEKARGDQCEECTKQLDPTDLINPRSAISGSTDLEVRETKHLFLRQSAMRDQLDQWIDSKTDWPVLTTSIAKKWLHDGDGLQDRGITRDLDWGIAVKKGDADWPGMEGKVFYVWFDAPIEYIAAAGEWAEAHGKTDADWERWWRTDKGADDVKYVQFMGKDNVPFHTLSFPATLLGSGEPWKMVDHLKSFNYLNYDGGQFSTSQGRGVFMDQALEILPADYWRWWLLSHAPESSDSEFTWENFQQSVNKDLADVLGNFVSRITKFCRSKFGEEVPDGGTWGEQEQTLIEELSTRIGAFERHMEAMEVRKSAQELRAIWVAGNEYLQSAAPWSVFKEDPERAAGQVRLGLNLIRLYAVLSAPFIPDASDRLFAALGTEDRSWPEDVAAALAALPAGHAFTVPEVLFAKITDEQREEWQERFAGGRSA

SEQ ID NO: 31549 - protein, 274 aa, Brassica napus
MSLFLKDDSIQIREVWNDNLHEEMDLIRQVVDDFPYVAMDTEFPGIVVRPVGTFKSNADYHYETLKLNVNILSIIQLGLTFSNEQGNLPTCGTDKYCIWQFNFREFDLSSDIFAHDSIELLRQSGIDFDKNKRNGVDSRRFAELLMSSGIVLNENVHWVTFHSGYDFGYLLKLLTCRDLPETQVGFFEMIRVYFPRVYDIKHLMKFCNSLHGGLNKLAELLEVERVGICHQAGSDSLLTSCTFRKLQENFFIGSMEKYSGVLYGLGVENGQSVH

SEQ ID NO: 31550 - protein, 115 aa, Brassica rapa subsp. pekinensis
GHVHTYERSERISNIAYTVVNGICSPVKDQSAPVYITIGDGGNIEGLATKMTEPQPKYSAYREASFGHAIFSIKNRTHAHYAWHRNQDGYAVEADTMWFYNRFWHPVNDSPSSDS

SEQ ID NO: 31551 - protein, 343 aa, Vibrio angustum S14
MKIKALSKLKPEEGIWMTEVDKPEVGHNDLLIRIKKTAICGTDVHIYNWDEWSQKTIPVPMVVGHEYVGEVVGMGQEVRGFAIGDRVSGEGHITCGHCRNCRGGRTHLCRNTIGVGVNREGAFAEYLVIPAFNAFKIPDDISDDVASIFDPFGNAVHTALSFDLVGEDVLITGAGPIGIMAAAVAKHVGARHVVITDVNEYRLDLAREMGVTRAVNVAKESLTDVMAELGMKEGFDVGMEMSGNPAAFNSMLSSMNHGGKIALLGIPPSDMAIDWNQVIFKGLIIKGIYGREMFETWYKMATLIQSGLDLSPIITHHYKIDDFQQGFDVMRSGQSGKVILDWE

SEQ ID NO: 31552 - protein, 286 aa, Arabidopsis thaliana
MASEKQKQHAQPGKEHVMESSPQFSSSDYQPSNKLRVALITGGDSGIGRAVGYCFASEGATVAFTYVKGQEEKDAQETLQMLKEVKTSDSKEPIAIPTDLGFDENCKRVVDEVVNAFGRIDVLINNAAEQYESSTIEEIDEPRLERVFRTNIFSYFFLTRHALKHMKEGSSIINTTSVNAYKGNASLLDYTATKGAIVAFTRGLALQLAEKGIRVNGVAPGPIWTPLIPASFNEEKIKNFGSEVPMKRAGQPIEVAPSYVFLACNHCSSYFTGQVLHPNGGAVVNA

SEQ ID NO: 31553 - protein, 271 aa, Solanum demissum
MSTKGRKFAVKGETVASHYAFGPLEDDIIIKHRLLTRTTTTRGEPPLKKLQKKFTTFALEIEKEADNYNDCERLAKAFLQELNTFEIPLLKSKVVIDANVREKENFNDLKGEINKQIVQAQADIEDLKRQLEESKVERKHKEEGEAIRKLIAMQPPRSETQKVITELEKEIAMLEAENTASSRTLDLRKKQFALLLHVDYDVIIGKDWLIRYYALVDCKLKHVDELQITIEEEQRSLVEEMRNVVDDHNKSGSEDATMGPEAMAVDYQVNP

SEQ ID NO: 31554 - protein, 477 aa, Candida albicans SC5314
MTTYQPVEQSLVEEESDLTLFSDLVRSRSTGSWINQDNIREVQRFNDFRTIDWVEDELDAQKKRVLKARHITSRGNNMKDKIISQAQNWVVLGIMGCSIGLIAGSLNIITSFLSNIRTGHCKRNFYLNESFCCWGEESDHCDNWVKWTSIEFINYILYVLISLLFAYSAAKLVKFYAPSAAGSGISEIKCIVSGFVMDGFLGWPTLFIKSLGLPLAIGSGLSVGKEGPSVHYAVCVGNSIAKLITKYRKSASRAREFLTATAAAGVAVAFGSPMGGVLFSVEEISTVFQLNTIWKSYFCALIAVTTLAALNPFRTGQMVLFEVTYDTNWHYFEIPIYIILGIFGGLYGIIVSKFNIRVVAFRKKYLGNFAVREVLILTLFTASFSYFNQFLRLDMTETMQILFHECDKNFHHPICDSSNKKTGIIVSLLFATLARMLLTIVTYGCKVPAGIFVPSMAAGATFGRALGINSRFSLCQP

SEQ ID NO: 31555 - protein, 352 aa, Solanum demissum
MASLVSSWSSEVNSIPEKYVVPLEKRVNADVPIGKHIPVIDLSQSSTQSIQQIIKASADFGLFQVINHGVSETLMVDALSVCKEFFKLPIEDKAKFVEKDEGLSDFEPSIDQRPKLYIEKEYTPNKNGSNTNNGKDTVFWKDTFGHGCHPLTQDVINSWPEKPQKYREVIGEYALELRKLSLRILDLMCEGLGLEVGYLTREHSQTQLMVTHHYPQCPDPNSTIGIGEHCDGALINLVQQELSGLHVRDKDGKWFGVEPIPGALVVINGLILKVVTNGKLSSGVHRVVTNSTSDRTSLGSLISPIECIIEPAKLLINESNPPLFKSFSYTEYLGYYFSDTTEIEAALKPYKL

SEQ ID NO: 31556 - protein, 610 aa, Oryza sativa (japonica cultivar-group)
MASHALRLHPLLFSAAAARPAPLAARPGGGARRVHRRHSLAVVRCSSSAAQALKIKSIPTKPVEGQKTGTSGLRKKVKVFQQENYLANWIQALFNSLPPEDYVGGTLVLGGDGRYFNKDAAQIITKIAAGNGVGKILVGRNGLLSTPAVSAVIRKRQANGGFIMSASHNPGGPDNDWGIKFNYSSGQPAPETITDQIYGNTLSISEIKTADIPDVDLSSLGVVSYGDFTVEVIDPVLDYLELMENVFDFQLIKGLLSRPDFRFVFDAMHAVTGAYADPIFVEKLGADPVDYILNGVPLEDFGNGHPDPNLTYAKELVFTMFGSGAPDFGAASDGDGDRNMILGRRFFVTPSDSVAIIAANAQAAIPYFQSGPKGLARSMPTSGALDRVADKLNVPFFEVPTGWKFFGNLMDAGKLSICGEESFGTGSDHIREKDGIWAVLAWLSILAHRNKDKKAGERLVSVEDVAREHWATYGRNFFSRYDYEECESESANKMMEHLRDVIAKSKPGEKYGNYTLQFADDFSYTDPVDGSTVSKQGLRFVFTDGSRIIFRLSGTGSAGATIRIYIEQFESDASKHDLDAQIALKPLIDLALSVSKLKDFTGRDKPTVIT

SEQ ID NO: 31557 - protein, 426 aa, Yarrowia lipolytica CLIB122
MSTFHTHLKMSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 31558 - protein, 132 aa, Prochlorococcus marinus str. MIT 9303
MNAPSVQAITTASAPAPVGPYNQAVLAGGWLYCSGQIALDPTNGVMVGQGDVEAETRQVLSNLMAVLTAAGAEPRQVIRTTVYLTDLADFQRVNALYGEIFGDGISPARACVQVAALPKGGRVEIDCVAWLG

SEQ ID NO: 31559 - protein, 941 aa, Alnus glutinosa
MMEGSDYFILRLLEWFILCFFILVRSTCGQEGFVSLRCCSDSNFTDQITSINWTPDDSWFPNKTGCRDEPNIEAWKKHKDYGKARIFNIDSGKRCYRLTSIKEQDYLVRGTFLFGDLLRTTLDTSFDVLVGVTGISRVNSSEDSEVEGIFRATKDHIDFCLEKVQGDPYISKLELRPLKDLNYLQNFSSTTVLKSVHRIDVGNTGVDIRYPSDKSDRIWKPDTNSTARGSRLSVNVSNYSANNATPPLEVLQTALYHSERLEFQESLDKRDYEYRVFLYFFELNKTSKHGDRVFDIYINNEKVKENFEILANGYNYKEVVWDVRANGSLNLTLIKASGSLFGPICNAYEILQVREINQSYGEFDLQVQQTDEKDVEVAWRVRNELLVSNQANAVLESWSGDPCLPKPWQGLACALHNGSAIITSLNLSSMNLQGSIPHSITELANIETLNMSYNQFNGSIPEFPDSSMLKSVDISHNYLAGSLPESLISLPHLQSLYFGCNPYLDKEPQSSFNSTIHTDNGRCDSNESPRVRVSVIATVACGSFLFTVTVGVIFVCIYRKKSMPRGRFDGKGHQLTENVLIYLPSKDDISIKSITIERFTLEDIDTATENYKTLIGEGGFGSVYRGTLSDGQEVAVKVRSATSTQGTREFENELNLLSEIRHENLVPLLGHCSENDQQILVYPFMSNGSLQDRLYGEPAKRKTLDWPTRLSIALGAARGLTYLHTNAKRCIIHRDVKSSNILLDHSMCAKVADFGFSKYAPQEGDCVSLEVRGTAGYLDPEYYSTQQLSDKSDVYSFGVVLLEIVTGREPLNIHRPRNEWSLVEWAKAYIRDSQIDEMVDPSIRGGYHAEAMWRVVEVASTCIESDAASRPLMIDILRELDEALIIETNASEYMRSIDSLGTSSNRFSIVMEKRIVLPPISSSPSEPSPILPQGPSPPQPR

SEQ ID NO: 31560 - protein, 155 aa, Brassica napus
MVKPFWRKGSGTERSKISPTKNDGLTWYKDLGLHAFGEFSMAMIQANSVMEDQCQIESGPLTFNNLAVQGTFVGVYDGHGGPEASRFIADNLFPNLKKFASESGEVSEEVIRNAFAETDEDFLNAVKKKWRKNPQMASVGSCCLAGVMCNGLVYI

SEQ ID NO: 31561 - protein, 941 aa, Alnus glutinosa
MMEGSDYFILRLLEWFILCFFILVRSTCGQEGFVSLRCCSDSNFTDQITSINWTPDDSWFPNKTGCRDEPNIEAWKKHKDYGKARIFNIDSGKRCYRLTTIKEQDYLVRGTFLFGDLLRTTLDTSFDVLVGVTGISRVNSSEDSEVEGIFRATKDHIDFCLEKVQGDPYISKLELRPLKDLNYLQNFSSTTVLKSVRRIDVGNTGVDIRYPSDKSDRIWKPDTNSTARGSRLSVNVSNYSANNATPPLEVLQTALYHSERLEFQESLDKRDYEYRVFLYFFELNKTSKHGDRVFDIYINNEKVKENFEILANGYNYREVVWDVRANGSLNLTLIKASGSLFGPICNAYEILQVREINQSYGEFDLQVQQTDEKDVEVAWRVRNELLVSNQANAVLESWSGDPCLPKPWQGLACAPHNGSAIITSLNLSSTNLQGSIPHSITELANIETLNMSYNQFNGSIPEFPDSSMLKSVDISHNYLAGSLPESLISLPHLQSLYFGCNPYLDKEPQSSFNSTIHTDNGRCDSNESPRVRVSVIATVACGSFLFTVTVGVIFVCIYRKKSMPRGRFDGKGHQLTENVLIYLPSKDDISIKSITIERFTLEDIDTATENYKTLIGEGGFGSVYRGTLSDGQEVAVKVRSATSTQGTREFENELNLLSEIRHENLVPLLGHCSENDQQILVYPFMSNGSLQDRLYGEPAKRKTLDWPTRLSIALGAARGLTYLHTNANRCIIHRDVKSSNILLDHSMCAKVADFGFSKYAPQEGDCVSLEVRGTAGYLDPEYYSTQQLSDKSDVYSFGVVLLEIVTGREPLNIHRPRNEWSLVEWAKAYIRDSQIDEMVDPSIRGGYHAEAMWRVVEVASTCIESDAASRPFMIDILRELDEALIIETNASEYMRSIDSLGTSSNRFSIVMEKRIVLPPISSSPSEPSPILPQGPSPPQPR

SEQ ID NO: 31562 - protein, 945 aa, Tropaeolum majus
MMMERLDNRSSRRVECFIFCLLILPIIFHSVSAQPGFVSVACCADSGFTDNTLINWITDESWFPDKQGCRNFAPPVANYTGYKKARIFAIDSGKRCYNLPTIKDQDYLIRGSFLFGDSLSSPFGTSFNVLVGVTPIARVSTSDKLEVEGIFRANRDYIDFCLAYEKGEPYISNLELRALENSNFLKLESPVVLKLVDRVDLGGSTGEGIRFKDDKYDRIWKPDSYLNRTIITNANVSINNLNVTVPIKALQSAVTNENRLEFLKNDLDIGDYKYSVTLYFLELVENVQPGQRLFDIYINNALKWENFDISANGSDYKEVSFYATANGFLNVSLVKVPNGLGFGPICNAYEILQVRQWIQQSNLNDVNVIVNVKEELLKHNKRNVLWESWSGDPCLPYPWDGLVCYSVNGSSVITELNLSSRKLQGPIPSSIIQLTYLKDLNLSYNGFTGTIPSFTASSMLTSVDLRNNDLKGSLHESIGALQHLKTLDFGCNPQLDKELPSNFKKLGLTTDKGECGSQGPKHSTRAIIISIVTCGSVLFIGAVGIVIVFFYRRRSAQGKFKGSRHQISNNVIFSIPSTDEPFLKSISIEEFSLEYITTVTQKYKVLIGEGGFGSVYRGTLPDGQEVGVKVRSSTSTQGTREFDNELTLLSTIRHENLVPLLGYCCENGQQILVYPFMSNGSLQDRLYGEAAKRKVLDWPTRLSIALGAARGLTYLHSLAGRSLIHRDVKSSNILLDQSMTAKVADFGFSKYAPQEGDSCASLEVRGTAGYLDPEYYSTQQLSAKSDVFSFGVVLLEIISGREPLNIHRPRNEWSLVEWAKPYIRESRIDEIVDPTIKGGYHAEAMWRVVEVALACIEPFSAHRPCMADIVRELEDGLIIENNASEYMKSIDSIGGYSFGGGSNRFSIIVTDKEKKTIPPPPSPPTPNPSEPSPVNTQALTPPEPR

SEQ ID NO: 31563 - protein, 117 aa, Eucalyptus grandis
MAEEGQVISCHSAESWSEQIAKSNESDKLVVVDFTASWCGPCRFIAPFLAELAKRFPNVLFLKVDVDELKTVAQEWAVEAMPTFMFVKGGKIVDRVVGAQKDQLQMTLAKHMATASA

SEQ ID NO: 31564 - protein, 81 aa, Glycine max
  misc_feature (47)..(47): Xaa can be any naturally occurring amino acid
  misc_feature (49)..(49): Xaa can be any naturally occurring amino acid
  misc_feature (56)..(56): Xaa can be any naturally occurring amino acid
  misc_feature (69)..(71): Xaa can be any naturally occurring amino acid
  misc_feature (80)..(80): Xaa can be any naturally occurring amino acid
MCIALFLWQCHPLFPFLLLNNRDEYHNRPTKPESWGEDRVILAGRDXIXLGTWLAXSSHGRVAFLTNVXXXSSLPDANSXG

SEQ ID NO: 31565 - protein, 908 aa, Pseudomonas syringae pv. tomato str. DC3000
MRMTSMAIQTTQVTASTCCYCGVGCGVLIEHDGQRILGVSGDPQHPANFGKLCSKGSSLHLTGDIEARALYPELRLSKGLARSVTDWDTALEHAATVFAESIREHGPDSVAFYISGQLLTEDYYAFNKLARALVGTNNIDSNSRLCMSSAVAGYKRSLGADAPPCSYEDLELSDCVMIVGSNMAYAHPILFRRLEEAKSRRPAMKLIVIDPRRTDTCELADLHLAIQPGTDVALFHGILHVLMSENLIDPQFIAAHTLGYDELAALVCDYPPERVANICGISQQHLHTCARWLGKSAGFLSLWCMGLNQSTAGSAKNSALINLHLATGQIGRPGAGPFSLTGQPNAMGGRETGSLSNLLPGHRDAANPEHRAEVAEYWGIDSLPATPGLSAIELFEQLQNGTIKALWIACTNPAQSLPDQNRIRQALETCPFVVLQEAFKTTETARFADLLLPAASWGEKEGTVTNSERRISNVRKAIQAPGEARSDWAITVDFAQRLQKRLQPEAPALFDFQTPKSLFDEFKGLTVGRDLDMSGIDRELIDRQGPQQWPFPTGASVGTPRLYLDGIFPTASGRAQFLAEPYIAARELRDAEYPLTLNTGRLRDQWHGMSRTGTAARLFGHVSEALLSLNPKQMLGHDLQNGDLVKLISRRGELLLPVSSDDSVVAGQAFLPMHWGERFLKGGVNVLTQPAFDPLSKQPELKHSGVRIEKARLPWQFFALIEGNVQQHMERLRPLCEAFTYLSMGLIGRERPALVVRAASTEAPDSTLLQRIDSLLNLDEGPVMAYDDPKRSIGKRVRIDNGRITAIRLAGETLAQHWLQTLWLQERADPALRRWLLAPLSSEPGKDSTLSRDKTLCNCMNVSQSTVMSGIERGLNLNQLKTQLGCGTQCGSCVPEIKRLINAVAVTE

SEQ ID NO: 31566 - protein, 898 aa, Arabidopsis thaliana
MNGLDFFFSPSPIVDTSTGNNGGDDDWGDFVDSSDAFDSDRNGADSSHNRIESEKKSQANWVTSRGPVPLSVFGEEEEDDTESSASVPSFGFSFDSFSSKRNDSNGSVNRVVDSNTNHTVEISGLIPNLYRKNGHSDNNHGNSGGFNVDLSSSNRKIENSAVSLETNPLNLGTERSVKASNVLNSSTIEVTLDPNYSDLGFADKSDDDLDGWEFKTAESMFGTLGGSYKEEREKAVQNTADVSSGVWSSPAINGTGPNFDTAKVDAVKLVAERENGDDDPWDNGGWEFKVAEAKEPKRDLTNKESNGWGFGFGFEPVSKLETTNSFQSSVEKETKKMENGSISFPSNGDVNSGGTSWAFKQPSLEIGNEKEEKEVQTGKPKGVLPLSFFEDEKSETSDTLVHEDSFVLASDFPVREKTKAPSPTVSISDLISRLYSQVEEKNAVNILENSATASNEVNGEDDSWEFQGPKMPITDSGIAEGADDFDSTWEFQGPSPALKMSDVTEVVDEFDDDSWEFQGPTQPVKDSMSRIGDNGLWEYKHSSVENEVGNQSSVPNGFGELHDKTVIRIEPNDYQDLFHKLKIELYHIALYHLEKLKEARDKAADSDEVQKCDSEIEDLQNLLNNDVLISGVNLESLQPGSSGMTELYKALQEPKFRELDSEDLLTERLLSVKFCRSSRCPDWKSTIELLKHATLTLKIINLGSLEQQSKYASTWFEISSTCAQELRHAASIWKQVIKNDVQEEILSKPQGKSYALSVGEIYRVVKILRASTRLYKPWILLAPTSSNVLAVLDECLKLWLSSGLVEALLNSHDDSADQLLESIKYINEVDAFTLYTCITSATSPTCYISGLNTDIVPAGIKTVEWNGEHYLLPLANIWANLISRDPPNLPGHHFPIVS

SEQ ID NO: 31567 - protein, 409 aa, Pseudomonas syringae pv. tomato str. DC3000
MKKLKLVMIGNGMAGVRTLEELLKLSEDLYDITVFGAEPHPNYNRILLSPVLAGEQNFEDIVLNDLAWYQSNGIQLLLNRRVVKIDRIKRLVIADDGTQAHYDRLLIATGSRPFILPIPGNTLDGVIGYRDIGHTRQMIDTAVTHKHAVVIGGGLLGLEAANGLSLRGMQVTVIHNGQTLLERQLDKTSGLMLQAALELRGLSFRLNEQTQALLGDDQGRVRAVQLKNGDVIDADLVVMAAGIRPNTELAEQAGLPCNRGILVNDTLQTFDPRIYAIGECVSHRGIAYGLVAPLFEQARVCANHLAQLGSARYPGSVTSTKLKVTGIDLFSAGDFLGGEGTESITLSDPIGGVYKKLVIKNDILVGACLYGDTADGSWYLQQIRDGQGIDAIRNHLMFGKPAATPAACA

SEQ ID NO: 31568 - protein, 260 aa, Ralstonia eutropha JMP134
MTGLQNAGRLVPDLSGRQALVTGGSSGIGEAIATAMGQAGARVILAARRQSQLDAAASRLDAMGIAVDTHVFDVSDLDAIPAAADALQQQHGTIDILVNAAGMNLRETYASVTPSSWRLQLDTHLGAPFFLTQALAPAMQTQGWGRILNIASLQSYRAFANSAPYGAAKGGIVQLTRAIAEEWSRHGITCNAIGPGFFPTALTGPVFADAGLTEYHASRTCIGRNGELADLHGLVAFLASDMAAYITGQTFMVDGGYTAR

SEQ ID NO: 31569 - protein, 765 aa, Zea mays
MPLSPSPSPPPNATAAAAALPLLLLLVCASSIAAQPLASSQAKALLRVRRLLFYPPALEPLRGAPDPCALPPAPALAVACEGGQVTALSVLGDRDPDAAWRAALPASFSSEALFTTLTRLPALARLSLVGLGAWGPLPGAKLRRLQALQQLNLSSNYFYGAVPDGLARLYSLQSLVLSWNWLNGTVPSLSGLQFLEELDLSHNRLGPAFPDVGRSVARLVLDDNNFTGGIPAGVSSLGLLQYFDVSGNQLQGWIPSSVFALPALRYINLSRNRLAGQLPATTACAEALAFVDVSANLLTGARPPCMRGNSSARTVLVAGNCFADAKQQRASSYCNPGALAAVLPPPQGNGGGGQGTGKGREIGMVLAIAGSVVGAALLIALAMVVVLRRARRQRPEATILPKSPAATPTNKADGWKAPAKATQKIITTADKRHASQAARVNTLEVPAYRVCTLEELQEATDNFSSSNLIKTSPLAQDYNGQLQDGSRVLVRCLRLKPKYSSQSLVQYMEIISKLRHRHLVSIIGHCIVSDEENPNIASLVYLVSECVTNGSLRSHLTEWRKREMLKWPQRVCAAIGIARGVQFLHNLTAPGIVQNNLNIEHILLDKTLTSKISNFSLPMISTSKNGKILSETPFAVHEDNDIGSAQNAAQGDKEDIYQIGLILLEVITGKPTESQRQLESLKAQLSEALTEDPDRLKDMADPAIHGTFAVDSLSTVAEIALKCTTGDPSDRPSIDDVLWNLQYSMQVQDGWASSESLGLSVKSQA

SEQ ID NO: 31570 - protein, 250 aa, Oryza sativa (japonica cultivar-group)
MENGLSDEVLKAVFPLLDGQDLVFCMLVCRQWREIAKDDYFWKCICARKWPSICKQPPSDANYQKLYLTFSKPRTPQHLPVPKLTFEDLVFYIDMWLDGSLIFSQAVSGCILRGGLQNTPCGIPDVLVAHLTAPDCILMMEVEPKLEITMGPSITVSVLAHRKDTKKMACVINKSTFDYIDSNAARALAYEYLQFSPRYPFISDIRAWMSLLFLYKGTNVIEVFGIELDFCDAARSETEILWLLDMLDWK

SEQ ID NO: 31571 - protein, 328 aa, Trichodesmium erythraeum IMS101
MANYAPAIETMTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 31572 - protein, 798 aa, Hordeum vulgare subsp. vulgare
MASLLAPPASTRVFPPPPAPPRRPAVVARAARSRYRFRTDDDAVVDVAVAAAEGGGYTVGVEVPPLPGARRREGGLALRPAGSGEAVPLAPPGDGACPAAELSFQASRAPFCLSFLLTDDEGAEIRTHRGTAFRVPVGVGPGSPAPLGLSLSEAGAANFALYSRGAEGVLLCLYGRGGGGGEPALEIELDPFVNRTGNVWHVSLESVEGYFSYGFRCGLFGADHPLLDPYAKLIGDFVAADPVHVKEGTVPSSVSCLGSLANPPSYNWGRDKRPCLPLENLVVYRANVALFTKDKSSGLPNNVAGTFSGMAAKIHHFGSLGVNAVLLEPVFPFDQVKGPYFPYHFFSPMNSYSAEGCSASAITAMKDMVKAMHRNGIEVLLEVVFTHTAEGQADGQMISISGIDKSSYYIADEIAGCKSGILNCNSPVTERLILDSLRHWVVDFHVDGFCFINAPFLVRGSRGEYLSRPPLLESIAFDPVLSKTKIIADPWSPLGISNVQFPFPHWKRWAEMNTRFSIDVRNFLKGEALIGDLATRLCGSGDLFSNRGPAFSFNYVSRNSGLSLVDLVSFSNGDLASESSWNCGEEGPSENSAVLQTRLRQIRNFIFILFVSLGIPVLNMGDECGHSSAGSTSYKDRVPLKWKALKTSFVKEVTGFISFLAALRSRRGDVFQRREFLKLENISWHGNNLSEPRWEDPTSKFLCMHIIAENDGNTPELTKGDLYICFNASEEPASATLPAPAEGSVWLRLVDTSLTFPSFFTTESNLEVQQVLGYSSYEVKAHSCVLFESKRDLPQFLG

SEQ ID NO: 31573 - protein, 195 aa, Trichodesmium erythraeum IMS101
MTHSTDITTLARWFAADFSNQQQAFDNPPLFAHIRVCMRPLPYQLLNGLSLYLEQAYDITLNQPYRVRVLKLVPSENHIEIENYIIDQEAEFYGASRDPQRLKNLKTEYIKKLPGCTFITKWTGKSFKGEVEPGKGCTVVREGKSTYLKSYFEINEHKFISHDTGYDPETDQQVWGAIAGPFEFVRWASFADEVI

SEQ ID NO: 31574 - protein, 335 aa, Oryza sativa (indica cultivar-group)
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKSLFNRYAAAPQEARTNWDEFTRNYFLGRENLVSVFLLVDASIPAKKIDLDYASWLGQNKCKIQKSSQTSNYVGINLVPETPLKTSSNVPMTLVFTKCDKRKKKKNGGKRPEENVENFQSLIREYFEAAPPWIMTSSVTNQGRDEILLHMSQLRNYWLKH

SEQ ID NO: 31575 - protein, 755 aa, Gluconobacter oxydans
MFRPGARPLDFGNDARRNVAGCHQAQERVSQYGLPISHCVRRDFASCRGSRCGGYRCVSSRQSQAGDPIPMSTLPQLAINTIRTLSMEGVERANSGHPGTAMALAPAMYAVWQHDLKYDPADPCWPARDRFVLSVGHASMLLYSTLFLTGVKDIRDGKVVDAPSLTVEDLSQFRQLNSKTPGHPEYRFTAGVETTTGPLGQGCGNSVGMAIAQKWMSARYDRPGFKLFDYHVTVFCGDGDMMEGVASEAASTAGHLALGNLTWIYDSNQISIEGSTDLAFTENVGKRFEAYGWHVQTLTDGNDVDAILAALKAARAVTDRPSLIVLKTVIGYGAPKKAGTASAHGEPLGADEIKGAKQAYGWPEDAPDFYVPDGVKEHFAEGLGKRGAEAHAEWRELFSAYREAHPELAAEIDCIIEHRLPEGWDKDIPTFDADAKGIASRASSGQVLNAVAKNLPWMIGGSADLTPSTKTDTKGGGSFQPEKWNGSYGGRNIHFGVREHAMGSICNGIALSGIRAYGSGFLIFSDYMKAPIRLSAIMELPVLYIFTHDSIGVGEDGPTHQPIEQLAQLRATPGIMTIRPSDANEVAEAWRTLIPMTHKPAVLALSRQNLPTIDRTKYASAAGLAKGGYVLASCEGKPDVILIASGSEVSLVVAAYEKLTEEGIKARVISMPSFDLFEEQSQEYRDSVLPPDVIGRVAVEQAAAFGWDRYVGLGGAIIAMNTFGASAPASALLTKFGFTPEAVYDAAKRQALRGK

SEQ ID NO: 31576 - protein, 577 aa, Bacillus cereus G9241
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLDNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKCFWCIDRNGLVTDNMEDLLDFQMPYARKEAEVSEWKQNGVIGLAEVVKHVKPTILIGTSTVAGAFKEEIIKDMASHVERPIILPMSNPTPLAEAKPADLIEWTEGKALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVRI

SEQ ID NO: 31577 - protein, 162 aa, Rhodopseudomonas palustris CGA009
MNVTATARSLLLTEFVSAFFLAMRYFFKPKPTINYPFEKNPISPRFRGEHALRRYPNGEERCIACKLCEAVCPAQAITIEAGPRRNDGTRRTVRYDIDMVKCIYCGFCQEACPVDAIVEGPNFEFATETREELYYDKARLLANGDRWEREIAKAISLDAPYR

SEQ ID NO: 31578 - protein, 375 aa, Kineococcus radiotolerans SRS30216
MSDYYDVLGVSRDASAEDIKRAYRKLARKLHPDVTSDPDAGEKFKEVSQAYETLSTPDKRAAYDRGGSMPGGAAGGFGAGFGFSDIMDAFFGQGGGGRPGAPASRTQRGQDALIRVDVDLAEAAFGGERSIQVDTAVLCTTCQGSCCQPGTSPATCDICHGQGSVQRVVRSLLGQVMTTAPCPTCHGYGTVLPSPCLECNGEGRTRARRPLTIRIPAGVDTGTRIQLASQGEVGTAGGPPGDLYVEIHERPHPVFSRNGDDLLCTLHVPMTAAALGASIPLETLDGSAEEVDVRPGTQGGEVITLKQKGAEHLRAQGRGDLLVTLEVTTPRDLDDEQEELLRRLAELRGEVRPAGKLAPAHQGVFSKLRGKFSGR

SEQ ID NO: 31579 - protein, 490 aa, Escherichia coli K12
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 31580 - protein, 416 aa, Solanum tuberosum
MGICLSNEIKAETTIFTGTGVGSRNVSGNGTETSNSNSKVSSGSVPPTPRSEGEILQSSNLRSFTFNELRASTRNFRPDSVLGGGGFGSVFKGWIDEQTLLASKPGAGIVIAVKKLNQEGLQGHREWLAEINYLGQLRHPNLVRLVGYCLEDDHRLLVYEFMPKGSMENHLFRKGSYFEALSWSLRMKVALGAARGLAFLHNAEASVIYRDFKTANILLDSNFNAKLSDFGLARDGPTGDKSHVSTRVMGTYGYAAPEYLSTGHLTAKSDVYSFGVVLLEILSGKKAIDKNRPTGEHNLVECSRPYLTSKRRVFRVLDSRLEGQYSLTRALKVANVALQCLAMDPKSRPTMDEVVTALEQLQESKDRVKNDKNKDQQLNRLSSQSSGELNKSFRSNSEETPRVANYPRPSASLRSI

SEQ ID NO: 31581 - protein, 923 aa, Lupinus albus
MEHQHSWILRLVSYIICLYIFIRSASATEGFESIACCADSNYADPLTTLNYTIDHSWFSDKGSCSQISKNVTNYGSNENVRLFDIDEGKRCYNLPTTKNGVYLIRGIFPFGELSNSSFYVTIGVTQLGSVISSRLQDLGIEGVFRATKNYIDFCLVKEKVNPYISQLELRPLPEEYIHGLPTSVLKLISRNNLKGEGDDIRYPVDKSDRIWKGTSNPSYALLLSSNATNFDPKTNMTPPLQVLQTALTHPEKLEFIHNDLENEGYEYRVFLYFLELNSSLKAGQRVFDIHVNSEAKVERFDILAEGSNYRYTVLNFSATGLLNLTLVKASGSENGPLMNAYEILQVRPWIEETNQTEVEVIQKLRKELLLQNQDNKVIESWSGDPCIIFPWQGIACDNSSVITELDLSSSNLKGTIPSSVTEMINLKILNLSHSSFNGYIPSFSMSSLLISIDLSYNDLMGSLPESIPSLPHLKSLYYGCNQHMSEKVPANLNSSLIKTDCGKCQADNPKFGQIIVIDAVTCGSILITLAVGLILVCCYRLKLTPSEGFGEKNYPMATNIIFSFPASKDDFFIKPLVVTIQIFTLEYIEVVTERYKTLIGEGGFGSVYRGTLEDGQEVAVKVRSATSTQGTKGFDNELNLLSAIQHENLVPLLGYCNEKDQQILVYPFMSNGSLQDRLYGEPAKRKILDWPTRLSVSLGAARGLAYLHTFPGRSVIHRDVKSSNILLDHSMCAKVADFGFSKYAPQEGDSYVSLEVRGTAGYLDPEYYSTQQLSEKSDVYSFGVALLEIVRGREPLNIKRPRNEWSLVEWAKPYIRASKIDEIVDPGIKGGYHAEAMWRVVEVALQCIEPMSAYRPCMVDIVRELEDALIIENNASEYMKSIDSLGGSNHYSIVMEKRVLPSTSSSTAESTITTQTLSQPQPR

SEQ ID NO: 31582 - protein, 304 aa, Solanum chacoense
MASIRWSRGRTIGKGAEGTVTLATTHNNFSIAVKSSLFSCSKSLQKEREFLNEFQDCSQIIRCFGADVTEEDNNILYNILLEYAIGGSLAHRIGKKSGLPDFEVKKYSKPILLGLRVVHGKGFVHGDIKPHNILLVGTEKRAKIADFGFASKVGIGSKKRKLRGTPMYMAPESVLDDEYGTPADIWAFGCTVFEMITGKKVWDCTGINDPLHLLCKIGMQSPDLHDDKMSKQAEDFLNKCVDRDPHSRWTADLLLNHPFLSSDNNDVHQRKRKELNLVDLCNSTELKPMKLLTNKRRRKLVERC

SEQ ID NO: 31583 - protein, 70 aa, Triticum aestivum
  misc_feature (2)..(3): Xaa can be any naturally occurring amino acid
  misc_feature (9)..(9): Xaa can be any naturally occurring amino acid
  misc_feature (31)..(31): Xaa can be any naturally occurring amino acid
  misc_feature (39)..(39): Xaa can be any naturally occurring amino acid
  misc_feature (43)..(44): Xaa can be any naturally occurring amino acid
  misc_feature (48)..(48): Xaa can be any naturally occurring amino acid
MXXTPTIIXALLGLATQMYSNALRKLPYMRXHPWEHVLXMGLXXVFVXHLVKVLMRRVLTCERGEPPSRL

SEQ ID NO: 31584 - protein, 137 aa, Zea mays
MSGEGWLFLFSVLLSAVLLFTMVFFIIMFSDLECDYINPIDLCNKLNQFILPEMAAHAVLTVFFLLSGQWIAFLLNVPLVAFNVNKVMNKNHTLDATEIFRTLSAHKKQCFIKLGFYLISFFYYLYRMILALIADTE

SEQ ID NO: 31585 - protein, 142 aa, Methylobacillus flagellatus KT
MKTVRQVLETKGSTVYSVAPESLVYDALLLMAEHHIGALVVMQRDKMVGIFSERDYAREVVIKGKTSKTTTVGDIMSVQLITVSPDDTVEHCMNLMSGKRIRHLPVLEGEKLVGLLSIGDLVKETIAYQEFLIKQLESYIQS

SEQ ID NO: 31586 - protein, 230 aa, Vibrio angustum S14
MKNTRIVLLRHGQSVWNKENRFTGWANVSLSELGENEARNAGIKLKENGFNFNFCYTSMLDRAIKTSNLALEQLDSLWIPVEHDWQLNERHYGDLQGLNKAETAEEFGDEQVHIWRRSYDIEPPQVSEDSFFYPGNDRRYQELQHSQLPHGESLKDTYDRVIPFWNESIVPNVKQGSDILIAAHGNSLRALIKYLDNIPDDKITKLEIPTGAPLVYEFNEQMKPVKSYYL

SEQ ID NO: 31587 - protein, 142 aa, Synechococcus elongatus PCC 6301
MSFTETPESLFEDGIHRYQAGEPPADLVPVFQSICDRQPRSSASWTCLSWLYLLLDEPRQAMKAAQRAVKLNPQDPQARVNLALAMLETDTKGVRQHIDIALRVITVSAELRQDLRESLADGQKRKPNWPSLDRVQHWLFPI

SEQ ID NO: 31588 - protein, 369 aa, Leptospira interrogans
MSERSYYDILGVSKSANDEEIKSAYRKLAIKYHPDKNKGNKESEEKFKEATEAYEILRDPKKRQAYDQFGKAGVSGGAGGFGQGAYTDFSDIFGDIFGDFFGGGRSSGFGGGRRSGPQRGSDLRYNLEVSLEDAALGREYKIEIPRLESCVDCNGSGASKGSSPATCPDCGGSGQIRRTQGFFSVATTCPTCRGKGTIISNPCRSCGGQGLQEKRRTINIKIPPGVETGSRLKVSGEGEAGPNGGPHGDLYVVTHIKKHELFERQGNDLILVRKISLAQAILGAEIEVPTIDGKKAKMKIPEGTESGQVFRLKGHGMPYLGAYGKGDQHVIVKIEIPKKITRRQRELIEEFARESGENIPGSKGKIFTK

SEQ ID NO: 31589 - protein, 163 aa, Solanum lycopersicum
MDLRTFLKWFAIHLCYSFSTKIVASLPTAEVEPIRSNYSQCWKVVEDFLLSVSMFKVCPLILYRLGTKLTRAEVADKVKYFFKYYSIPSIDGQRRLAQVVRLTLEKKHHHHHLRLNPKQVDVNYVGFYSYVIHPKRQHKRNGCCSNWLGRLKGSRFILSSTCS

SEQ ID NO: 31590 - protein, 558 aa, Ralstonia eutropha JMP134
MVTKFDLGLDQRAANYQPLTPLHFLNRAEDVYPHRIAIIHGDRSYTWKEYAGRCRKLAGALIDHGIERGDTVAILAPNTPAMLEAQFGVPMAGAVLNCINIRLDAAAVSFILRHSETRLLFVDQQFAEVARAAIAVLGEPITVVDITDPEVAGSRPVGRIEYESFLASAPDTPDIRLPLSEWDAIALNYTSGTTGNPKGVVYHHRGAYLNALGQLVNAELSGDAPVYLWTLPLFHCNGWCYAWALAAVGATQICLRKVSGATIYDAIANHDVTHFCCAPTVLSFLIESVPPSWVPPARPIRVLSGGASPPPAVFRRLIELGFRVQHVYGMTEMHGVATICQSQEAWQALPEEEHLVHLTRQGVRTVVMNEMMVADPKTLSPVSRDGSAMGEILLRGNLAMKGYFKNASATEEAFAGGWYHTGDLAVVHADGYIEIKDRSKDIIISGGENISSVEVEDVLYEHPAVAGAAVVAVPDPRWGEVPCAIVELKADLAGGVNASEIISFCRARLPGFKAPQHVIFDSLARTATGKLQKFKLRESALQHLVGNGAIGPDSGTTE

SEQ ID NO: 31591 - protein, 1631 aa, Solanum lycopersicum
MHGRIQREQGQVCKKGSGSGGQHMPATTTRRTVDVGGSSIVNTVTADSFCKDGRKIRVGDCALFKPPHDSPPFIGIIRRLRLGKDNNLQLGLNWLYRPAELKLSKGILLDTTPNEIFYSFHRDETPAASLLHPCKVAFLPKGAELPTGISSFVCRRVYDISNKCLRWLTDRDYNNEQQKEVDQLLYKTQVEMHATVQPGGRSPKPMNGSISSSQLKTGSDNIQSSVASFPSQVKGKKRERGEQGSESIKRERSVKSDDSESVLKSEISKITEEGGLVDCEGAAKLVQLMQPDRVDRKMDLTSRSMLASVVAATDKFDCLARFVQLKGLPVLDGWLQDVHRGRIVEVSNSKDGDISIEEFLLVLLRALDRLPVNLQALQMCNIGKSVNHLRQHKNMEIQRKARSLVDTWKKRVEAEMNMIDSKSGSNQAVTWPSKARLPEASHSGEKNAGGSTDATRSSVTQFSASKTTSIKPTPVETNMKSACSSPGPIKQASPPSSGKVGQPRISAFGSSDVPLAREDKSSSSSQSHNHSQSLSGKEDARSSTAVSMSSIKISSGGSRHRKSINGGPGPSVSAGQKEGSTNRSSSLHRNPTTEKSLQSALSGEKTVDVPAVEGSCHKLIVKIPNKGRSPARSVSGGSCEDPSIMSSRASSPVLSEKNDQLDRNSKEKKDAYRSDVTINVNTESWQSNVLKDVLTGSDEGDGSPVAVLEEERRKTAGEGRKSAEVAKPGSSSSGTELKSGKLHEASFSSMNALIESCAKYSEANASMSLSDAVGMNLLASVATEEMSKSGRVSPFVSPQGDSPSGGETCTGDELKPKTSPVDSSSGNHSGRNDGDANGDKEKQFVVANTSWSEGKVHANRSAMTDFNRERRPSSSPSEETTTGECFNSSCTDSQMAGNLKSGVNEKLVEMAKSAAAPCNVFEKASDGEQSRQFHEEKVISTKTLDNVLDGESGGHGSSIGEDKVTNGLVSIEGLKRPVGISAFKYEGDDKNDVSRVLGVASTEVKPPSVVVKSEATERGDKEELQQTGSSRDTIAGKGGHSDEMDANSVLKSEQPNSDKKTVDTSVIEDKAASECNLAIRNLTKDEPKAEEMTKHDSGSGLLTKKETPGFSNAEVENLESRESKYSGVEADRPKECVSIKGENSSSSAAAAPDSASKMKFDLNEGFISDEGKYGESINSTGPGCLSNVQIMSPSTFAVSSVSSSLPASITVAAAAKGPFVPPEDLLRVKGEFGWKGSAATSAFRPAEPRKPPDMHSNSMTISVTEASSSKHGRPPLDIDLNVADERVLEDINSQDCALAIGSAVDHITNLVSSKNKCSGPLRSFGGLDLDLNRVDEPNDVGQCSLSSSHRLEGAVFPARASSSSILPTAEVRRDFDLNNGPGVDDSCAEQPLFHQSHQGNMRSQLNASSLRMNNPEMGNLSSWFAPGNSYSTMTIPSMLPDRGEQPPFPIIPPGAPRMLGPSAAGSPYTPDVFRGSVLSSSPAMPFPAAPFQYPVFPFGTTFPLPSGTYAVGSTSYIDSSSGGRLFTPPINSQLLGAVAPQYPRPYMVSLPDANSNGATDHNRKRSRQGLDLNAGPGAVDLEGKEESVSLVTRQLDEHGRMYPVAGGLLKRKEPEGGWDSESYRFKQSPWQ

SEQ ID NO: 31592 - protein, 402 aa, Rhodopseudomonas palustris CGA009
MADAAAPDAASVRNFTINFGPQHPAAHGVLRLVLELDGEVVERVDPHIGLLHRGTEKLIEQKTYLQAIPYFDRLDYVAPMNQEHAFCLAVEKLLGIAVPRRAQLIRVLYAEIGRILSHLLNVTTQAMDVGALTPPLWGFEEREKLMMFYERASGSRMHAAYFRVGGVHQDLPPKLVDDIDAWCDAFPAVVNDLDRLLSDNRIFKQRNVDIGVVTLDQAWSWGFSGVMVRGSGAAWDLRKSQPYECYAELDFEVPIGKNGDCYDRYHIRMEEMRQSVRIMKQCIAKLRAPHGQGPVVVDDHKIFPPRRGEMKRSMEALIHHFKLYTEGFHVPAGEVYVAVEAPKGEFGVYLVSDGSNKPYKCKIRAPGFAHLQAMDFLSRGHLLADVSAILGSLDIVFGEVDR

SEQ ID NO: 31593 - protein, 204 aa, Rhodopseudomonas palustris CGA009
MDDNGLDTLGQTIVGALPGIATGHSVGFGQLTLTVDAGKIVEVMRLLRDDPRFRFISFIDMTAVDYPGRAERFEIVYHLLSPKLNERVRVKAEVGETTLVPSIIEVFPGADWFEREAYDLYGIVITGHPDMRRLLTDYGFDGHPLRKDFPLTGFVEVRYDDDQKRVIYEPVRLNQEFRKFDFLSPWEGADYPVLPGDEKAGVKS

SEQ ID NO: 31594 - protein, 377 aa, Prunus avium
MTFSLRKEEILIDILVRLPAKSLVRFLCTCKSWSDLVGSSSFVSTHLHRNITKHAHVHLLCLHHPNVRRQVNPDDPYVTQEFQWSLFPNETFEECSKLSHPLGSTEHYGIYGSSNGLVCISDEILNFDSPILMWNPSVRKFRTAPTSTNINLKFAYVALQFGFHHAVNDYKVVRMMRTNKDALAVEVYSLRTDSWKMIEAIPPWLKCTWQHHRGTFFNGVAYHIIQKGPIFSIMSFDSGSEEFEEFIAPDAVCSSWGLCIDVYNDQICLLSGFYGCEDEGLDKIDLWVLQEKQWKELCPVIFPPLGDCDRIIGISIGIELLMEKKDFDKGVGELYLCNYESKQVLQTGIKLAVMKYDEIEFVFAITYTESLVLLNNY

SEQ ID NO: 31595 - protein, 360 aa, Bacillus clausii KSM-K16
MTTQKLEIMKCTHKKQKPESSALEFGKYFTDHMFIMDYSEEKGWYSPRIIPYQPLTLDPAAMVFHYGQTVFEGLKAYRSEDGSVRLFRPEENFKRLNQSSDRLSIPPIDEAQMLAYLKELIRIDKDWIPTMPGTSLYIRPFVIATEPTLGVAPSRNYKFMIILSPVGAYYKEGINPIGIFVEDQYTRAAPGGTGTAKTAGNYCAAYKAQERATANKQAQVLWLDGMEKKYVEEVGSMNVFFKLNGEVHTPGLSGSILEGITRKSVIELLKSWDIPVFERRISIEEIVSASKSGTLEEVFGTGTAAVISPVGELLWKDHKIVVNNNETGALSKRLYTELTGIQTGEQKDPFGWTVRLEDEE

SEQ ID NO: 31596 - protein, 510 aa, Vibrio parahaemolyticus RIMD 2210633
MSAKKPLALVILDGYGYREDTASNAIANAKTPVMDALIANNPHTLISASGMDVGLPDGQMGNSEVGHTNIGAGRVVYQDLTRITKSIADGEFEQTPALVEAIDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWERVQVAYDLLTQAKAEFTAETAVAGLEAAYARDENDEFVKATAIKAEGQEDAIMQDGDAVIFMNYRADRARQITRAFVPGFDGFERAVFPAINFVMLTQYAADIPLATAFPPASLENTYGEWLSKQGQTQLRISETEKYAHVTFFFNGGVENEFEGEERQLVASPKVATYDLQPEMSSPELTEKLVAAIKSGKYDTIICNYPNADMVGHTGVYEAAEKAIEALDESVGKVVEAIKEVGGQLLITADHGNAEMMIDPETGGVHTAHTNLPVPLIYVGDKAVEFKEGGKLSDLAPTMLSLAGLEIPAEMSGDVLVK

SEQ ID NO: 31597 - protein, 375 aa, Prunus avium
MTFTLRKKEILIDILARLPAKSLIRFLCTCKSWSDLIGSSSFVSTHLHRNVTKHDHVYLLCLHHPNFERLVDPDNPYFKKEFQWSLFSNETFKQCYKLNHPLGSTEHYVIYGSSNGLVCISDEILNFDSPIHIWNPSVRKFRTPPMSTSINIKFNYIALQFGFHPRVNDYKAVRMMRTNKDALAVEVYSLRTDSWKMIEAIPPWLKCTWQHHKGTFFNGISYHIIEKCPIFSIMSFDSGSEEFEEFIAPDVICSSWGLFIDLYKEQICLLSSFYSCEEKGMRKIDFWVLQEKRWKQLCPFIYPSHYYGTLGISKDNELLMEKRDFSRGIGDLHLCNYESKQVLETGIDLATIKYGEIEFLFAITYIESLVLLNNT

SEQ ID NO: 31598 - protein, 884 aa, Kineococcus radiotolerans SRS30216
MVRACGSWSRKVARTARAEATRLSTSATSAVTSVADVDRSVCRPRAAMPSRTPSKAAEGTRRVSRACSPSGSPEPPARLAATTPPAVVTRSSTAACAAAGSATSTPRVAVETTARAAPPTSAAGSAAGAAAAVPALSSAATAAPESAPELSPEPPPAAGALSAAEDPPPESEPYPLQAVAPSSRAARSAGTARAVRRRAGARCGGEGGQRGHRAPPAGSVAVTVGVGRRRAPGGSARADGPGTGRATMGTRSNAPDERCSPPVSPMATDAPAPAATAPELLRNFCIIAHIDHGKSTLADRMLQLTGVVDARAMRAQYLDRMDIERERGITIKSQAVRMPWGYDGTDYALNMIDTPGHVDFTYEVSRSLAACEGAVLLVDAAQGIEAQTLANLYLAMENDLTIIPVLNKIDLPAAQPEKFAEELAKLIGCEPDDCLRVSGKTGVGVEPLLDQIVRQIPAPVGDADAPARAMIFDSVYDTYRGVVTYVRVIDGNLSPREKIVMMSTRATHELLEIGVSSPEPVPSKGLGVGEVGYLITGVKDVRQSKVGDTVTNAAKPSTKALGGYRDPKPMVFSGLYPIDGSDYPLLRDALDKLKLNDAALSYEPETSVALGFGFRIGFLGLLHLEIVRERLEREFNLDLISTAPSVPYEVTLEDKRVVEVTNPSEFPEGKIAEVREPVVRATVLAPSEFIGAVMELCQQRRGELQGMDYLSEDRVEMRYRLPLAEIVFDFFDQLKSRTRGYASLDYDVDGDQAADLVKVDVLLQGEQVDAFSQIVHREKAYGYGVMMAGKLKDLIPRQQFEVPIQAAIGARVIARENVRAIRKDVLAKCYGGDITRKRKLLEKQKEGKKRMKMVGRVEVPQEAFIAALSSDAAGDKAKDKNAKK

SEQ ID NO: 31599 - protein, 445 aa, Propionibacterium acnes KPA171202
MDRQLENAYESVLRRNPGEAEFHQAVREIFESLGPVLDTNPQYVEAAVLSRICEPERQIIFRVPWVDDEGKIRINRGFRVEYSSVLGPYKGGLRFHPSVYLGTIKFLGFEQIFKNALTGMPIGGAKGGSDFDPHDASEAEVMRFCQSFMTELYRHLGEHTDVPAGDIGVGSREIGFLFGQYKRITNRHESGVLTGKGLTWGGSLVRTEATGYGTVFFVQRMLATNGKSLDGLRVTVSGSGNVAIYAIEKAQDLGATVVACSDSSGYVVDEKGIDVALLKQIKEVERARICEYAARRDSATFHSDGSIWDVPVDVALPCATQNELNGQAAATLIRNGVVAVAEGANMPCTPEAVHSFQDAGVIFAPGKASNAGGVATSALEMQQNAARDSWDFDATEARLQQIMADIHDRCIETADEYGHPGDYVMGANIAGFTKVADAVIAMGVV

SEQ ID NO: 31600 - protein, 405 aa, Propionibacterium acnes KPA171202
MSSTGSSVSTSGLVLPSTPLAEPGKEVPLVVNTPNRAKPPRHWIDLSIEERVQAVKDFGVPAFRARQISAHVFERWEVDPTQWTDLPKAARQEIADAWFPVLLTKVSQQSCDRGTTVKTLWRLHGGALVESVLMYYPATRHSAARATLCLSSQAGCGMACPFCATGQGGIQRNMSTAEIVSQVLAANRLIAAGEVPGASGRVHNIVFMGMGEPMANYRSVLTAIRTLTADGPDGVGMSARALTLSTVGLVPRIKALTQEGIPVTLAVSLHAPDDELRDELIPVNRRWKVDELLDAAWHYAEKTKRRVSIEYALMKDINDQADRAAVLARQIRRRGDWTWAHVNLIPLNPTPGSRWTASRPEDQDAFVETLERWKIPVTVRDTRGSEIDGACGQLAAVGRSEGLGS

SEQ ID NO: 31601 - protein, 317 aa, Oryza sativa
MAADALVVAGQAKARHPLSQIAESGTHRLLLKQWLKEEDLLARRVALREARLDGARKEIAFLYCAFFAFHAASILLLFLSASASTSAACRRSWIPCLVSLLSSLAMLWALRYKADTEAVLERLLAREREDALLLGKCVAELKRKGLEFDLLKEVDALRRAKSLRVEAKGGAGGERPKRWAARDLAVFLLFGAACGVLVLTRCKLIKGPRAASWLAVDRARERGRRKRLTGVSRSGRAEVAPTWRLRGCHAGRLEEDEGAGCEWTAGSGGFSGTPCDDEGRRGGNTPWEAGDERWLPDSGGDGGEPTASDGSSRGGAS

SEQ ID NO: 31602 - protein, 764 aa, Triticum aestivum
SGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFKGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNTYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 31603 - protein, 838 aa, Synechococcus elongatus PCC 7942
MTLTRFQPTAGNESRDQRFVLWFEEVGIDDIPLVGGKNASLGEMIRELLSKGVNVPLGFATTAAAFRFFLAGAGLEPQLRQLFADLDVEDVVNLRERGRQARNLILNTPFPAELETAIATAYQQLCDRYEPTPAVCDRLSGLDRDRCQRQFGSVDVAVRSSATAEDLPDASFAGQQETYLNVRGVQAVIQACHRCFASLFTDRAISYRQIKGFDHFEVALSVGVQKMVRSDLAASGVMFSIDTETGFRNAALVTAAYGLGENVVQGAVNPDEFFVFKPTLQQGFRPTLDKRIGSKEIRMVYDEGGSKLTKNVSVAESDRQRFAISDDEVLQLAQWACIIEDHYSAKRGCFTPMDIEWAKDGLSGELFIVQARPETVQSQRASNLLRSYQLQGSGSVLVEGRAVGEMIGQGTARVILDVHHIADFQAGEVLVTNRTDPDWEPIMKKASAIVTNQGGRTCHAAIIAREMGIPAIVGCGTATTAIATGADVTVSCAEGDQGRVYAGLLPFEVHETVLDDLPRPRTQILMNVGNPEEAFGLAAIPCDGVGLARLEFIIANHIQAHPLALLHFDQLEDLFVQDQIAKLTANYDRKADFFVEKLAQGIGRIAAAFWPKPVIVRLSDFKSNEYANLLGGRQFEPREENPMIGWRGASRYYDPQYREAFALECQAFRQVREGMGLTNVIPMVPFCRTPEEGQRVLAEMAANGLKRGENGLQVYVMCELPSNVICADAFSEVFDGFSIGSNDLTQLTLGLDRDSALVAALFDERNPAVKRMVAQAIQTVKAAGRKIGICGQAPSDYPEFAEFLVEQGIDSISLNPDSVLKTLLAIAAVEARLETGRD

SEQ ID NO: 31604 - protein, 341 aa, Photorhabdus luminescens subsp. laumondii TTO1
MEKALAGKKILIVEDEPVFCSLLAGYLRTLGAKVLVASNGAVALQVLGREAHVELILCDLDMPVMNGIEFIAKLTNEGISIPVIIISATNKMAEIDEVLRLGAKDVLLKPVSDLNEIKKSVLAYLHPTVFMSGAIEQNNLNKDWLTLKHNSDEALNMLKQLQPPVSQVIAHCKVNYRKLNMIDNPGLILDMAALSDNELAFYCLDISRSKEYGVISALLLRVIFNSLLQEHIIHHSRRLPNMAAILNRINNLLEGAGLQGQFPLLLGYYHTINKTVLLTSAGLHASIKSGNRQIQLDSGVPLGTLRTICSNQVCSHSAEWQCRIWNTNSQINLMLSSMYSG

SEQ ID NO: 31605 - protein, 139 aa, Chlorella vulgaris
MAALTICSAAAGKAQAVRSSAQKPKAVAALPRLATAVGAAAVLLTSTPAFAGDLTLGQQVFDNNCPRATWAARTACSPEKTLQKAALEQYLEGGFSVASIITQVENGKGAMPAWSGRLDSDEIESVAEYVFKQAEGNLW

SEQ ID NO: 31606 - protein, 334 aa, Zea mays
  misc_feature (139)..(139): Xaa can be any naturally occurring amino acid
  misc_feature (175)..(175): Xaa can be any naturally occurring amino acid
MASKEDTMKSLVKVLVDCAEDATKSLRGLVDHALDHMHDEEILARTLFAMKEKLDLLHQDALEAKVQAFPEIAKYEGDDISVEPTSPSTPPTVTEPSVDEEEFYCPDGSNTIHQLPVNLESDAEHSVQDINSPGKNAPXVQKQKKSKEQNFTAPEDILLCSTWLQISSDPIVHTXQRREGLWARIEKRYNEQRGEFPCRLNRALSSRWDKIRADVSKFSGYYARVLREKQSGISDEDKTSKAATLFAHEENKPFHYMHCWHKLKGEPKWESICQGHSFRGLHARSIPSSGCPSVEAPETDSGSAGLTGKRPRGRDYSKVERKKGASSSSPEYLS

SEQ ID NO: 31607 - protein, 492 aa, Glycine max
MGARCSKFSLCWWPSHLKSNLHNLSDNDDDGKRDENDPRGGFSEYSLDQLRVATSGFSPDNIVSEHGEKAPNVVYRGMLEDDRLVAVKRFNKSAWPDSRQFLDEARAVGQLRSERLANLVGCCCEGEERLLVAEFMPNETLSKHLFHWEAQPMKWAMRLRVALYLAQALEYCSSKERALYHDLNAYRILFDQEANPRLSCFGLMKNSRDGRSYSTNLAFTPPEYLRTGRITPESVVYSFGTLLLGLLSGKHIPPSHALDLIRGKNFLLLMDSCLESHFSNDDGTELVRLASRCLQYEPRERPNVKLLVTALTPLQKETSVPSNVLMGIPDRSLSSKETVSLTPFGDACSRRDLTAIHEILEKIGYKDDEDVANELSFQMWTNQIQETLNSKKQGDSAFHARDFSTAIDCYTQFIDGGTMVSPTVYARRCLCYLMNDMAQEALGDAMQAQSISPTWPTAYYLQAAALFTLGMDNDAQESLKDGTTLETRKYRN

SEQ ID NO: 31608 - protein, 487 aa, Cryptococcus neoformans var. neoformans JEC21
MNQPSTLAQAHPDHPTLAELVADRPDPATATPLGHDIASPQHTTTPTSMSDADSSPASPEAPRRPGGLSEGPNARSKSVTVASGEDTFGALNCHPGPGSAAISNSNLPADSFRVGVSEDRNRRCRRTMEDAHSFVYDFAGVKGQGYFAVFDGHAGKHAAEWCGQNFHEYLLDGLLIEPDTPVPDLMNKTFHLVDKRLSHLAHAAGTSSGCTAVTAFLRVEEMDDNDSFRKGFTNPGLQPRGLWEGKGEDELESQTSLQPSSRRSSMGGGTGGQMGGASAPGVNGRTGSLARRLSSKKIRDFVKGLTGGMEKNFDEAITEDEGVISAADGTRVEAIEPKSEKGVRRVLYTANVGDARAVLCRGGKAVRLTYDHKGSDAQEAKRITDAGGFVMNNRVNGVLAVTRSLGDASMKEFVVGAPYTTETTLDEQDEFLIVACDGLWDVCSDQEAVEIVHLVTDPQEASKRLLDHAMSNFSTDNLSVMVVRFNH

SEQ ID NO: 31609 - protein, 189 aa, Triticum aestivum
  misc_feature (59)..(59): Xaa can be any naturally occurring amino acid
  misc_feature (165)..(165): Xaa can be any naturally occurring amino acid
MPRHSGDSQYTAPSIATEKVCSHAKSYDMIESRIKRLDEDLVQFADDFIQEEEIPADEXPHIVPPMPMGGRDDRRRYSYSTLQAARKFVREKEWDRDRERGMDLALILLPGSSSKRVALHVWIDGSNELIHNEATYRICQQVSYGDTSVLCDNENCEGGEWFHWXCDVGVTPETRFIGKWFYPDRRNVQ

SEQ ID NO: 31610 - protein, 411 aa, Schizosaccharomyces pombe
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFLLMPETLYLAVNIIDRFLSRRSCSLSKFQLTGITALLIASKYEEVMVPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSLKRFLKASIFVHQLVRNDTSVNRTDDDDLQSEPSSSLTNDGH

SEQ ID NO: 31611 - protein, 214 aa, Zea mays
SVGEMIAAVNRVPAGWGEDEMSVLPRHTKVVVTGNNRTKSVLVGLHGVVKKAVGLGGWHWLVLTNGIEVKLQRNALSVIEPPTGNEDDDKFDCENLRWNSSDLVSDDAQSPKPQRSRSRQHRGFHRKSFSRSMSCDSQSKTSVSSSSRAHTKVDLSKLELTALLRYWRHFNLDACPNPSREQLVDAVQRHFTAQVDKTNLTSDSSNLHHYGVRS

SEQ ID NO: 31612 - protein, 206 aa, Zea mays
VRVSVLNDALKSMYNAEKRGKRQVMIRPSSKVIIKFMTVMQRHGYIGEFDYVDDHRARKLVVELNDRLNKCGVISPWFDFGIKKIDGWTARLLPSSQFGYIVLQPCIELCLCAQHPVTGRRTSSSPWRAPLDHRLQQPLLCPTLCAAGGIQCADQTGRKKTLWSLIIQSRARIRLGRNPWLNKSCALVVDPTTDLRQYPFGQVTIA

SEQ ID NO: 31613 - protein, 343 aa, Trichodesmium erythraeum IMS101
MIQERTVPKFDTNSVKITKEKALILYEDMVLGRLFEDKCAEMYYRGKMFGFVHLYNGQEAVSSGVIKAMRQDEDFVSSTYRDHVHALSAGVPAREVMAELFGKATGCSKGRGGSMHMFSATHNLLGGYAFVAEGIPVATGAAFQSKYRRETMGNQAADQVTACFFGDGACNNGQFFECLNMAALWKLPIIYVVENNKWAIGMAHERATSEPEIYKKAHAFGMVGVEVDGMDILAVHSAAQEAVARARAGEGPTLIEALTYRFRGHSLADPDELRDQEEKQYWFSRDPIKKFTTYLTENNLVDVAELVAIDKKIENLITEAVDFATNSPEPGSDELYRYIFAED

SEQ ID NO: 31614 - protein, 210 aa, Brassica napus
  misc_feature (204)..(204): Xaa can be any naturally occurring amino acid
QDVLMMMMTSLGGGGGGRFMTYPPPLSVPPSAPQSPNFSGGLRSQSSFLVEQEKYLSELLAERHKLTPFLPVLPHVCRLMNQEILRVTTLLENALTQSRFDHPSPLSSSGGIFQNSRADMNGGWPSQFPSERPLSSSPAPNWLNSPGGSSGLIVKRSIRVDIPVDQYPNYNLVGRLWGPRGNSLKRVEASSECRVLIRGRGSIXDPVKED

SEQ ID NO: 31615 - protein, 559 aa, Neurospora crassa
MPLKSRWAVDVPRCSLQQWIFDSPCGPLPDRRAYIDPEQPDTNYLDLSSYRLLAKRVALGLQQAGLKEGDRVLLFSGNNIFFPSIFLGILMAGGIFTGANPSFVARELAYQLRDSEASFLVTAQGSLETAFQAAKEAGLPRDRIFVLGGDTPAAQEVVLSSNPGPGLKGRVAGARHWTELLQGNAKEAESWSWKEPKDPQTTTCCLNYSSGTTGVPKGVEISHYCYVANGVQVIHLNNLNPDWEERQKRARALCFLPLYHAYGQTYFVANMPRAGIPIYIMPSFDFVKMLEYVQRYRITSLTCVPPIVVALAKSPLTKKYDLSSVEGLGSGAAPLAKEVSDEAEKLFNGKFRLRQGWGMTETTCTCMSWDPLNKEPSSGVGEMMPNCSGKLMSLDGKVEITKAGERGEFWVTGPNLMRGYWRKPEATAETVVVDADGTRWLKTGDIAYFDAYKPGGIVHIVDRLKELIKVKGNQVAPAELEGLLLEHPEVADAAVIGVTINGEEVPRAYIVRQNPKSKITGQEIAGWMAGKVTRYKQLKGGVVFTDNIPKNPVSSDYIF

SEQ ID NO: 31616 - protein, 319 aa, Staphylococcus aureus subsp. aureus N315
MRRLFSIGEALIDFIPNVTNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 31617 - protein, 211 aa, Glycine max
MGKAWVGLVVLLCLIVTAIAEQCGRQAGGQTCPNNLCCSQYGWCGNTEEYCSPSKNCQSNCWGGGGGGGGGGGGESASNVRATYHYYEPEQHGWDLNAVSAYCSTWDASKPYSWRSKYGWTAFCGPVGPRGRDSCGKCLRVTNTGTGANTIVRIVDQCSNGGLDLDVGVFNRIDTDGRGYQQGHLIVNYQFVDCGNELDLTKPLLSILDAP

SEQ ID NO: 31618 - protein, 143 aa, Zea mays
  misc_feature (24)..(24): Xaa can be any naturally occurring amino acid
  misc_feature (73)..(73): Xaa can be any naturally occurring amino acid
  misc_feature (84)..(84): Xaa can be any naturally occurring amino acid
  misc_feature (129)..(129): Xaa can be any naturally occurring amino acid
FGSRQIFTPYFAAWRDLAETCGAXQGSRQAAFGKAELISGQQTNPLYNIIYAEAPLTIGGLENIQTADTYFAXAWQLTGGPNTXALFVLRKCTSAIYHLTKGRNKYEDGSELHTLTAKVSRNNFLKKAXTNAPLMSTSLKNMK

SEQ ID NO: 31619 - protein, 368 aa, Nostoc punctiforme PCC 73102
MTTNVTSSIVERGKTNVKAQVFRGVNQLSYEDIPVPTVEPDEVLVQVRVVGLCQSDIKKIRYPLYEPPRIFGHETAGTIAAIGNNVKGWQVGQRVAVMHHIPCMRCAYCLNDNFSMCDVYKNISTTAGFNASGGGFADYVKVPGHIVENGGLIPIPDNISFEEASFVEPTNCCLKAVRKAQIAPGQTVLVTGAGPIGLMFIMLVKYFGAKAIATDLLPSRIDKALSVGAEAAFDARDPDLPAKISALTGGLGVDVTLLAVPSEKAFFQALDSTRKGGKILFFAEFPDEVEIPINPNILYRREIDLIGSYSSSYRLQNLSADIVFNQRIDVKALISDRYPLKDLSAAVEQAIAPTPDTYKILIYPQKED

SEQ ID NO: 31620 - protein, 139 aa, Brucella melitensis 16M
MSIFPAQPSDKKAVEEGAAFMPRFDASGLITAIVTDARDGELLMVAHMNEEALRLTLETGIAHYWSRSRKTLWKKGETSGNLQSVVELRTDCDQDALWLKVHVAGDGPTCHTGRRSCFYRQVVSSGGKVALTMASDHDQ

SEQ ID NO: 31621 - protein, 129 aa, Brassica napus
  misc_feature (14)..(14): Xaa can be any naturally occurring amino acid
FFIKNLTMCCVLFXDFTDPSKNLREKETKRQTLLDLVDYIATVPTKFTDAAMQEIAKLAAINLFRTFPTTANHESKILETLDGNDDEELALEPAWPHLQLVYELLLRFVASSMTDAKLAKRYVDHSFVL

SEQ ID NO: 31622 - protein, 176 aa, Methylobacillus flagellatus KT
MNIKSLIRTIPDYPKPGIQFRDITTLLKDASGLRQVVDALVERYAGAKVDKVVGIESRGFIVGAAVAYELGVGFVPVRKKGKLPGDVLGHDYALEYGTDRVEIHSDAISPDEHVLLLDDLIATGGTAEAAAILIEKLGGHVLECAFIIGLPDLGGERKLRVLGYKTFSLCQFEDSE

SEQ ID NO: 31623 - protein, 117 aa, Ralstonia eutropha JMP134
MFSRKPYSDWVEHAGLIFFSGKTGANADGSIPANFPAQASNAMSNVSTALSNAGCEWRDVIKVTVFLTDMRDYDSFNTTYTEHLDGVFPARSCVAVVGLPRGAAVEIEVVARRTAAR

SEQ ID NO: 31624 - protein, 499 aa, Rhodopseudomonas palustris CGA009
MELLTPAEMDRADLLTIAGGSSGFALMLHAGRHVAQAAIEMADEGPILVIAGPGNNGGDGLIAATELVALGRTVHVMLLGEREALKGDAALAAREWRGPLLPFLTQSIGAPALIIDALFGSGLNRPVKDQALKVIEAVNHSGVPVLAVDLPSGINGATGAVMGAAIRARETVTFFRRKIGHLLLPGRLHCGQVRLVDIGIEPGVLGEIRPQAFENDPDLWLPDFPVPRADGHKYGRGHAVVVSGELSQTGAARLAARGALRAGAGLVTVASPRDALAVNAAALTAVMVRPVDTPDELGTMLADRRFNAIGIGPGAGIGEETRGKVLAALAAGAAVVLDADALTSFAGHPDELFEAIKSASSPQVVLTPHEGEFPRLFSDMSNKNPLRSKLERVRVAAQRSGAVVLLKGADTVVASPDGRAAIAANAPPWLATAGSGDVLTGIITGLLAQRVPAFEAACIGVWMHGEAACEAGPGLIAEDLTETMPAVHRRLYGALGIEY

SEQ ID NO: 31625 - protein, 267 aa, Nostoc punctiforme PCC 73102
MNKTHQGQSKKTALITGAAGGIGYELACIFATHDYNLVLVDRNGLKLVEIAAKFQKKFGNLVKTIVKDLSISTAPEEIFTELQLANINVDVLVNNAGFGIYGLFHKTDLATELEMLQVNLVCLTHLTKLFVKHMVKQGEGKILNVSSAAAFQPGPLMAVYFATKAYILSFSEAIANELEGTGVTVTVLCPGSTESGFHERTGMADSKLLKGKRMMDAQTVAEIGFRGLMKGQTIVIPGFMNKLLAKCVRFVPRNLVTKIVRNMQEDK

SEQ ID NO: 31626 - protein, 312 aa, Vibrio vulnificus CMCP6
MATKTADYIWFNGKMVPWAEANVHVLTHAMHYGTSVFEGVRCYNTPKGPIVFRHQEHAQRLKDSAKIYRFPIPFSVEEIMEATRETLRQNKLDNAYIRPLAFVGNVGLGVCPPTDTEMDLIIAAFPWGSYLGEEALENGVDAMVSSWNRAAPNTIPTAAKAGGNYLSSLLVGGEARRHGYAEGIALSVDGYLSEGAGENIFVIKNGVITTPPATAAILPGITRDSIMTLAREMGYEVREANIAREALYLADEVFMTGTAAEVVPVRSVDQIQVGAGKRGPITKAVQEAYFGLFNGTTEDKWGWLDYVYPEKK

SEQ ID NO: 31627 - protein, 469 aa, Rhodopseudomonas palustris CGA009
MTTAKEVLKSIKDNDVKYVDLRFTDPRGKWQHVTFDVSMIDEEIFSEGTMFDGSSIAGWKAINESDMTLMPDPATATIDPFFAETTMVITCDILEPSTGEPYNRDPRGIAKKAEAQVKALGIGDSVFVGPEAEFFVFDDVRYSASPYNTGFKLDSSELPTNSDTEYEGGNLGHRIRTKAGYFPVPPQDSVQDMRSEMLGAMAKMGVKVEKHHHEVASAQHELGMKFDTLTHMADQMQIYKYCIHQVAHIYGKTATFMPKPVFGDNGSGMHVHQSIWKDGKPTFAGNKYADLSETCLHYIGGIIKHAKAINAFTNPSTNSYKRLVPGYEAPVLLAYSARNRSASCRIPYTTSPKAKRVEVRFPDPMANPYLAFAAMLMAGLDGIKNKIDPGPAMDKDLYDLPKEELKQIPTVCGSLREALENLDKDRAFLKAGGVFDDDFIDAFIELKMTEVARFEMTPHPVEFEMYYSY

SEQ ID NO: 31628 - protein, 327 aa, Trichodesmium erythraeum IMS101
MAQTLLFNALRAAIDEEMAHDPTVYVLGEDVGHYGGSYKVTKGLYEKYGELRILDTPIAENSFTGMAIGSALTGLRPIIEGMNMGFLLLAFNQIANNAGMLRYTSGGNFKIPLVIRGPGGVGRQLGAEHSQRLEAYFQAVPGLKIVACSTPYNAKGLLKSAIRDENPVLFFEHVLLYNLKEDLPEDEYLLPLDKAEVVQTGKDVTILTYSRMRHHVTQAVQTLKKQGYDPEVIDLISLKPLDFETIGASIKKTHRVIIVEECMKTGGIAAELIASINEKLFDELDAPILRLSSQDIPTPYNGLLERLTIVQPEQIVEAVQKMVAIKV

SEQ ID NO: 31629 - protein, 425 aa, Rhodopseudomonas palustris CGA009
MSHASPVWHPFTQHAVQGDTPTIVHSEGAWLQADDGRRIFDAISSWWVVTHGHRHPTIISAIKQQSDQLDQIIFAGFTHPPAEQLAQRLVEITPPELTHVFFSDSGSTSVEVGLKMALGYWLHSGESRRRILALEGAYHGDTIGGMSVGERGVFNAPYDPLLFDVSRLPFPRAGAEQATLDALEQACRNEAVAALIVEPLVLGAGGMLIYPPWVLAEMARICKAHGLLLIADEVMTGWGRTGTLFACEQANVVPDIACYSKGLTGGSVPLAVTMCRREIFDAHFSTDRRKTFFHSSSYTANPIACAAALANLQVWASEPVRQRIDDLAAVHARALNRFRDDARFSNVRQIGTIAAVDLQVGDSGYLADVGPRLYAYFINRGLLVRPLGNTIYLMPPYCSTAVEIEAVYEAIAAVPEVLARGSDAG

SEQ ID NO: 31630 - protein, 441 aa, Geobacter sulfurreducens PCA
MALKETLKQKIEEHRPRTTRLVKEFGKVIIDQVTIDQCIGGARDIRCLVTDISYLDPQEGIRFRGKTIPETFEALPKAAGSDYPTVESFWYFLLTGEVPTQAQVDEVVAEWKVRQEVPQYVFDAIRALPRDSHPMVMLSVGILALQKDSKFAGFYNSGKFNKMTAWEYVYEDAYDLVARIPVIAAFIYNLKYKGDKQLPIDPSADCGANFARMIGQCKEYEDVARMYFILHSDHESGNVSAHTTHLVHSALSDPYYAYSAGLNGLAGPLHGLANQEVLDWTIKFQEKYCKDVEPTKELVTKALWDTLNAGQVVPGYGHAVLRKTDPRYTSQREFCLKTPGLKDDPLFKLVAMIFETAPGVLMEHGKAKNPWPNVDAQSGVIQWYYGLREWDFYTVLFGVGRALGCMANITWDRGLGYAIERPKSVTTPMLEKWAEEGGRKF

SEQ ID NO: 31631 - protein, 525 aa, Chlamydia trachomatis D/UW-3/CX
MMGKGFLDCESLVALQEMALHPIDLTASGCLSEERIQKNSLSAEGFTYSYATERVDDRCLEALQGLTEERELIKQMECMQQGAIMNRIEGFQSESRPVLHTATRAWVRDQDLHEEAAAIARHSKEEALRLAEFLYIARAKFSTLVQMGIGGSELGPKAMYFAMQGSCPSDKRIFFVSNIDPDNAAEVLREIDLEQTLVVVVSKSGTTLEPAANEELFRQAYQNKGLSIAEHFVAVTSQGSPMDDKSRYLEVFHLWDSIGGRFSATSMVGGVVLGFAFGYEAFIEFLQGAAAIDAHALTPKMRENLPLLSAMLGVWNRNLLGYPTTAVIPYSTGLKYFTAHLQQCGMESNGKSISREGKEISFRTSPIIWGDVGTNCQHSFFQSLHQGTDIVPVEFIGFLHNQRGLDCVLSGSSSSQKLFANLVAQSLALAQGRDNANSNKRFKGNRPSSILVAQQLSPRIAGSLLAFYEHKFAFQGFCWGINSFDQEGVSLGKELATQIIGIMSGNAPVEFSEARGMLRLFNVLT

SEQ ID NO: 31632 - protein, 130 aa, Chlamydomonas reinhardtii
MALVARPVLSARVAASRPRVAARKAVRVSAKYGENSRYFDLQDMENTTGSWDMYGVDEKKRYPDNQAKFFTQATDIISRRESLRALVALSGIAAIVTYGLKGAKDADLPITKGPQTTGENGKGGSVRSRL

SEQ ID NO: 31633 - protein, 320 aa, Vibrio parahaemolyticus RIMD 2210633
MIKKIGVLTSGGDAPGMNAAIRGVVRTALSEGLEVFGVYDGYLGLYEGRIEKLDRSSVSDVINKGGTFLGSARFPEFKQVEVREKAIENLKKHGIDALVVIGGDGSYMGAKKLTEMGYPCIGLPGTIDNDIAGTDYTVGYLSALNTVIDAIDRLRDTSSSHQRISIVEIMGRHCGDLTLMSAIAGGCEYIITPETGLDKDKLISNIQDGIAKGKKHAIIALTELMMDANELARDIEAATGRETRATVLGHIQRGGRPTAFDRVLASRMGNYAVHLLLEGHGGRCVGIVKEQLVHHDIIDAIENMKRPVRNDLYKVAEELF

SEQ ID NO: 31634 - protein, 143 aa, Hordeum vulgare
MASLVAVQPAAVKGLSGSSISGRKLAVRPSSAAVSRSTRRARGAAVVAKYGEKSVYFDLDDIANTTGQWDLYGSDAPSPYNGLQSKFFNTFAAPFTKRGLLLKFLLIGGGSLVAYVSASASPDLLPIKKGPQLPPTPGPRGKI

SEQ ID NO: 31635 - protein, 118 aa, Serratia marcescens
MSNIIKQLEQEQMKQDVPAFRPGDSVEVKVWVVEGSKKRLQAFERVVIAIRNRGLHSAFTVRKISNGEGVERVFQTHSPVIDSITVKRRGAVRKAKLYYLRERTGKAARIKERLNRVG

SEQ ID NO: 31636 - protein, 36 aa, Pisum sativum
  misc_feature (34)..(34): Xaa can be any naturally occurring amino acid
KYGDKSVYFDLEDIGNTTGQWDLYGSDAPSPYSXLQ

SEQ ID NO: 31637 - protein, 144 aa, Spinacia oleracea
MASLATLAAVQPTTLKGLAGSSIAGTKLHIKPARQSFKLNNVRSGAIVAKYGDKSVYFDLEDIANTTGQWDVYGSDAPSPYNSLQSKFFETFAAPFTKRGLLLKFLILGGGSLLTYVSANAPQDVLPITRGPQQPPKLGPRGKI

SEQ ID NO: 31638 - protein, 422 aa, Aspergillus nidulans FGSC A4
MSRMWEVDPETKAKLLQYSKVNGNDRCCDCGAPSPQWASPKFGTFICLNCAGTHRGLGVHISFVRSITMDAFKNSETQRMELGGNDPWKKFFDSHPITQSEGRTFEDSTIKERYEGEVGEEWKERLSAKVEGREFVPGQRPAQQTKKSAVDIGESRSSTPLSNAGLTRGSSASPALQEGPGGLENAGVSRKARNEAYFAKMGSENAMRSESLRPSEGGKFTGFGGGLPVEESPKPRAGAGIPALDDFQKDPVAALTKGFGWFTTTVGKSAKTVNDSFIQPTAKTLAESDFAAQARQHAAQLGQNIQVGARGAADSFNRFVEGSDVPSTRRARAEPERKDFWDDFASLGAQDNHRRNTSRSGALGTTAMKPGPGASSSATASTSVSSGSGSAPVGSGTGTGRGSSPTPASRKSQDEGAWDDNW

SEQ ID NO: 31639 - protein, 168 aa, Avena agadiriana
VMASSATTVAPFQGLKSTAGLPVSRRSSGSLGSVSNGGRIRCMQVWPIEGIKKFETLSYLPPLSEEALLKQIEFLIRSKWVPCLEFSKVGFIFREHGSTPGYYDGRYWTMWKLPMFGCTDASQVIKEVEEVKKEYPDAYVRIIGLDNIRQVQCVSFIAFKPPGCEESG

SEQ ID NO: 31640 - protein, 562 aa, Vibrio angustum S14
MNNDKRPLYIPYAGPALLETPLLNKGSAFSVEERMFFNLEGLLPEAIESIEEQTERAYQQYRKFENDMDKHIYLRNIQDTNETLFYRLVENHITEMMPIIYTPTVGSACEDFSNIYRRGRGLFISYPNRDRIEDMLNNASRQNVKVIVVTDGERILGLGDQGIGGMGIPIGKLSLYTACGGISPAYTLPVVLDVGTNNPQRLSDPMYMGWRHTRISGKEYDAFLEEFIQAVKQRWPEALIQFEDFAQKNAMPLLERYKNKVCCFNDDIQGTAAVTVGSLLAACKAAGTKLSEQRVTFLGAGSAGCGIAEAIIAQMVSEGISDAQARSQVFMVDRWGLLIDKMPNLLNFQQALVQKKEQLVDWDVTENNISLLDVMRNAKPTILIGVSGVPGLFSEEVIREMYAHCERPIIFPLSNPTSRVEATPFDIIRWTDGNALVATGSPFEPVIYEGKTYPIAQCNNSYIFPGIGLGVLAVNARRVTDEMLMESSRALAECSPLAIHGDGALLPPLEDIQKVSRKIAFAVAKKAVEQHKAPKNSDERIREKIDANFWKSEYRRYKRTSF

SEQ ID NO: 31641 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEDVKKKYPDAYVRIIGFVNIRQVQCVSFIAFKPPGCEESG

SEQ ID NO: 31642 - protein, 168 aa, Avena clauda
VMASSATTVAPFQGLKSTAGLPVSRRSSASLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 31643 - protein, 284 aa, Pseudomonas syringae pv. tomato str. DC3000
MTHAEHTSVLAGLIGSGIQASRTPAMHEHEGDAQGLRYLYRLIDIDALQLDINALPRLVESAQNCGFTGLNITFPCKQAVIPLLDELSDEARGIGAVNTVVFKDGKRIGHNTDCLGFAEGFQRGLDKAPRQHVVQMGAGGAGAAVAHALLSAGVERLTVFEVEPQRAQGLVDNLNEHFGAGRAQVGLDLPAAMAEADGLVNTTPVGMAKLPGTPLPVELLRPALWVAEIIYFPLETELLKHARTLGCRTLDGSTMAVFQAVKAFELFSGRSADAQRMMAHFHTL

SEQ ID NO: 31644 - protein, 504 aa, Solanum tuberosum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKIFQQIIAGVEYCHKNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPDARQHLKKLDEEILQQVSRMGLDRDQLLDSLQKRIQDDATVAYYLLYDNRSMASSGYLGAEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 31645 - protein, 580 aa, Oryza sativa (indica cultivar-group)
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPVSGWRQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENAKKPANGEGSSDAVVQEPFGNGPTSPAALAAGAVSNPALTPAAVSMSFYDVNAGEQPSREDEAPEEVVECRCGERSTDGRGEA

SEQ ID NO: 31646 - protein, 475 aa, Geobacter sulfurreducens PCA
MAKRYKVLVGGEWTGDDRPGIEVVNPYDDSVIGVVPEATNEDVDHAIRAAQAGFAEMSALPAYRRSDILDRTSELIKRDREEIAEIIAREAGKSWKFALAEADRSAETFRFASLEARNAHGEIVPMDASPVSAGRFGFYLRTPIGVIGAIAPFNFPLNLVAHKVAPAIAAGNAIVLKPATKTPLSSIKLAELMVEAGLPAGALNLVIGSGRTVGNRLVEDDRLAMVTFTGSPPVGVQIKERSGLKRVTLELGSNSPTIIEDDGDVDAAVARCVVGSFANSGQVCISVQRIFVHQRRYREFVDKFVAATQKLKVGDPMDRDCDIGPMISREELQRAVEWLGEATSLGARLETGGTVAGNCLTPAILSGVTPDMKVVCSEVFAPIVSVIPYETFDQALDMADDSIYGLQAGVYTSDINKAFKAIRRLDVGGVIINDIPTFRVDHMPYGGNKQSGLGREGIRYAMEEMTNIKFVCLNL

SEQ ID NO: 31647 - protein, 334 aa, Nostoc punctiforme PCC 73102
MSKNLLEQLREVTVVVADTGDIQAIEKFKPQDATTNPSLITAAAQMPEYQGIVDQTLLQAKKDAGDGATQAQIVSLAFDRLAVAFGLKILQIIPGRVSTEVDARLSYDTEATLTKARDLIAQYKAAGIGRDRVLIKIASTWEGIRAAEILEKEGIHCNLTLLFGLHQAIACAEAGVTLISPFVGRILDWYKKDTGRDSYPATEDPGVLSVTKIYNYYKKFGYKTEVMGASFRNLGEITELAGSDLLTISPSLLAELQSTVAELPRKLDPAKAASLSIEKISIDKASYDKMHAADRMATDKLDEGIKGFTKALEDLEKLLADRLVRLEGEVVASH

SEQ ID NO: 31648 - protein, 137 aa, Geobacter sulfurreducens PCA
MERTFAIIKPDAVERNIIGKILEKVETAGFRIVGMKKILLSKCEAEGFYYVHKERPFFNDLCSFMSRSPVVVMVLERENAINTWREVMGATNPANAEAGTIRKDFGLSIEENSVHGSDSPESAAYEIPYFFSQLELL

SEQ ID NO: 31649 - protein, 213 aa, Brassica napus
  misc_feature (203)..(203): Xaa can be any naturally occurring amino acid
MCLEEAGDLVLHIILSKIGPENTARVACVSKRLKVSASEDSLWSIFCSLDLNISAPLDPHGEPSPSFKAAYQSWRESFRMYPWHLVKRVRRCWDNLKLWLSLNFPEAEATLRKGATEDDLEEFESALRIKLPLPTRLLYRFVDGQEPRLDGSLGLMGGYSVYSHDVNVYLLPLKEVIRETNETMSDLGVSNGSNFIVVAASAXASLKMFSLTA

SEQ ID NO: 31650 - protein, 487 aa, Glycine max
MGRPSSTIEIPHERYRHNDRRTPDPDVSDDYRRRRSPSYDSYDRHPERRRRRSVSPEHRNPRHTNGTHNDNALPKKFGRRNGAYLDRDRGDWQRSDSESDEELKGLNFEEYRRLKRQKMRKSLKHCIWNVTPSPPRRENEDLEDYSKPDEISDRNDGAGKIDTEVKAKTKAKPESESDSESEKSASSESDDSRSRKKRRKGSAGSSRKSYSESESESDSESEEEERRRRKSRKNRRKRSNRSRKKRRYSDSDESEESESDDSESSGRKKKKRSSSSRSRSKRIRRSSKRTKGSSETESAGSGSEEEENGSGDAKSKAMVDEVKMTEINAEAIKLKELFESQKKPALDNEPAVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFAAKASDGADA

SEQ ID NO: 31651 - protein, 111 aa, Chlamydia trachomatis D/UW-3/CX
MTTIFERIIEGAVECDKVFEDENFIVIKDKFPQAPVHLLIIPKKHIEKLQDIQGDDFLLLAEAGKIIQLMARNFGIENGYRVVVNNGLEGGQSVFHLHIHLLGGGLLGSIA

SEQ ID NO: 31652 - protein, 142 aa, Xanthomonas axonopodis pv. citri str. 306
MQTVRQLLGTKQVEVFAVAADAAVIEAIRLMAEKAIGAVLVMEGPRLVGIVSERDYARKVVLRDRSSSTTSVAQIMSGEVVTVSPSETVERCMQLMTDGRFRHLPVVENGRVQGVISIGDLVKAVIEAQQQDIDQLQRYIAS

SEQ ID NO: 31653 - protein, 861 aa, Gibberella zeae PH-1
MVCALPAIPLWLILRVNSDTWDSSKYCPLVYTHRALFEFETLPPHNPLSTMALREFKAPVSYEKQQHAFQEFLTGFKTSPEQTITTALGNITIGEDDFEDDLMDEDGQDVNQGQQAKERRSPQYKYKNMLQQLSDRTIDEATIDLDDLSTWESQAFEGEESLRLVDSIEMNTKHYVEIFSRAVDEVVPPASADTTFKDDVLDVLMARRQARNRELDEAAERDPTAADDKFPAELTRRYTLVFKPRSGTSSQPAKALAVRQVRGDHLGHLITVRAIATRVSDVKPIVQVSAYTCDRCGCEIFQPITDKQYGPLTMCPSEDCKQNQAKGQLNPSSRASKFLPFQEVKVQEMAEQVPIGQIPRSLTVFCYGTLVRQINPGDVVDISGIFLPTPYTGFKAMKAGLLTDTYLEAHHVLQHKKAYSEMIVDPTLVRRIEKYRQTGQVYELLAKSIAPEIFGHLDVKKALLLLLIGGVTKEMGDGMKIRGDINICLMGDPGVAKSQLLKYISKVAPRGVYTSGRGSSGVGLTAAVMRDPVTDEMVLEGGALVLADNGICCIDEFDKMDETDRTAIHEVMEQQTISISKAGISTTLNARTSILAAANPVYGRYNPRISPVENINLPAALLSRFDILFLLLDTPTRETDEQLAKHVTFVHMNSRHPDIGTDNVVFSPHEVRSYIAQARTYRPVVPANVSEYMIKTYVRMRDQQQRAEKKGKQFTHTTPRTLLGVVRLAQALARLRFSNEVVQDDVDEALRLVEASKESLNNELDAGRRNMKPTDRIYNLVKNLAETGQCRPDDAADDEDLGIELSMSKVRDRVLARFTLDQWQDALHEHTSVLNVWQTTGNGARLVFVVVGGENQNDDDF

SEQ ID NO: 31654 - protein, 565 aa, Oryza sativa (indica cultivar-group)
MAAAAARGAAAARSPLVLHRHPHPAHHRRLRLLPLVAGGGGGSPPRVGRRIRASREKGRRVGVRVFARYSQAQDFSTRLQDRAGELPKLVEDLLQTSISTGPRGAFRFAQGIQAVLGVGGEWLNDFSKTANTSAGIPAQMQLGLLSPLYLRRLFERMGATYIKLGQFVASAPTLFPAEYVEEFQNCFDRAPPVPYSEIESILREELQQPLDSVYEYIDPVPIASASIAQVHGARLKSSQKDVVIKVLKPGIEDTLVADLNFIYVVARILEFLNPELQRTSLVGIVKDIKESMLEEVDFRKEATNIEAFQRYIDAMGFDRQAKAPFVYRHCSTKRVLTMERLYGVPLTDLDSIRSLVPDPELTLVTALNVWFGSLISCESFHADVHAGNLWLLRDGRVGFLDFGIVGRISPRTWAAMEVFLASFATDDYNAMASALSEMGATGNDINVNEFAKDLEKIFSSIQDLDTEVIVATARTPDATAVSANVVVDDRQMNALFLDLVRVSESYGLKFPREFALLMKQLLYFDRYTRLLAPSMNMLRDERINIGMNRSAAAKENLDEYNWTFS

SEQ ID NO: 31655 - protein, 347 aa, Coprinopsis cinerea okayama7#130
MAPSSYKQIVLNSRPVGDIEPDTFRTEVRPASDLRPGPGQALVQCTWLSLDPAMRGYIRDVRSYLPPVQIGEVMRAAGLGVVVAVGPGSKFQVGDYVSGQWGMREFAVVKDKHLEKLELGPGIEALDYLGVLGGSGLTAYFGLKEIGQLKAGDKLVVSGAAGSVGTVACQLGKAAGAKVYAIAGGPAKCRWLEEEIGVEKAFDYKSPSFFADVKKHVGYLDVYFDNVGGDILDFLLTRLNKDARIVLCGAISAYNSPKPKGLQSYLNLISQRATLRGFILFDYEHRYPEALAELRKGLQSGAIKRKFHIVEGGIEQAPKALPMLFSGGNTGKLVVKVSDEPKAQAKL

SEQ ID NO: 31656 - protein, 255 aa, Cryptococcus neoformans var. neoformans B-3501A
MSPVIILTGASRGLGLAVLRILLAKHNARVATLSRSLTPELQGAVDEYGADRVLPVQGDVSKPEDNARVVKEAVDKWGQLDGLVLNAGSIDPVDKIGNVQLDALIPYVQTNLLSTIYLLQPALPHLRKSKGRVVLVSSGASSTGYQAWGLYSMAKAGMNSLARTVASEEKENGVAIWSVRPGMVNTDMQSFLRTHGPAEMSPTDMAKFQSAYEKGELLAPEQPGSVLAGMAVNGPIELSGEYINWADERLKAFQA

SEQ ID NO: 31657 - protein, 356 aa, Arabidopsis thaliana
MSDISQDLLEEILSRVPITSLRAVKSTCKRWKDLLNDPSFSKKYGGKRDNEFLAIMTSGSRASLMSVNLHGPRDNKDLEDPFIKQIGELNQDQIFKVFHCDGLLLCITNEDNTRLVVWNPYLAQTRCIQPIDKFYIYDWYCLGYDKDKNHKILVVYSPMFGRIEYEIYSFLSKSWIVLSFPTDWQISRDECLSLKGNTYFIAYKKMEVEEVGFQEFLLCFDFTNERFGPLLPLPFQCYNQTSLVLSTVQEEQLAVLCKRCDAYETKIWITTKIEPNAVSWSYFLKFDFKVDISGGSFFVDVEEKVAVLFCINREKEKGINNKTYMIGEDGYYKEVDLGESNWCPSMCSYVPSCVQV

SEQ ID NO: 31658 - protein, 625 aa, Musa acuminata
MDGCDCIEPQWPADELLIKYQYISDFFIALAYFSIPLELIYFVKKSSFFPYRWVLIQFGAFIVLCGATHLINLWTFALHSRTLAIVMTVAKVSTAVVSCATALMLVHIIPDLLSVKTRELFLKNKAEELDREMGLIRTQEETEGNVRMLTHEIRSTLDRDTVLKTTLVELGRTLDLKDCMLWMPSHSGTSLQLSHTLHHQIPTGSAVPINLPVVNQIFSSNHAMIIPHTCRLARIWPLSVRHVPPEVAAVRVPLLHLSNFQISDWSELSTKSYAVMVLILPSDSGRKWHVHELELVEVVADQVAVALSHAAILAESMRARDLLTEQNVALYLARQEAELAIRARNDFLAVMNHEMQTPLHATITLSSLLLETELSPEQRSMVETVLKSSSLLATLINDILDLSRLEDGRLELEIGDFNLHSVFREVMNFIKPIRAVKKLQVSLMLSPDLPLYAIGDEKRLMQIMLNVAANAVRFTKEGDISLTASVARTDYLREFRALDFYPVASDGHFYLRVTIKDTGCGISHQDLPNLFTKFSQSQNVSSQGYSGNGLGLAICERYVSLMQGHIWVESDGIGKGCTATFVVRLRLCENPDGSQQKILPLPWKKQTQKFSSSRGMPTDPGGLFD

SEQ ID NO: 31659 - protein, 77 aa, Glycine max
  misc_feature (66)..(66): Xaa can be any naturally occurring amino acid
MVSSFTCLKSMAGFPTRKTNNDITSIACNRLRVQCIHVSPPIVKKKFDTFSYLPYLYYSQLSNEVXYLLTKGLIPFF

SEQ ID NO: 31660 - protein, 765 aa, Aspergillus oryzae
MASTEEQSDKTAKSQITTNVEVEQGHLDELPEGIDEKVEYDYESERSPFPEVRAVVPETDDPDLPVNTVRMWFLGIVFTILGSGINQFFSLRYPSVHIVSLVAELLAYPCGVFLAKVLPAVTINLGPLGSFCLNPDHYFNIKEHAMIVIMSNVSFGYGSADSTNIIQAASPKFYNFGLKAGFSVLVVLCAQLLGFGVAGLAAPWLVEPASIIWPQVLSNCAMLETLHSRANSVANGWKISRLRFFLYVTAGGFIWYFFPGLMFTALSYFTWICWIAPRNAVVNQLFGMQTGLGLSPITFDWSQVAYNTNPLLSPSWAAVNVFAGFAAFFWIVVPGIFYTNTWFTAYLPLMTSDVYDRTGAVYDTARVISPQSTLDLEAYKSYSPPYLGATFAFVYGLSFASITGVLTHIGVWHYKDIWAAFRGKNRLDVHARLMKSYKKTPWYWYAAIIVAMTAISIAMVEVYKTKLPVYGIFLALAIPAIYMIPCGIVQGITNVNANQLNVLAEFIGGYMFEGKPLANMIFKILSTDVVGQGIYFAMDMKLGHYLKIPPRSLFLAQGLATILGALTQAGVTIWMLGHISDICSEDQPDGFSCPNGRTVYSSSVIWGLVGPRRLYSVGQIYSSLLHFFWIGAIAPLVTYALYKITKKEYWKYVSWPLIFTGTANVPPATGINYSSWALVNFIFNHFIKRRFFAWWTKYNYILAAALDTGLALSGIVIFFCISYPGAAFPDWWGNTVYQNTADADGVPYKPMPKIGYFGPANGTWS

SEQ ID NO: 31661 - protein, 826 aa, Nostoc punctiforme PCC 73102
MTTISKNTLSPSAQERSLILWFDEVGIADIPLVGGKNASLGEMIQQLTPKGINVPTGFATTAYAYRHFIKSAGLEAKLRKLFADLDVEDVKNLRERGKKARSLLIHTPFPVELREAIATAYQSLCEIYHTETDVAVRSSATAEDLPDASFAGQQETYLNVVGVEGVLAACHKCFASIFTDRAISYRHTKGFDHFSIALAVGVQKMVRSDLATSGVMFSIDTETGFKDAALITAAYGLGENVVQGSVNPDEYYVFKPTLKAGFRPIIDKKLGSKELKMIYDDGSKFTKNVSVSASERGKFALSDEEILQLGNWTCLIEDHYSQVHGISTPMDIEWAKDGITNQLFIVQARPETVQSQKTGNVLRSYRLVWGNREKSSHSSLHDSQSPIPLVTGSAIGEAISQGKARLILDVQKLEQFQVGEVLVTERTDPDWEPIMKRASAIVTNSGGRTCHAAIIARELGVPAIVGCGNATEILKPGQEVTISCAEGEEGKVYAGLLPFEVEEVALENLPRTHTQILMNVGNPQEALSLSAIPNDGVGLARTEFIIANQIQIHPMALINYELLKDEFAKAKIAEITSLYDDKPQYFVDKLAQGIGRIAAAFYPKPVIVRMSDFKSNEYANLLGGRQFEPHEENPMLGWRGAARYYDEGYREAFALECHALKRVREEMGLTNVIPMIPFCRTPDEGRLVLAEMAKNGLKQGVNGLQVYVMCELPSNVILAEEFAEVFDGFSIGSNDLTQLTLGIDRDSALVARLFDERSPAVKRMVKMVIEAAKKCDRKIGICGQAPSDYPEFAQFLVEQGIDSISLNPDSVLKTMLEVAKAEGTNS

SEQ ID NO: 31662 - protein, 510 aa, Solanum demissum
MMQDVWTQLGPTIAAIMFIWTMYQNYFPHELRGHIRRYTNKLVSYFYPYMHIIFYELETEGWFERSKAYVAIERYLSKNSSTQAKRLKANAVKDGQSLVLTMDDHEEITDEYKGEKVWWISSQKPASRQTISFYREDEKRYFKLKFHKKNRDLITNSYLKYVLDEGKAISVKERQRKLYTNNKGDGGGYRYRGGRMWSGVVFEHPSTFDTLAMDPNKKQEIIDDLETFSKSKDYYAKIGKAWKRGYLLYGPPGTGKSSMIAAMANFLKYDIYDLELTSVKDNTELRKLLIDTTGQRETNKKKKEEEDKGKNEEDAIKEKMKKGGEVKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADIAENLMPKSSKENADTCLERLIKALETAKEEAKLKAEEEERAKAAEKEKEEKDREEKKEVTDTEEAKNTDGVNEKDNCVKENGDVSKG

SEQ ID NO: 31663 - protein, 383 aa, Arabidopsis thaliana
MCNGSDRLGQREAEEICTNNVRVFSYNSLRSATDSFHPTNRIGGGGYGVVFKGVLRDGTQVAVKSLSAESKQGTREFLTEINLISNIHHPNLVKLIGCCIEGNNRILVYEYLENNSLASVLLGSRSRYVPLDWSKRAAICVGTASGLAFLHEEVEPHVVHRDIKASNILLDSNFSPKIGDFGLAKLFPDNVTHVSTRVAGTVGYLAPEYALLGQLTKKADVYSFGILVLEVISGNSSTRAAFGDEYMVLVEWVWKLREERRLLECVDPELTKFPADEVTRFIKVALFCTQAAAQKRPNMKQVMEMLRRKELNLNEDALTEPGVYRGVNRGRNHRGIGLRVGQGGSSQESSSTQRDKGKSSAVPQGSTSNSNISFQSITELAPR

SEQ ID NO: 31664 - protein, 277 aa, Vibrio vulnificus CMCP6
MTQQIDRYAVFGNPIEHSKSPFIHTLFARQTNQPLIYTAETAPKEGFVEAVKAFFAEGGKGCNVTLPFKEEAYQFASRLTERAQLAGAVNTLKKLDDGDIIGDNTDGAGLVQDLLQHQVVLAGARILVIGAGGAARGVLKPLLDQKPTSLTITNRTFSKAEKLAVLFAAYGSVTAKEMNTVTEEYDVIINSTSASLSGELPALSSSIFAANSTSYDMMYGKGDTTFNQWAKQHGAAHAYDGLGMLVGQAAESFMLWRGLRPGSKQILRELRKNLEGL

SEQ ID NO: 31665 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENIFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 31666 - protein, 424 aa, Bordetella bronchiseptica RB50
MSDTTPAWMAQGYPHIWLPYAQMKTAAPPLPVVRSHGSLLELADGRTLIDGVASWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIVTLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVDAGVWVRPFGNIVYLTPAFTIAEDELQALLAAVRQVVAERRP

SEQ ID NO: 31667 - protein, 328 aa, Chlamydia trachomatis D/UW-3/CX
MYVPGIAENLCLDIFHKQKQVISQYFASFHYDCVHQLTEKLLCHQGSLFFSGIGKSGCIARKLVATMQSFGEKAFFLSGDLLHGDLGVVSPGDIVCLFSNSGETREILEWIPHLKNRPVFLVGITAAPCSSLAAFSDFVIVLPKLEELDPFNLMPTTSTTCQLLFSDLLAMTLLRCRKISLSDYGSNHPSGQIGLKANGKVKDYLYPRTEVPFCSPLTTVAESLPTLSSYGYGCVCVVNELFELLGIFTDGDLRRGLSEYGGDILAYPLQQIMTRNPKVISEDSDVLLSLEMMESGNPVTVLPVVDAQQQRFIVGLLHMHALARAGLL

SEQ ID NO: 31668 - protein, 1113 aa, Coprinopsis cinerea okayama7#130
MRIAILTSGGDSAGMNAVVRAVVKTGILKGCEMYVVREGYEGLVRGNNEHAEQQAKNVAAETEAEVEREVKATYEAPHGQPAVNLLHNLRFGDGELLKDGTCEFVGGRTLKGRYIVRVGWDDVRGWFSQGGTLIGTARSMTFKTVEGREAAAHNLIREGIDALVVCGGDGSLTGADVFRREWPSLIAALKEKGLVSEDQAKKHAHLKIVGLVGSIDNDMSMTDLTIGAPTALQRICEAIDNINSTAYSHSRAFVIEVMGRDCGWLAALAGVAGGADFIFIPERPPTAMPWEDDMCAQIHRPTLQGVEAIDALLQSTEDTPSYMIGLHENKITRAVARAVKAKDYEKALELRGSEFKEILDGFFATSMLAEESAKLPKEKRMRIGIIHMGAPAGGMNAATRAAVRYCIRQGHTALAIHNGFRGLLDGNIDQLSWLGVDAWTPRGGSELGTNRALPSTDIGGVAAKFQEYNLQGLLIIGGFEGFTALLQLEEGRKHYPAFHIPMVHLPATISNNVPVTEYSIGSDTSLNALVDACDAIKQSASASRDRVFVVETQGGKCGYIATMGALAVGASLVYTPEEGITLDMLRRDVRFLKTRYSLDPPGKSEGRLVIRNEASSSVYTTTMITKMLQEEGGSLFDARSASLGHTLQGGIPSPIDRVRAARLSLKCMVFLEQHHNRLLGQKHRQAPPESASVITVQTSSVKMVPVQEMVKHADMVNRRGKTAWWFGVKHLEEQLAGKPQFLGLHKSPEYQASDGGHAFILRRFDTQAISLTTMFRAAFPTASEAEEKDEINYVKANFDLFGNNGSSKEPHITRLAGTWVNRDTAGQLAHDYNMVDLINTMVEAEPDPNGQYRRSNKSAQNNNPPTNAPEPTPATNVHATRSPAKQSPKPPSKTLPTPSPGSGDAQPPAPKRRREGSPATFTSGIPVASSPAVPKTPGPRRSTRTKSPAPSRVPQPLTATKPRSRASVAPPSPKKRPVDLPKSSPIKAEEDTAVEDNVAGNELYAQDISEQKKLIADLKAAASSKKPADTVKEDDDQQMEEEGQGPSKLKRIRQDEEKPLQFEFKEPEREERQIATNRRVGRFDMQPERKSLAWGIAAFAFGMTAITYLPNFL

SEQ ID NO: 31669 - protein, 421 aa, Oryza sativa (japonica cultivar-group)
MADNVSKRQVASVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 31670 - protein, 307 aa, Coprinopsis cinerea okayama7#130
MDFVLDVCDDLFLDKIWAKLVPLSAFTASPEFLQSLNASSSYVPVTSASKWSQLVASLPHPPIPATEIASYAASQSIPNISAWPRNYIPRQILSLSVLTLVGIHVLYFLFASLSYYFIFNHDMKRHPRFLKNQIRLEIQSSLKAFPMITLLTLPWFQGEVMGYSKLYDGLDTYGYIYLVASVPFFLLFTDYCIYWVHRWLHIPIFYKYLHKPHHKWIMDGYLQSVPYHLFVFLFPLHRMVYLVLFVLVNFWSIFIHDSDMVTGHPLEKIINGPAHHTLHHIYFTVNYGQPESHLDPLLEVKDAKKQD

SEQ ID NO: 31671 - protein, 306 aa, Pseudomonas syringae pv. tomato str. DC3000
MQAKVVIVGSLNMDLVIRAQRLPRPGETLSGETFDTVPGGKGANQAVAAARLGASVAMIGCVGADAYGQQLRAALLAECIDCQAVTVVEGVSTGIASIVVDANSQNAIVIVAGGNGRLTPALIERFDALLAGSEIVICQLEVPTETVFHTLSRARALGKTVILNPAPASEPLPASWYGLIDYLIPNESEAQTLTGVNVDSAASAEQAAMAMLAAGARNVIITLGERGTLFANAAGVEHIPARRVQAVDTTAAGDTFVGGFAAALAAGQGESQAIRFGQAAAAISVTRAGAQPSIPTFEEVQELNSL

SEQ ID NO: 31672 - protein, 307 aa, Rhodopseudomonas palustris CGA009
MAKLCSTTDWLTGYIPDLPTPFNEAGDIDLVSLARLIARAISSGASAVVICGTAGEASTLTPAEQTAVISEAVGIAGRRIRVIAGAGSNATSQAIELAARAQSAGADAVLSVVPYYNKPTQDGIRAHFDAIGRAIELPVLLHDVPSRTARPLADDTIVRLARSGRFTGLVDGSGDVLRPLRLRPRLPAGFQMLSGDDTTSFGFLASGGDGAVSEVANIASDLCRTIHTYCRQGRLQSARYLQKRLLPLASSLDQDSPASLKYALNLLGLIRPDTRLPIVPLAGGSAAHLAAVLAAMADEDLAETLGA

SEQ ID NO: 31673 - protein, 573 aa, Oryza sativa (indica cultivar-group)
MAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQHYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKKVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 31674 - protein, 114 aa, Arabidopsis thaliana
MSRASTSVVIYNDLGGGLPLRHHCKSREDDLGYQSLAPGRSWSFGFTPDIFGRTLFYCRFSWGAESHIFDIYKQSRDKEFQEFGCKKCEWKIRKNGPCKFYKKTGMFDHCYSWD

SEQ ID NO: 31675 - protein, 431 aa, Bacillus cereus G9241
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFEFIDIIIAMVIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAILVIILNIFLLYQTFVG

SEQ ID NO: 31676 - protein, 1309 aa, Burkholderia mallei ATCC 23344
MASTTLGVKVDDLLRARLKDAASRLERTPHWLIKQAIFAYLERIEHGQLPPELSGHTGVTDLSDSHADGDDDGAPHPFLEFAQSVQPQSVLRAAITAAYRRPEPECVPFLIGEARLPASLASDVQAMAAGLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGKGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQERTMNELLPRVRSLALLARRYDIGLNIDAEEADRLELSLDLLEALCFDPELAGWNGIGFVVQAYQKRCPFVIDYLVDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVEDALKVVPLGAPHAKIALPRELYGASRVNSMGLDLSNEHRLASLSSALLASAHHPWRAAPMLADDALAHAAPRDVRNPADLRDVVGTVSEATPDEVSAALAHAVAAAPIWQATPVDARADCLARAADLLEAQMHTLMGLIVREAGKSLPNAIAEIREAVDFLRYYSAQIRDEFSNDTHRPLGPVVCISPWNFPLAIFMGQVAAALAAGNTVLAKPAEQTPLIAAQAVRLLRDAGVPAGAVQLLPGNGETVGAALVADPRTRAVMFTGSTEVARLINKTLSSRLDPDGRPIPLIAETGGQNAMIVDSSALAEQVVADVLQSSFDSAGQRCSALRVLCLQDDVADRTLTMLKGAMRELALGNPDRLSVDVGPVIDADAKRTIDTHIAAMKDKGHAVTQLEMPDACAQGTFVPPTIIEIGNVDELKREVFGPVLHVVRYRRSGLDKLLEQIRATGYGLTLGIHTRIDETIAHVISRAHVGNIYVNRNVIGAVVGVQPFGGEGLSGTGPKAGGALYLQRLLATRPAGLPRSLEAALVADAPQEGETRDNPSAALTALRDWLIEQREPALAARCDGYLSHVLAGATAVLSGPTGERNTYTLGARGTVLCIAATASGARAQFAAALATGNRALFAGAAGEALAAALPAQLKAHAGVRKQADAAFDAVLFEGDSDELLALVKEVAQRPGPIVSVQGVAAGAFENGGDEDYALERLLTERSVSVNTAAAGGNANLMTIG

SEQ ID NO: 31677 - protein, 473 aa, Arabidopsis thaliana
MAESTKSKKLSVRLLIDELKNKVVLAESGKDFVDVLFSFLALPMGTIVRLLEKHQKSPQVGIGCFNNLYKSVSEMDLESFQTEACKQVLLYPRSVNLEKFRNMKLKIDDTRAVKYFVCSGFKESCRHHYSISNTEECECGEIVDSKVVKRVMNREIKGLEEEQVQGRILRKDNDGVFFSCKASSFIITDDLKVEASSMDNVLNTLRGLGYADTSKLSEILLHVGVSEVLTLLECFFTSDLPLTDTFLKKQSSLQMIRSRIPLSPTLQGSGDGAVPGQTITFKAFVRKPNIKILCVECGADFIDLLFTFLALPLESVWNISAGNISLGCIGNLFRSFKRIDASSSSKTKLPSFYSCPKQLLDVVTEQQEIYCSFKCVVETNNEYDFKFTRKMPPRPNSLKEKNQNMFFTNKTSVLYLTSFGFMKQNTRFLVTDDLVIKPKNLVSNISLLKLNMHLDKEDVEEHVITIGKLEVWV

SEQ ID NO: 31678 - protein, 1121 aa, Triticum aestivum
  misc_feature (38)..(38): Xaa can be any naturally occurring amino acid
  misc_feature (66)..(66): Xaa can be any naturally occurring amino acid
  misc_feature (69)..(69): Xaa can be any naturally occurring amino acid
  misc_feature (109)..(109): Xaa can be any naturally occurring amino acid
  misc_feature (404)..(404): Xaa can be any naturally occurring amino acid
  misc_feature (438)..(438): Xaa can be any naturally occurring amino acid
  misc_feature (443)..(443): Xaa can be any naturally occurring amino acid
  misc_feature (623)..(623): Xaa can be any naturally occurring amino acid
  misc_feature (641)..(641): Xaa can be any naturally occurring amino acid
  misc_feature (935)..(935): Xaa can be any naturally occurring amino acid
MTMMTPSPLEQQEDEEMLVPHQELSTADAAQPMEVVAXTEPTNTAESQAPEDPQTSRFTWTIENFXRVXGKKHYSDVFVVGGFKWRVLIFPKGNNVDHLSMYLDVADSXNLPYGWSRYAQFSLAIVNQIHQKYTARKDTQHQFNARESDWGFTSFMPLSELYDPSRGYLVNDTVVVEAEVAVRKMIDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLDVKGCHDVYASFDKYVEVERLEGDNKYQAEQHGLQDARKGVLFLDFPPVLQLQLKRFEYDYMRDXMVKINDRYEFPLQLDLDKDDGKYLTPDADRSIRXLYTLXSVLVHSGGVHGGHYYAFIRPTLSDQWYKFDDERVTKEDTKKALEEQYGGEEELPQVNPGFNNTPFKFTKYSNAYMLVYIRESDKEKIMCNVDEKDIAEHLRIRLKKEQEEKEHKKKEKAEAHLYTIIKVARDEDLKEQIGKNIYFDLVDHEKVRNFRIQKQLPFNSFKEEVAKEYGIPVXQSQRFWLWAKRQNHTYRXPNRPLAPHEEAQSVGQLREVSNKAHNAELKLFLEVELGLDLRPIRPPEKSKEDILLFFKLYNPEKEELRFVGRLFVKALGKPSDILTKLNEMAGFSPNEEIELYEEIKFEPNVMCEHIDKKLSFRSSQLEDGDIISFQKPSIPGGDTQVRYKDVPSFLEYVHNRQVVHFRCLEKPKEEEFCLELSKLHTYDDVVERVARQLGLDDPSKVRLTSHNCYSQQPKPQPIRYRGVEHLLDMLVHYNQTSDILYYEVLDIPLPELQCLKTLKVAFHHATKDEVVIHSIRLSKNSTISDXVITDLKTKVELSNPDAELRLLEVFYHKIYKIFPPHEKIENINDQYWTLRAEEIPEEEKNLTAQDRLIHVYHFMKDPNQNQQIQNFGDPFLLVIREGETAAEVMDRVQKKLRVPNEEFAKWKVAFISMNRPEYLQDIDAVSARFQRRDVYGAWEQYLGLEHTDTTPKRSYTANQNRHTYEKPVKIYN

SEQ ID NO: 31679 - protein, 384 aa, Burkholderia mallei ATCC 23344
MQSAAAPRSKLPDVGTTIFTVIGQLAAEHEALNLSQGAPNFAPDPALVERVARAMRDGHNQYAPMAGIAALREALGVKTERLYGERYDPDSEVTIVASASEGLYAAISALVHPGDEVIYFEPSFDSYAPIVRLQGATPVAIRLSPERFRVNWDEVAAKITPRTRMLIVNTPHNPSATILGEADVARLAQLVAGTDIVVLSDEVYEHVVFDGARHHSMARDRALAERSVIVSSFGKSYHVTGWRVGYCLAPAELTRELRKVHQFMTFAADTPMQHAFAAALAEPASYLELGAFYERKRDLLVRELAGSRFELLPSEGSFFMLARFGHFSDESDADFVLRAIRDARVATIPLSAFYADGANTGCIRLSFSKDDATLVEGARRLCSL

SEQ ID NO: 31680 - protein, 213 aa, Panicum maximum
SKRRNGLLKKAYELSLLCDAEVALIIFSGRGRLFEFSSSSCMYRTLERYRSSNYTTQEVKTPLDGEINYQDYLKLKTRVEFLQTTQRNILGEDLGPLSMKELEQLENQIEVSLKHIRTRKNQMLLDQLFDLKSKEQELQDLNKDLRKKLQETNAENVLHVSWEEGGHSGTSGNAMEPYQGFLQHQENDPSLQIGYHQQAYIDQLNEDMADPNE

SEQ ID NO: 31681 - protein, 472 aa, Xanthomonas axonopodis pv. citri str. 306
MHRHVHEPEILADPAAAQTAEHWRQRDLAVVWHPCTQMREHPHTLPLVPIVGGEGAWLVGHDGRRYLDAVSSWWTNLFGHTEPRIGAAIARQAGELEQVMLAGFTHTPAVQLAEQLLAIAPRQAGRAPLSKVFYADNGSAGVEVALKMAFHYFHNRGDHRRTRFIALENGYHGETIGALSVGDIPLYRRVYAPLLLEAMFTPSPDAYLAEPGQSAEDHALQAADALQALFEHSPGEICALILEPRVQCAGGMRMYHPAYLRRARELCDAHGAFLIADEIATGFGRTGTLFACEQAGVMPDLLCLSKGLTGGFLPLSAVLATQQLYDAFLDDSRERAFLHSHSYTGNPLACAAALATLKIFADDDVIARNQPIAARMRALAAQIGEHPSVADVRQAGMIVAFELTQGGNKRTPFASAARVGLKAYRAALEKGVVLRPLGDVLYWMPPYCVDEAQLALLADTTRHAITEAVACA

SEQ ID NO: 31682 - protein, 338 aa, Xanthomonas axonopodis pv. citri str. 306
MSASSPMEAVAFPRPETFVAADVGGTHVRLALVCESNDAGKPITVLDYRKYRCADYPGLADIMAAFFAELGCAPVRRGVIASAGYALEDGSVITTNLPWVLAPEQIRRQLGMQALHLVNDFEAVAYAANYMSGNQVMQLSGPVQGAAGPALVLGPGTGLGAALWIPNDGHPVVLPTEAGHAALAPASDLEMALLQELRRTRTHVGTETLLSGPGLLNLYTALAALRGDTVVHASPADITAAAMAGNDGLAHDALQAFCGFMGSVVGDLMLLYGVRSGVYLAGGFLPQIATFIADGDFVARLLDKGALRPALEQVPVSIVEHGQLGVIGAASWFLQRGR

SEQ ID NO: 31683 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLWDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 31684 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 31685 - protein, 558 aa, Coprinopsis cinerea okayama7#130
MAGGGVAVTTTRRKALAGKSGWAGLVHNRKVFAIAVFASLGGLLYGYNQGVFSGVLAMHSFKTRFSDTVDDPGLKGWLVAILELGAWFGVLVTGYLADKLSRKYTIVLAVVVFLIGVVIQTAAFTIAPIFGGRFVTGLGIGSLSMIVPLYNAEIAPPEVRGSLVALQQLAITFGIMVSFWIDYGTNYIGGTGEGQLEAAWRIPLGLQLAPAVILGVGILFMPFSPRWLVNQGRDDEALTVLSNARGLPPDHELVQIEFLEIRAQYLFEKETQELKFPQYQDGTFASGFKLGFFDYVSLLRSKTLLRRVIAGSFTMFFQQWTGINAILYYAPAIFQALGLTGNTISLLATGVVGIVMFIATIPAVLWVDQLGRKPVLISGAFLMAACHLIVAILSGLFYTSWDTHIAAGWAACVLVWIFAIGFGYSWGPCAWILVAEIWPLSVRGKGLSIAASSNWMNNFIVGQVTPTMLEHLRFGTFIFFGAFSLLGGLFIWFFDALRGLTLEEMDDVFGATEGLAAADQIRHDAILRRLGLIHDSAAGSEKHDEEVGSVVREENGKD

SEQ ID NO: 31686 - protein, 143 aa, Arabidopsis thaliana
MAWDLFLWIVSFFVSLALVASVFYQVICLTDLEADYLNPFETSTRINRLVIPEFILQGSLCLLFLLTWHWVFFLVAVPVTVYHAMLYKERRYLIDVTEVFRGISFEKKLRYTKLGFYVFLFIMVVFRFLLRPCLELAIQGFIM

SEQ ID NO: 31687 - protein, 121 aa, Glycine max
  misc_feature (41)..(41): Xaa can be any naturally occurring amino acid
SIMESAGVHIWAFMDATIAVASVNHADDLKRWRDRIIECLXAASSPPPQCRNCDVGNGGQIMTHSISSAEEEKDPYGGLFEDEQRKILDIKEKLRRPHQILFLLISQFMSLLFRLKRVFDF

SEQ ID NO: 31688 - protein, 166 aa, Triticum aestivum
  misc_feature (94)..(94): Xaa can be any naturally occurring amino acid
MWQSYGLCVEMLIAAIGHLFAFPYKEYAGANARPSGGFRESLLHALKFNDFYHEAVHQFAPTYNEYVLYNHNEGESAPTKFPSGSAVPSVRDVXEVAGIIVMPPSNNSPVTSSVSSNHVDQDESMTTPIRNKVDPPGGMYDLTDLLDVDLSSYPAKVPAIFDVRKQ

SEQ ID NO: 31689 - protein, 218 aa, Eleusine indica
SKRRNGLLKKAYELSLLCDAEVALIIFSAGRGRLFEFSSSSCMYKTLERYRTYNFNSHEVKAPLDSEINYQDYLKLKTRVEFLQTTQRNILGEDLGPLSNKELEQLENQIEISLKQIRSRKNQMLLDQLFDLKSKEQELHDLNKGLKKKLKETCGENATHISWEEGGNSGTSRNANEPYQGILQHAENNSSLQIGYHQQAYMEQLNNQDIGAAHNPNE

SEQ ID NO: 31690 - protein, 758 aa, Rhodopseudomonas palustris CGA009
MTEGSVARQPDLSTCDDEPIHIPGAIQPHGLLLALAADMTIVAGSDNLPELTGLAIGALIGRSAADVFDSETHNRLTIALAEPGAAVGAPIAVGFTMRKDAGFVGSWHRHDQLVFLELEPPQRDVAEPQAFFRRTNSAIRRLQAAETLESACAAAAQEVREITGFDRVMIYRFASDFSGEVIAEDRCAEVESYLGLHFPASDIPAQARRLYTINPVRIIPDINYRPVPVTPDLNPVTGRPIDLSFAILRSVSPVHLEYMRNIGMHGTMSISILRGERLWGLIACHHRKPNYVDLDGRQACELVAQVLAWQIGVMEEQAITRQTLKGQAIQRSLINDIEQLHDHRAGLARNSEALLELMGASGLCLHSREGVITIGQTPPGPIIDQLAQLAGRSGGSELFQTDRLSTIIPEAGAFAEVASGVLAVPLSRTPPRRVMLWFRPEVAQTVYWAGNPDKSVTAESGRLRPRTSFAAWTEQTHGRAIAWQPHEVAAAVEIRDLIIDVILRNTEKLERINTQLARSNEELESFAHVASHDIKEPLRHIEAFAGLLADNIREMGDERLGVMVSGIEKSSRRLRNLINDLAEFSQLGRRSKPLSWVSLETVLNEVLADLQPRITEARAEIQADRLPFARCDHNQIRQVLQNLIANSLKYRDPARPCRIRIFAQPDDNGGRAEIGSAPAIRICVTDNGIGFDKKYIDQVFEPFQRLHGPDDYEGSGIGLAICRKIVQRHGGRVGVDTVPGQGSTFWFTLPVSDDHGQG

SEQ ID NO: 31691 - protein, 332 aa, Arabidopsis thaliana
MPATAGRVRMPANNRVHSSAALQTHGIWQSAIGYDPYAPTSKEEPKTTQQKTEDPENSYASFQGLLALARITGSNNDEARGSCKKCGRVGHLTFQCRNFLSTKEDKEKDPGAIEAAVLSGLEKIRRGVGKGEVEEVSSEEEEESESSDSDVDSEMERIIAERFGKKKGGSSVKKTSSVRKKKKRVSDESDSDSDSGDRKRRRRSMKKRSSHKRRSLSESEDEEEGRSKRRKERRGRKRDEDDSDESEDEDDRRVKRKSRKEKRRRRSRRNHSDDSDSESSEDDRRQKRRNKVAASSDSEANVSGDDVSRVGRGSSKLSEKKSRKRHHRKERE

SEQ ID NO: 31692 - protein, 319 aa, Corynebacterium glutamicum ATCC 13032
MQVTESGSTASPLCGVGSSVMTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 31693 - protein, 153 aa, Pavlova lutheri
MGELPRRIQKETQRLLSEPVAGISASPYQDNLRYFNVVLAGPATSPFEGGIFRLELFLPEEYPMAPPKVRFLTKIYHPNIDKLGRICLDILKDKWSPALQVRTVLLSIQALLSAPNPEDPLDAGVADHWKSNEAAAIEEAKRWTQQYATGSLP

SEQ ID NO: 31694 - protein, 520 aa, Cryptococcus neoformans var. neoformans B-3501A
MAPRSSKKALTLCLFQSLAGVIFGWSNSEGSGLFSMSKYQERFGECIDGVCTLSTTRQSAITGLLSVGAVIGAVGSGSIADRFGLRLTCMVFIFIYLCGAAIETSAFNTYGQLCVARLLTGLGVGATSGLVPVFQAEASPPRYRGLVTGSFQLCVTLGIWGVAMTNWGMSSYAGDVSWRIPVSLQMVWAALLLVGFLFSPESPRFLAKKGRWDHCRKNLANLRGLPTDHPDIDTEMEEVREATIKDQERGQASYVECFSTKDRILWRTMIGICVQIGQQITGINFFFSYGVQFAQTAGLDDTYVFQIILASVNVVFSFPGILAVDRAGRRPILLIGGILMFIGQIVVGAVSKAYPDDKIAGDVLIAFTCLFIASFASSWGPIAWVVCGETFPIRLSSRCVTLGTGANWLFNLIIAFAAPQIQARIGTGITFVWAGCLALAISFAFFCIPETRSMSIEAIDALYLSHTPAWRSHKFVDEQLTRTQNAQEKHYSRSIHAENEQVKSSQQTSARTSAEDGRMV

SEQ ID NO: 31695 - protein, 2333 aa, Cryptococcus neoformans var. neoformans JEC21
MSIPTPPAFQGVVPPSDIPATQQASSLAPAAHSAVAPEADTPTMERTPSSAPVPRPAGSLYPPATLKGIDYQGMPDEPKWDDSMGEPDAVLELADGLALAGHSFGAKKSVAGECVFQTGMVGYPESLTDPSYSSQILILTYPLVGNYGVPERPDVETSHVPTSEDAHNVPPASSLLDSLPLEFESSHIHVAALVVANYHPSFSHHLATSSLGKWLEEQGIPAIWGVDTRMLTKRLREGGVLLGRVLNKRAGVLDGERGRDGQSGVLGGVQRLINGLSPSTSMAQTQSIDKFNVSWREDFETIPYYDPNHENLVAKVSTKAPVVYTASTSSDKKIHPQTGRQMRVVAIDVGMKWNQIRCFRERGIEVKVVPWNYDINNESEPYDGLFVSNGPGDPSMVKETISNLSQALETSKVPIFGICLGHQLLALASGAKTRKMKYGNRGMNIPCTCATSGRCYITSQNHGYEVDVTTLKNGWEPLFTNANDGSNEGIWCGKNGKPFFSVQFHPESAPGPRDTEFLFDVFIQSIVDTAREGRLISIDVPGGELATNIAAKPREQVKKVLVLGSGGLSIGQAGEFDYSGSQAIKALKEEGIYTILVNPNIATIQTSKGLADKVYFLPVTPEFVLKIIKHEKPDGIYCTFGGQTALNVGIKLKDEFSKLGVKVLGTPIETIITTEDREMFARAMEEIGEKCAESATAVNLTEAIEAANRIGFPVIVRAAYALGGLGSGFAKDVEQLTELCGKAFATSPQVLVEKSMKGWKEIEYEVVRDCRNNCITVCNMENFDPLGIHTGDSIVVAPSQTLSDADYNMLRTTAVNVIRHLGVVGECNIQYALNPYSKEYCIIEVNARLSRSSALASKATGYPLAFIAAKLGLNIPLNEIRNSVTKLTSACFEPSLDYCVVKIPRWDLKKFNRVSTALSSSMKSVGEVMAIGRTFEETIQKAIRCIDDQLPGFGDHAKVEDLDYEIANPTDKRLFAIAAALKKGYSVEKLNEMSSIDPWFLTRLQRLIKTEQVISQYNASNVPSALVLNAKQLGFADRQIAKMLSSNELAVRRLRIEAGITPFVKQIDTVAAEFPAFTNYLYTTYNATEHDVDFEDNGVMVLGSGVYRIGSSVEFDWCAVRAIRTLRENGMKTVMINYNPETVSTDYDEADKLYFENISLETVLDIYDTEHSSGVVLSMGGQTPNNIALALHRQNVKIYGTSPEMIDTAENRYKFSRMLDKIGVDQPLWRELTSFPEAKAFCDKVGYPVLVRPSYVLSGAAMNVVFSQDDLNNYLTQATDVSRDHPVVISKYIEEAKEIEMDAVARDGKMVMHYISEHVENAGVHSGDATLVLPPQDLDAETVRKIEIATQKIGHALNVTGPYNIQFIAKNNEIKVIECNLRAARSFPFVSKVTGIDAIEIATKVMLGLPVTPYPDVKMPANYVGVKVPQFSFSRLSGADPVLGVEMASTGEVACFGKDRYDAYLKALISTGIVPPKKNILLSIGSFKEKLEMLPSVHKLHRMGYNLFATAGTADFIQEHGIPVKYLEQLGSENDLNPQKKEYSLSQHLANNLIDLYINLPSKNRFRRPASYISQGYKSRRMAVDFAIPLITNVKNAKLFIEAIIRKPTFDISSVDYQTSHETFTFPGLVSVQAFVPGAAEESSTDFGEATEAAIEGGFTIMQMVPQGVNSAVEDEISLQRAQANASGAAHCDYSFSVAATADNASRLQDAIAAGAKALYIPFNNFYGANNKVSSVSQHFAAWPADRPIITDARATDLASTLLLASLNNRSIHITSVSTKDDLLLIALAKEKGLAVTCDVSIYSLFYCQTDFPDAAKVLPSKADQEALWDNLASIDVFSVGVLPYELGRALNKPVSARSGVAESLPLLLTAVTEGKLTLEDISLRLSENPRAIFGLPEQSQTYVEIEVNRRSSFTAEDAERTWSPLDGQAIAGNVHRVVANNHSIFLDGQSFSMPFGRDISASGSRPTKQARGSFALQKRPSVTALMSPISEKTSSAGAKLMSLASVAPIRELSPIRGLVSVQTHPTFSRRHILSVKQFDREDLHALFNVASEMRTAVERSGSVDTLRGRVLCTLFYEPSTRTSTSFEAAMKRCGGEVVQVNASTSSVQKGESLADTIRTVGCYADAIALRHPSVGSAKAAAKSSPVPILNAGDGIGEHPTQSLLDVFCIREELGSVNGITVTLIGDLKNGRTVHSLVKLLSLYDVTLNFVSPRSLAMPESVKTEAFRAGIRFTESFTLTDEIVSRSDVLYVTRVQKERFENIAEYEAVKDIYVINNDVLEKAKESAIVMHPLPRVNEIDPEVDFDSKRAAYFRQMRYGLFVRMALLTLVMGA

SEQ ID NO: 31696 - protein, 469 aa, Nicotiana tabacum
MNVMRRLKSIASGRSSVSDPGGDFSLKKVTVEQEVDHRVDGETQLEEQCTIAPKQDVTSTSEESTVCTLNVDTRPEKSRYEELPKEMNEMKIRDEKTNGHEDDIKDMEPAVVSGNGTETGQIIVTTLSGRNGRQKKTLSYMAERVVGTGSFGVVFQAKCLETGESVAIKKVLQDRRYKNRELQIVRMLDHPNVVHLRHCFYSTTEKNEVYLNLVLEYMSETVYRVSRHYSRVNHHMPIIYVQLYTYQLCRALNYMHNVTGVCHRDIKPQNLLVNPHTHQLKICDFGSAKMLVPGEPNISYICSRYYRAPELIFGATEYTNAIDIWSAGCVFAELLLGQPLFPGESGVDQLAEIIKILGTPTREEIRRMNPNYKEFKFPQMKAHPWHKIFNRRIPPEAVDLASRLLQYSPTLRCTALEACAHPFFNALREPNACLPNGRPLPPLFNFTPQELSGASTELRQRLIPEYMRK

SEQ ID NO: 31697 - protein, 548 aa, Coprinopsis cinerea okayama7#130
MSVKTIAVLPEAELEDGQMKEVSFEDGKVLLSRLGDKIHATSAFCTHYGAPLAKGVLTADGRVVCPWHGACFNVCTGDIEDAPAPTALHSFEAYIADGQIYVTANPTNTLKANLSRQPKLLATGNDTTGHGVVIVGGGSGTFHAIESLREHGYPGPITLISKETYTPIDRTKLSKALITDPAKIEWRSAADLKIKYGTNIRLGVEVTGVDLQKKVVTLDGGKDTLPYDKLILAPGGTPRRLPIEGANLENVYTFRGIADSQKVDAAAQEGKRVVVIGSSFISMELVVAMAKRKLASIDVVGMEEYPFQAVLGSEIGAALKKYHESNGVKFHMKSKVDKIVASDSNPNAASGVIVNGQTIPADFVIMGVGVAPATEFLKGSGINVEKDGGVKVDQYLRVKSGPDQQNVYAIGDIAIYPQASGDETRIEHWNVAGNHGRAVGVTISGKEQPFVKIPVFWSAQGQQLRYCGIGHKYDRVIVKGNPDELKVIAYYVKNNRIVAVASMQNDPVVSKASELLRLGLMPTPEEVEAGKELLSIDISTSSVLGKLK

SEQ ID NO: 31698 - protein, 290 aa, Vicia faba
MEAKEQDVSLGANKFPERQPIGIAAQSHDDGKDYKEPPPAPLFEPSELTSWSFYRAGIAEFVATFLFLYITILTVMGVNKSQSKCATVGIQGIAWSFGGMIFALVYCTAGISGGHINPAVTFGLFLARKLSLTRAVFYIVMQVLGAICGAGVVKGFEGKAFFGEKGGGANFVAPGYTKGDGLGAEIIGTFVLVYTVFSATDAKRSARDSHVPILAPLPIGFAVFLVHLATIPITGTGINPARSLGAAIIFNQDRGWNDQWIFWVGPFIGAALAALYHTVVIRAIPFKSRS

SEQ ID NO: 31699 - protein, 469 aa, Nicotiana tabacum
MNVMRRLKSIASGRSSVSDPGGDFSLKRVKVEQEVDHRVDGETQSEEQCTIAPKQDVTSTSSESTTTTLNVDTRPEKSGYEELPKEMNEMKIRDDKTNGREDDIKDMEPAVVSGNGTETGQIIVTTLSGRNGQQKKTLSYMAERVVGTGSFGVVFQAKCLETGDSVAIKKVLQDRRYKNRELQIVRILDHPNVVHLRHCFYSTTEKNEVYLNLVLEYVSETVYRVSRHYSRVNHHMPIIYVQLYTYQLCRALNYMHNVTGVCHRDIKPQNLLVNPHTHQLKICDFGSAKMLVPGEPNISYICSRYYRAPELIFGATEYTNAIDMWSAGCVFAELLLGQPLFPGESGVDQLVEIIKILGTPTREEIRCMNPNYKEFKFPQMKAHPWHKIFNRRIPPEAVDLASRLLQYSPTLRCTALEACAHPFFDALREPNACLPNGRPLPPLFNFTPQELSGAPTELRQRLIPEHMRK

SEQ ID NO: 31700 - protein, 775 aa, Rhodopseudomonas palustris CGA009
MSSRSDPGQPMASATDPSGRLALDLTECDREPIHIPGAIQPHGYLFVVSETDLRIASVSANVEDLLRQPPASLLNVPIAHYLTAASAARLTHALHGGDPAAINPIRLDVVTPDGERAFNGILHRHDSIVILELEPRDESRYTNEFFRSVRVAIRRLQTAADLPTACWIAASEVRRITGFDRIKVYQFAADWSGQVIAEDRDSGIPSLLDFHFPSSDIPAQSRALYTINPVRIIPDIGYRPSPLVPDINPRLGGPIDLSFSVLRSVSPTHLEYMVNMGMHAAMSISIVRDNRLWGMISCHNLTPRFVSYEVRQACELIAQVLTWQIGVLEEAEIVRHSVRMRAIQNRLLHELGDEQGLTAGLSRVSEEMLALMGASGFALCSFDGVAAFGRTPSDDEIQALASWLSHRESRGIFQTQQLSASFPEAEVYSDIASGLLAVPLGRASTTLMLWFRPEVAQTVTWGGDPHKPVQIGPRGRRLQTRASFEAWREEVRDRSRPWRSHEIVAAEEIRDLVVDVILGRAEELENANRELSRSNDELESFAYVAAHDLKEPLRHIEAFAGLLNDLLLPEARSRLSLMVNGIEASSRRLRALINDLAEYSRIGRQARPLQPVDLNQILTEVLSDLKPMLQDARAEVVSEPLPTVLCDGSQIRQLLQNLISNAVKYRDAERLPHVTIAATIDSPPPAAPAGANVRRARITIADNGIGFDEQYREQIFEPFQRLHGPDEYQGTGIGLAICRKIVHRHGGTISATSRVGEGSVFTFTLPLCDQDAAES

SEQ ID NO: 31701 - protein, 183 aa, Brassica napus
  misc_feature (172)..(172): Xaa can be any naturally occurring amino acid
EILQGIQPFSGLRSFPTEDNWYWIGVGVLIAYALLFNNIVTVALAYLNPLRKARAVVLDDPNEETQTASAKQGRSEKKGMILPFKPLTMTFHNINYYVDMPKEMRSQGVPVTRLQLLSNVSGVFSPGVLTALVGSSGAGKTTLMDVLAGRKTGGYIEGDIKISGYQKEQQTXARISGYVEQND

SEQ ID NO: 31702 - protein, 235 aa, Glycine max
MAMASSTRRLAFVLLGLAFSAALAESRDAYMRSADRYACILTQESFPVASKGSGLTSANGKLCVLCEQYSTEALIYLRQNETQAEILSALHHTCASLGPLRQQCITLVDYYIPVFFLEVSVVKPEELCESAHLCPKGAATRSSTRGDACGLCHHVLVEVLMMLKDPNTKLEIVGLLFKTCSKAKNYEPQCKRLVLDYIPLILVKTQEFLETTDVCFATHACKTGMQATIPLSAAL

SEQ ID NO: 31703 - protein, 374 aa, Methanosarcina mazei Go1
MNEIITWILIVICLTQSAVFSGLTIGIFGLGRLRLEIEAEANNKNAIKILQVRRDSNFLLTTLLWGNVGVNVLIAQLTDSVMAGTFAFLFSTFGITCFGEIMPQAYFSRNALDIGAKLTPLVRFYQMLLYPVAKPTALVLDWWLGREKLELFREQAMRIMLEKHIESGKTDIGTFEGIGALNFLSIDDVSISDEGSIIDSRSIISLPVENNRPVFPPFNREPSDPFLQKIEASGKKWVIITSPENEPVMVLDADGFLRDAVYKKGPFLPLIYCHFPVVVKSPETRLEKVIRQFKVYPQYPEDDVIDQDLILYWGEEKRIITGSDILGRLLRGIVVECELGSGCEIPVPPSQPGFVRRTAFRRGKKKEIENLKRK

SEQ ID NO: 31704 - protein, 123 aa, Desulfovibrio desulfuricans G20
MSKHILIVDDSKTVRNLVAFIMKKEGFRVTMAEDGLDGLEKLYSAEETVDLIISDVNMPRMDGFTFIKTVREQDTYRDLPIVVLSTEGQEKDIQMGMSLGANLYMVKPAQPDKMVKNIKMLLG

SEQ ID NO: 31705 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWDKQDPRYMATIIMDSAKVVVLDIRFPALPVVELQRHQASVNAIAWAPHSSCHICTAGDDSQALIWDISSMGQHVEGGLDPILAYTAGAEIEQLQWSSSQPDWVAIAFSTKLQILRV

SEQ ID NO: 31706 - protein, 947 aa, Oryza sativa (japonica cultivar-group)
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 31707 - protein, 147 aa, Triticum aestivum
GRPGRYRRVETEILRSEATPAMRLLDELLNIHDGSDDDKWLKACRKHMIEVFPREDPFTMVFPPGFDMEKHDGQIKLPPQDDDVLLRVDFVREVDELLKEVEAEQEKSKLHTGYDPESVATMLKQQEKLRTIRQVEALLELAATLKW

SEQ ID NO: 31708 - protein, 283 aa, Cryptococcus neoformans var. neoformans JEC21
MPKSDFERLAEWRTLGARHSEETVQLAKRVLLSGNAGDQEWAIREQLAIAALDLGQTLLASEQIETLYGKFPGSPRVRILDGLKFEADGDVSRARAVYEALLKEDETNITAHQRIISLALPSLSAIPLLLSYLDVFYSDPAAWSLLADLYSEQGLYSQALGALGHLSVINSWDDGVVRRCGEVAYTLGDYHLALKHFLRASEMQGGKETNVNTRRTRTWWGIKLAIQRLLDSPNLETSVPADLQTSEKHLRLLDELATERLLDAGGQGLDVRRKVLGEKALRR

SEQ ID NO: 31709 - protein, 193 aa, Exiguobacterium sibiricum 255-15
MKIYKADFITSGVNPEHYPEPLLPEVALAGRSNVGKSSFINKLVQRKALARTSSKPGKTQTLNFFNINDEVMFVDVPGYGYAKVSKTEREAWGKMMEKYFTTREILKGVVLLVDIRHEPSADDVIMYDFLKYYDLSVIVVATKLDKIKRGQRDKQIAAIKRKLQFDGQDTFIPFSSETGEGVDAAWEAIYRHL

SEQ ID NO: 31710 - protein, 549 aa, Legionella pneumophila str. Paris
MKSIKQLIRLIHINYILAKNGLDNVVVSIKLFAPLRFIVYLNPWNWLRKEKLTRGEALRKSLEELGPIFIKFGQALSTRPDILPEDIAKELSKLQDKVPPFPSHIAMNIIEQAYKQSAYDVFAQFDPIALASASMAQVHAATLKTGENVVVKILRPNMRRLIEQDLSIMYTIAALTDRYWPEGKRFKPKEIVKEFEHTLLDELDLMREAANAAQLRRNFNQSPMLYIPEIYWDYCHHNILVIERIHGIPVTDIVSLRDHGIDIKKLAERGVEIFFTQVFRDCFFHADMHPGNIFVSYQNPKDPQYICVDFGIIGTLTDNDKRYLAENLVAFFNRDYKRVAELHVESGWVSRDTPVAEFESSIRTVCEPIFEKPLKDISFGQVVFRLFQVARRFHMEVQPQLILLQKTLLAIEGLGRQLYPELDLWATAKPFLEKWVREQMGPKAFIKRLKQNLPFFTEQLPHMPKLIFDILEMKKDQLLTVHEFTRLQSENNNQTIQWKSVGLGVFFSFLSLGVISYFDLLDYNHLTTITIAGSVLAGIFVLINRKIRN

SEQ ID NO: 31711 - protein, 445 aa, Methylobacillus flagellatus KT
MAPRATFTSRNSSTRRNSSRNNNLPDELSVNPFQLKNGILHAENVPLTRIADEFGTPTYVYSRAALESAYTRFAAGFDGQDHLVCFAVKSNPSLAVLNLFARLGAGFDIVSGGELARVLAAGGDPAKVVFSGVGKTETEMETALNAGIFCFNVESASELDRLNDVAGRLGKTAPVSLRVNPNVDAKTHPYISTGLKNNKFGVAYEDAFNLYQHAASLPNIAVHGVDCHIGSQLTELSPFMDAFDRVLALVDQLEAEGIRVAHIDLGGGIGICYADETPPDFAAYAAAMLQKLGDRKVKLVFEPGRALVGNAGALITKVEYLKHTEAKNFAIVDAAMNDLMRPALYDAYHEIAAVVPATDPSSAQVYEIVGPVCESGDFLGHDRKLALQQGDLLAVLSAGAYGMSMSSNYNTRPRAAEVMVDGDKTHLIRERETVAQLFALEKILG

SEQ ID NO: 31712 - protein, 329 aa, Coprinopsis cinerea okayama7#130
MACIFVVSSAFLGGVLWLALPTLDEIDRPLLKIPKSFAELQALNQLLKKYRDIYPYRIVICYVTTYLFLQAFSLPGSMYLSILGGAVWGVARALPLACCCVATGATLCYFISAALGPALLAIPKWKSLMEKWSDKIRNNKENMISFLIVLRIAPLPPHWVVNVICPHVGIGIVPFWISTALGILGVTVIHTTIGGGLDEMTSADDFHLISWRNFFGLAAVVVGVMIPVGLRYWFRREVEDVSEEEGSEDLEEDRIIAVGPPPAPKFSNNRPLLERDNTTTYSSEEDDDDDDVILATGPAIDIPSSKDAKPEPPLIVLDPSPSTSVQGRV

SEQ ID NO: 31713 - protein, 270 aa, Methylobacillus flagellatus KT
MDRYAVIGHPVEHSKSPLIHAAFAQQTGQQLEYGKVQAPLDGFVAIVTDLQEKGYRGVNVTVPFKFEAYSLATELTPRARDAGAVNTLTFTDGAIHGDNTDGVGLVRDILQNLAFTLAGKRVLLLGAGGAAEGVLAPLLEASPLSLCIANRTVDKAEAMAARVRPGQTSLDARGFDALADQEFDVVINATSSGLHNERLPLPSGLFAADALAYDMMYGRETPFMRYAREEGASRIADGLGMLVEQAAEAFYIWRRVRPDTAPVMAALRAA

SEQ ID NO: 31714 - protein, 320 aa, Bacillus anthracis str. Ames
MKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYNYDQNLRTYLRRIKRKTALLIAASCQLGAIAAGANRDTVSRLFWYGYFVGMSYQIIDDILDFVSTEEKLGKPAGGDLLQGNITLPALYAMEDPILCKKIRSVHENTTADEMKEIIEAVKNSAAIDKAFAFSERYLHKALEMIKPLPRGQAKYALQNVAKYIGKRKF

SEQ ID NO: 31715 - protein, 866 aa, Pisum sativum
MFGIFDRDTSQKIKGTLVLMPKNVLDFNSVSSVKKKGVLDVAGDVIEAAGSLLGGIVDGATAFLGRNVSIRLISATKKDGNGHGLVGKEVFLEKHIPTLPTLGARQDAFSIYFDWDADFGIPGAFYIRNYMQAHEFFLVSVTFDDIPNHESVQFVCNSWVYNFKSYKKDRIFFSNDIYLPSQTPAPLVYYRQEELQNLRGDGTGQRKDWERIYDYDVYNDLGNPDENVNLARPVLGGSSTHPYPRRVRSGRKPTTKDPKSEKPGALYVPRDENFGHLKSSDFLTYGIKSLSQDVIPLFKSVIFDLNFTPNEFDSFDEDALFEGGIELPTNVLSKISPLPVLKEIFRTDGEQVLKFPPPHVIKVSKSAWMTDEEFGREMIAGVNPCVIRLLKEFPPKSTLDTTLYGDQTSTIKKEHLEINLGGLTVEKAVNDQRLFILDYHDAFIPYLNKINKNAKAYATRTILFLKDDGTLKPLAIELSLPHPSGLQYGAESKVILPSDQGVDSTIWLLSKAHVIVNDSCYHQLMSHWLNTHAVVEPFIIATNRHLSVLHPINRLLDPHFRDTININSLARAALINADGIIEQTFLPGPSSVEMSSAAYKNWVFTDQALPADLIKRGLAVEDSSSPHGLRLVIEDYPYAVDGLEIWYAIKIWVQDYVSLYYPTDEVVQKDTELQTWWKEIIEKGHGDLREKPWWPEMQSLQDLIQSCSIIIWTASALHAAVNFGQYPYGGYILNRPTLSRRLIPEKGTPHYDEMVKNPQKAYLRTITPKFQTLIDLSVIEILSRHASDEIYLGERDSKFWTSDSRALQAFKKFGNKLAKIEGTIKERNNDSSLKNRYGPVQLPYTILQPSGEDGLAFRGIPNSISI

SEQ ID NO: 31716 - protein, 469 aa, Methylobacillus flagellatus KT
MAVADVLKLVKENDIKFVDFRFTDTKGKEQHVTVPISAFDEDKFTEGHAFDGSSIAGWKGIQASDMLLIPDPNTANIDPFMDEPTLFLTCDVVDPTDGKGYDRCPRSIAKRAEAYLKSSGIGDAAFFGPEPEFFIFDSINWSVDMSGSSVKINSEEAAWASNEKFEGGNTGHRPGVKGGYFPVPPIDSLHDIRSAMVVALEELGVPVEVHHHEVATAGQCEIGTKFSTLVQRADWTQILKYVVLNTAHAYGKTATFMPKPISGDNGSGMHVHQSVWKDGKNLFAGNGYAGLSEFALYYIGGIIKHARALNAITNPGTNSYKRLVPGFEAPVKLAYSAKNRSASIRVPFVQSDKARRIEARFPDPTANPYLAFSALLMAGLDGVQNKIHPGEPATKDLYHLPPEEDAAIPTVASSLEQALEALDKDREFLTRGGVFSDDWISAYIDLKMEEVTKLRQTPHPIEFSMYYSV

SEQ ID NO: 31717 - protein, 409 aa, Phytophthora infestans
MMLKLVLRAQRGMRAFAGIGATRKLMLAAEASAPSSVAEASSIFAKVGRDIPLKVVPRAERRAARKAAKHSADAATGHKVVRTSSLPARISFALLAGSISGSIVWNFVLDDGIKSRVKETLGATFLGDIYAIIAKKVEETVKPFTDPSRQKLLPDWPIPQVPADTPTVPVLVLDLEDTLVHSEWSRKHGWRHAKRPGVDEFLETLCQYYEIVIFSQNYGAEEIVQKLDPKQCALHILSRDATRYLNGAHVKDLSNLNRDLRQVVILDDDPAAYQLQPENAIPVTPFTNGRDRDDHELKDLIPFLKALASERVPDFRQVIGEFRDEDGVVRDLATKYGARVHQLEMQKEQKKKKGFGGFVRGRLSHHPASPTGGVAASGFSSGPHVLKRWTLLDSSAYVVAPRCIKEKCM

SEQ ID NO: 31718 - protein, 152 aa, Triticum aestivum
  misc_feature (131)..(131): Xaa can be any naturally occurring amino acid
  misc_feature (145)..(145): Xaa can be any naturally occurring amino acid
MVFSVSIFASVAPYLVSALLLFFLIEQLSYLVKKRNLPGPLFVPPIIGNAISLVRDPTSFWFKQSDTAGTSPGLAANYLIGKFIIYIRDTELSHQIFSNVRLEAFHPLGHPFGKQLFGDHSLIYLFGEDHXTVRRHLAPNFTPKXLSTYSDL

SEQ ID NO: 31719 - protein, 569 aa, Geobacter sulfurreducens PCA
MGTPVSSGFSVGKVAVIDHSVADGMEVATVRPTNEERHRFLMALEKARIETIYMEKRVAETLSKEDAAIFHTHLMILEDRGFIARVMDFIEQDYGAVRSVNEAVAHYVNAFSQMEDPYLRERSADMEDIRRRIISCLDGSCKPVPKLRERRIIVAREILPSDMATLDHDKILGIVTEKGDVNSHAAIMAKSLGIPAVVGVGGALQNLGLKDEVIVDGSSGHIYINPSAKIKEEYARLEADFSVRMRELEELRDVPAVTLDGEQVWLRANIGLLSDIRIAQANGAEGVGLYRTEFPYMTRSAFPSRDALFSLYRRVLEGFSPNPVTIRTLDIGGDKTLPYFPMPHEDNPFMGWRSIRVSLEREDIFRVQLAGILLASAHGKIKLMFPMVSSIGEIWQIKKIMNEVRGELTREGLPFDQNLELGIMVELPAAVQTAHILIREVDFFSIGTNDLIQYTMAADRNNPKVSRYYDPYQPAVLHSIKRVVDTATAAGKPVSICGEMAADPINAVLLFGMGIREFSLSAPSIPVVKQTIRALSSTMAEEVAREVLALESSGAVRAYLLDARARLGL

SEQ ID NO: 31720 - protein, 209 aa, Brassica napus
MGTMAELGSMGKFEEQQQAKQIVLYRESAEEWLSHVHSLIPSVLQKAKTVPNFTGRWKTIISKIQQIPGCLSDLSSHPCFSKNKLCNEQLQSVAKTLNEAMELAELCSADEYEGKLRMQSDLDALSGKLDLNLRDCMVLIKTGVLGEATLPLYISSSSETPKMSSLKELLARLQIGHLESKHNALENLIRVMEEDEKMVMPLMGRGNVP

SEQ ID NO: 31721 - protein, 324 aa, Triticum aestivum
ATIGSLGTISIDRACAPALALANMSGSSSANLGKLSCSSMKTISSVMDDVAEDEISWEDLHIGERIGLGSYGEVYHADWNGTEVAVKKFLDQDLSGVALEQFKCEVRIMSRLRHPNVVLFLGYVTQPPNLSILTEYLPRGSLYRLLHRPNSKVDETRRLKMAFDVAKGMNYLHTSHPTIVHRDLKSPNLLVDKNWVVKVSDFGMSRLKHHTFLSSKSTAGTPEWMAPEVLRNEPANEMCDVYSFGVILWELATLRVPWSGLNPMQVVGAVGFQNKRLDIPKEVDPLVASIISSCWDNDPSKRPSFSQLLSPLKKLQRLLVTESL

SEQ ID NO: 31722 - protein, 337 aa, Petunia x hybrida
MENSSQESQHLRSENSVTYDSTYPIYSMAFSSFPTPRRRIAVGSFIEELNNRVELLSFNEETLTLNPIPNLSFDHPYPPTKLMFHPNPIKSNNDILASSGDYLRLWEVKESSIEPLFTLNNSKTSEYCAPLTSFDWNEVEPKRIGTSSIDTTCTIWDVEKGVVETQLIAHDKEVYDIAWGEAGVFASVSADGSVRIFDLRDKEHSTIIYESPTPDTPLLRLAWNKQDLRYMATILMDSNKVVILDIRSPAMPVAELERHQASVNAIAWAPQSCRHICSGGDDGQALIWELPTVAGPNGIDPMSMYSAGAEINQLQWSPAQRDWIAIAFSNKLQLLKV

SEQ ID NO: 31723 - protein, 595 aa, Neurospora crassa
MDPQPAQQPAEATPDGHGAPAPVALTKTRTESFSAKSENSQTAADFIRDQMQLEADAREALPYSILTSHQSIETCTKPLGPLRQAVFSCLTCNPPPADPKAPYNAAGICYSCSVQCHGEHTLVEIFAKRNFTCDCGTTRFPPTSPCNLRINEETGTKGGVHSEEPDVNNKYNHNFRNRFCGCECDYDPFEQKGTMFQCLGLGTAETGGCGEDWYHPGCIVGLGPDWFEKMDKKDKPKSAALKTEVKTENGALPTIAEDETTEQNGAHAEEAEEDEDEDDDPPPPPGFPADDDFEGFICYKCVEAYPWIKRYAGTEGFLPPVYLKKEEQTISTTSELKVNGNSSSKKRKASDEDNEHIEESQEKKPKTDETVHSTTTAITTTESLTTNGSSTITSTTNTTTLTTTDSSTTTPHPNPNPKPCLLSSLPPPPSQTSQNSPFSLFFTTPSFRSLLCHCPHCFPLLIPHPHLLEEEDTYEPPVSETSSSSPSHSLHGGGGGGSSSKGSGSVLERGESALRNIDRVRAIEGVMAYNHLKDKLKPFFREFAESGRAVSAEDIKAYFAKLRGDDEVRTGGSGEMEEEEEKGVNGDGRKEQDGY

SEQ ID NO: 31724 - protein, 308 aa, Triticum aestivum
  misc_feature (59)..(59): Xaa can be any naturally occurring amino acid
MAGHFDLQGRHGKSRVRVSRVWRRPADAGGHLFVEWSVAVSVVSDCLPSYTSDDNSAIXSATDSIKNTVYVKAKECTEVVSMEEFAVILGRHFTSLYPQVSEAAVTIVERPWERVAVDGKPHSHGFKLGSEKHTTEVTVKKSGSLLINSGIQGYSLLKTTQSGFEGFMRDRYTLLPETRERIVATEVTAWWRYPFEHISQLPSKPFCFTQRYQDVKKVLADTFFGPSDVGVYSPSVQNTLYLMAREVLTRFPDIASVQLRMPNLHFLPVNLGGKENPGLVKFADDVYMPTDEPHGTIEATLSRANSKL

SEQ ID NO: 31725 - protein, 148 aa, Bacillus anthracis str. Ames
MEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIGIFFKEEELVDYSKLMNEWIY

SEQ ID NO: 31726 - protein, 436 aa, Exiguobacterium sibiricum 255-15
MSLTNQNSKSKAAFERALPLMPGGVNSPVRAYKSVGMTPIFAERAQGSRLYDIDGKEYIDYVLSWGPMILGHADPIVTAAIQEQATRGWSYGTPTEIESAMAEVVISRVPSVEVVRMVNSGTEATMAALRLARGYTGKTKILKFEGCYHGHGDSLLIKAGSGVATLGLPDSPGVPAQIASMTLTVPYNDMDAVRIAFEKHGDDIAGVIVEPAAGNMGFVPPQPGFLEGLREITEQHGTLLIFDEVMTGFRVGFNCAQGHFGVTPDITCLGKVIGGGMPVGAYGGRRDIMEQIAPQGPIYQAGTLSGNPLAMAAGLATLTQLKPEHYEEFDRKANRLSEGYLAAAAKYNIPLTTNRAGAMFGVFFTDQPVTNFEQAKSSNLDMFRSYYQKMAARGVFLPPSQFEGLFLSTVHTDDDIEQTLAAVELTFKELQLEFNR

SEQ ID NO: 31727 - protein, 467 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYSWSIVGASDGIQYGPFALPQNGLPIVLARKPEIEV

SEQ ID NO: 31728 - protein, 624 aa, Myxococcus xanthus DK 1622
MSGASRSLKVDGKVLEGISRGPLPASRKVYVPGVLHPDLRVPLREISQTPTRLGHGPDAKETANPPVHVYDSSGPYTDPAAELDLRQGLPALRESWILGRNDTEALSGVSSEYGRAREADPRLAGLRFAHRRSPRVAKSGANVTQLHYARKGIITPEMEYVALRENLQVEASLAAQHPGQSWGAAIPRVITPEFVRDEIARGRAIIPANINHPELEPMIIGRNFLVKINANIGNSAVTSSIEEEVEKMVWSIRWGADTVMDLSTGRNIHETREWILRNAPVPIGTVPIYQALEKVGGKAEDLTWELYRDTLIEQCEQGVDYFTIHAGVLLRYVPWTAKRLTGIVSRGGSIMAKWCLAHHRENFLYTHFEEICEIMKAYDVSFSLGDGLRPGSIADANDAAQFGELETLGELTQIAWKHDVQVMIEGPGHVPMHLIQENMTKQLAVCGEAPFYTLGPLTTDIAPGYDHFTSGIGAAMIGWFGTAMLCYVTPKEHLGLPDRDDVKEGVITYKIAAHAADLAKGHPGAQARDNALSKARFEFRWEDQFNLSLDPERARAFHDETLPAEGAKVAHFCSMCGPQFCSMKITQEVRDFAAKQGVSDDTALQSALDEKSAEFKKAGSQLYR

SEQ ID NO: 31729 - protein, 292 aa, Triticum aestivum
FQEHTDRPAMAAAAASREERWSLAGKTALVTGGTKGIGRAIVEELAGFGVRVHTCARSDADVQERLRGWAADADAGRLSGRVTASACDVSVRGDREALMATARAELGGKLDILVNNAGQTFFMPATQSTAEDYARLMATNLESCFHLAQLAHPLLVAAGGGSVVNISSVASAIAYPVLSVYSATKAAMNQLSRNLAVEWASDGIRVNCVAPGGIRSDILQSSGIEVDMEALLAMGKKENERVALGRMGEPEEVASLVTFLCMPAASYVPGQVIYVDRRRTHSGLGLACCLLA

SEQ ID NO: 31730 - protein, 269 aa, Oryza sativa (japonica cultivar-group)
MDAPLLRSLPSLGWALLSLSPAPARMLSTAASDALVEIKPGEISMVSDIPKEHLRRKVLLWTYSDLCSVDRFASPRRPVWESLEMSRFELGRNVLVRARPRRSAGSSPRNTLFTSVRPRNDVMLKKLGGISPVRLLCDKANMRSAGRLDKPSGMELSIRFWSNSSCTIFVRFASDGGMWPESELWLSRSTVRFGNASSHRGTPPTIEVVVVEVRDVEGGAIAERVRLGVGVSDRQLITVALLFANWPLLKWNMSIETTALFAYRVGKMK

SEQ ID NO: 31731 - protein, 924 aa, Oryza sativa (japonica cultivar-group)
MPSASAAAAALVLLFLAFSLSNAQPGFISLDCGGDDDYTDGIGIQWTSDAKFVSAGQEANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLAPNQTRKFKLVIPGKPEFSKPTVDVEENAQGKYCLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKELYIQNNKLSGEVPQALFKKSIIFNFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKITSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSVQDLEQNASFDELLMRPGLR

SEQ ID NO: 31732 - protein, 518 aa, Oryza sativa (japonica cultivar-group)
MEFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKHGPII

SEQ ID NO: 31733 - protein, 173 aa, Oryza sativa (japonica cultivar-group)
MPRVPLPLLLLVALLVAGGGGAAAETKPTAYEALATFDFPPGILPKGVVSYTLDDATGDFTATLNTTSTCAFSIQGSYSLRYQRRLSGRIAADRLTNLQGVSVKILFLWVNIVEVTRHGDELGFSVGIASADFGIDNFLESPQCGCGFDCHDHRDLSLPLPLPEPSLRLRGAF

SEQ ID NO: 31734 - protein, 643 aa, Burkholderia mallei ATCC 23344
MNANPKFLSADARVDAAAVAPLPNSRKVYVTGSQPDIRVPMREITQADTPTSFGGEKNPPIYVYDTSGPYTDPDAKIDIRAGLPALRQRWIDARGDTETLSGLTSDYGRERAADPATAELRFPGLHRHPRRAKAGKNVTQMHYARQGIITPEMEYIAIRENQRRAEYLESLKASGPNGAKLAAMMGRQHAGQAFGAAAFGANAPAEITPEFVRDEVARGRAIIPANINHPETEPMIIGRNFLVKINANIGNSAVTSSIGEEVDKMTWAIRWGGDTVMDLSTGKHIHETREWIIRNSPVPIGTVPIYQALEKVNGKAEDLTWEIFRDTLIEQAEQGVDYFTIHAGVRLQYVPLTANRMTGIVSRGGSIMAKWCLAHHKESFLYEHFEEICEIMKAYDVSFSLGDGLRPGSIYDANDEAQLGELKTLGELTQIAWKHDVQVMIEGPGHVPMQLIKENMDLQLDWCKEAPFYTLGPLTTDIAPGYDHITSGIGAAMIGWFGTAMLCYVTPKEHLGLPNKDDVKEGIITYKLAAHAADLAKGHPGAQVRDNALSKARFEFRWQDQFNLGLDPDKAREFHDETLPKDSAKVAHFCSMCGPHFCSMKITQDVREFAAQQGVSENDALKKGMEVKAVEFVKSGSEIYHRQ

SEQ ID NO: 31735 - protein, 450 aa, Desulfovibrio desulfuricans G20
MTATRFESGSIVLDTTIPNLGPAKIPSPLSYCRFANEEQGLSLFLDHDQVEELGDEVVPLTFEPAGPRRHVYFDTSKTKCAIVTCGGLCPGINDVIRAIVMEAYHNYRVPAVLGIKYGLEGFIPRYGHDVVELTPALVGDIHQFGGTILGSSRGPQSPEEIVDALERMNVNILFMIGGDGTMKAVRSITGEINQRRLKISVIGIPKTIDNDINFISQSFGFETAVDKATEAIQCAHTEAVGAMNGIGLVKLMGRESGFIAAQATLSLKEVNFVLVPETPFTLHGEDGLLNALAQRLRERSHAVIVVAEGAGQHLLSGSHDTDASGNPILGDIATLLRTEIKSHFDKLGIPHTLKYIDPSYIIRSVPANANDRVYCGFLGQNAVHAGMAGKTGMVVAKLMDRYIHLPLDLVTSKRRKLNIISDFWRAVLESTGQSHLAGMVPPEARSCPRA

SEQ ID NO: 31736 - protein, 387 aa, Corynebacterium glutamicum ATCC 13032
MSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 31737 - protein, 199 aa, Burkholderia mallei ATCC 23344
MASVNKVILVGNLGADPEVRYLPSGDAVANIRLATTDRYKDKASGEFKEMTEWHRVAFFGRLAEIVNEYLKKGSSVYIEGRIRTRKWQGQDGQDRYSTEIVADQMQMLGGRGSSGGGGGGGGGGGGGGDDGGYGGGGGGYGGGRDMERGGGGGRASGGGGAGARSGGGGGGGGGGGGGASRPSAPAGGGFDEMDDDIPF

SEQ ID NO: 31738 - protein, 642 aa, Desulfovibrio desulfuricans G20
MQPFYITTPIYYVNAKPHLGHAYTTIVADALRRFHTLLGKKTFFLTGTDEHGDKIVQAAEKNGCTPQEYVDSISATFRDLWPSMGITYDRFVRTTDESHKKCVQAVLQKVYDSGDIYFGEYGGHYCYGCERFYTEKELENGLCPQHQVKPEYIAEKNYFFRMSKYQDWLRQYILDNPDFIRPERYRNEVLSLLDSGALEDLCISRPKSRLSWGVELPFDTDYVCYVWFDALLNYVSALNWPDGEEFTTFWPGVQHLVAKDILKPHAVFWPTMLKAAGFEPYNNLNVHGYWLVRDTKMSKSLGNVIEPLEMAGRYGLSAFRYFLLREMHFGSDASFSEEALVARLNADLANDLGNLFSRVLSMTGKYFDGVVPSPAAYTADDEDIINLAKDACRNYVRLFERVRFSNALESLWELVRALNKYVDSSAPWTLYKTGDTARLGTVLYVLLECMRKVAVNLWPVMPEASEAMLGQLHVCFDSAGTRLQDEAEAWGTLQAGGKVEVSSGLFPRVEVAKEKDRPAEQPVPKAQPVAVPAVEYAEFEDFQKVELRVGTVLTVENHPKADKLYRIEVDLGEEQPRQIIAGLKEFFAPDALTGRQVVVVANLKPRKLRGLESQGMILALRTEDGMELLTASNPVPAGTRAS

SEQ ID NO: 31739 - protein, 192 aa, Schizophyllum commune
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVRHHCPGVPCLIVGTQIDLRDDSQVIEKLARQKQRPVTSDQGERLARELGAVKYVECSALTQKGLKNVFDEAIVAALEPPVVKKKGPKCVIL

SEQ ID NO: 31740 - protein, 131 aa, Zea mays
HASADAWVVYLCPEPYPETNTEFLEKNGIRLHQFGIEGRKEPFVNIPDDKIREALKVVLDPRNQPLLIHCKRGKHRTGCLVGCLRKLQKWCLSSVFDEYHRFAAAKARITDQRFMELFDVSSLKHLTPSHC

SEQ ID NO: 31741 - protein, 261 aa, Methanosarcina mazei Go1
MDDGRVLETRRKNVFGAITGKPTSLGGSAGRFDATAKGGLYAVREAAKKLGIELEDAKVAVQGFGNVGYHAAYLAKKLFGCRVVAVSDSKGAIYSGKGLDPEDVSGYKHSTGSVLGYPEAENLSNKELLELDVDILIPAALEDVVSIENAEKVRPKILAEMANGPTTREAEEVLISNGVHIIPDILYNGGGVIVSYFEMVQNESSIQWDEKEVEMRLEKKMKEAYHSVFDFAEKNNAGMRQAAYTLAVGRVVEAMQLRGWI

SEQ ID NO: 31742 - protein, 156 aa, Triticum aestivum
MLTYNSTSTMPIKAPTKPVSIALSPTTSSPMTAATPSLNSAAINGHKTQGQQHIWLVTGPAGCGKTTVAEYLAKSLGMPYVEGDAFHPTANIEKMANGIPLTDEDRWDWLTALREESINRLNAGSCGVVLTCSALKRKYRDVIRVAGYYDRRIQIH

SEQ ID NO: 31743 - protein, 226 aa, Brassica napus
  misc_feature (78)..(78): Xaa can be any naturally occurring amino acid
MDFSALLLTLFTGIIFLYFLRCLISQRRRGSSKLPLPPGTMGWPYVGETFQLYSQDPNVFFASKQKRYGSVFKTHVLXGCPCVMISSPEAAKFVLVTKSHLFKPTFPASKERMLGKQAIFFHQGDYHAKLRKLVLRAFMPEAIRDMVPDIESIAQDSLRNWDGTMINTYQEMKTYTFNVALLSIFGKDEVLYREDLKRCYYILEKGYNSMPVNLPGTLFHKAMKAR

SEQ ID NO: 31744 - protein, 204 aa, Triticum aestivum
  misc_feature (69)..(69): Xaa can be any naturally occurring amino acid
  misc_feature (138)..(138): Xaa can be any naturally occurring amino acid
  misc_feature (149)..(149): Xaa can be any naturally occurring amino acid
MAPTVMASSATSVAPFQGLKSTAGLPVSRRSNGASLGSVSNGGRIRCMQVWPIEGIKKFETLSYLPPLXAREALLKQVDYLIRSKWVPCLEFSKVGFIFREHNASPWGTNEWAGTGTMWKPAYVRVATDATQVINEVXEKVKKEYPDAXYVRIIGSTHAQVQCVSSSLKQRAARSGRLNTTHTAIKCMRFNRMLGSSITLLSKK

SEQ ID NO: 31745 - protein, 470 aa, Arabidopsis thaliana
MAATSPRPPPSTSLTSQQPPSPPSQLPLRTMPGSFQGPDKFFRTRAEKYKSTVFRTNIPPTFPFFGNVNPNIVAVLDVKSFSHLFDMDLVDKRDVLIGDFRPSLGFYGGVRVGVYLDTTEPKHAKIKGFAMETLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFGLTRDEAIQNLLFVLGFNAYGGFSVFLPSLIGRITGDNSGLQERIRTEVRRVCGSGSDLNFKTVNEMELVKSVVYETLRFSPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRYDTITGDSGSIKAVVKAK

SEQ ID NO: 31746 - protein, 448 aa, Nocardia farcinica IFM 10152
MRIAIVGGGISGLVAAYRLRTLLGPAADLVLVDRAERVGGILYTADIQGEPVDLGAEAFVGRRPEVPALLRELGLEDQLVYPAGKRPLLWAGGATHPLPPRTLMGIPSDAESMRGLVDDDTLDRIASESARPLAWYPDSDLDVHSLVADRFGAQVVERSVDPLLGGVYAGSARSIGVRAALPTLAAALDAGAPSLTHAVAAALPPPSDAPVFGGIRDGYRVLLDALVAASGLRFVAATAATRLARASGGWVLDPLGLVDAVVVAAPAPVAARLLRYVAPGAADAAAGIELSSSAVVALSLPPDTALPDNSGILVATGEPLRAKAFTLSSRKWPHLAERKTALVRASFGKFGDDAPLRWSDAELIAAATEDLATVTGVPITPVEAVVQRWPGGLAQYAPGHTDRVAEIDRAVAELDGLAVAGAYLRGVGVPACVAAGDAAARRIAGFLS

SEQ ID NO: 31747 - protein, 251 aa, Zea mays
SLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQF

SEQ ID NO: 31748 - protein, 440 aa, Oryza sativa (japonica cultivar-group)
MASAAAAAASDEPPRKRARSAGAEDRLSELPDCLLHDILALVGSRQAVRTSVLSRRWRGLWRSAPRVDIDQREFRRACGGEEGEPVVDCDGFEDFADGILSPTLLGGTGTPPLDAFRLHLLYEGRFITFGRWVRRALTRRPASVDIHVEYGGTVDWPPALTLGDGAGTGRLKRLHLFGVHLGFISGDGGRLAELLPVLEDLRMESCTFGHEPSSPTTTIAIPTLRSLALAVVPRRTARPYALTVASPRVASLRLFLPFSRTRAAAVRVAPAEEGEALASLVTASITVLETDQELNRRMNKHKLDFLASTRNMLDRFPNVRNLDLSGFPTIALLDKASQEFPTLPSLTTLLLSECDVGANCYVLKSVLRNAPNLEHLRLHRCKFLGTPKRKRGNSRSKGKSSSTCLDSLSSKCKSLQSVEIKFRPIDNARHHDLVGLLKEC

SEQ ID NO: 31749 - protein, 170 aa, Triticum aestivum
MHPTRWELSHMVDLQAAGLVISSGRPGGIVSPAELLVCHFTGIKALEDEYGSAEIVKQGVEVVQTALTKAFDQLQGAYNGKIVGLVISTKEASTSLASIIDAPSSLHISRRLAEASKTNATASIAAIYLVRLSLAWITGIILLGLTLIGICLLMNMPVTRDSSYIQCQDG

SEQ ID NO: 31750 - protein, 512 aa, Petunia x hybrida
MEILSLILYTVIFSFLLQFILRSFFRKRYPLPLPPGPKPWPIIGNLVHLGPKPHQSTAAMAQTYGPLMYLKMGFVDVVVAASASVAAQFLKTHDANFSSRPPNSGAEHMAYNYQDLVFAPYGPRWRMLRKICSVHLFSTKALDDFRHVRQDEVKTLTRALASAGQKPVKLGQLLNVCTTNALARVMLGKRVFADGSGDVDPQAAEFKSMVVEMMVVAGVFNIGDFIPQLNWLDIQGVAAKMKKLHARFDAFLTDILEEHKGKIFGEMKDLLSTLISLKNDDADNDGGKLTDTEIKALLLNLFVAGTDTSSSTVEWAIAELIRNPKILAQAQQEIDKVVGRDRLVGELDLAQLTYLEAIVKETFRLHPSTPLSLPRIASESCEINGYFIPKGSTLLLNVWAIARDPNAWADPLEFRPERFLPGGEKPKVDVRGNDFEVIPFGAGRRICAGMNLGIRMVQLMIATLIHAFNWDLVSGQLPEMLNMEEAYGLTLQRADPLVVHPRPRLEAQAYIG

SEQ ID NO: 31751 - protein, 365 aa, Oryza sativa (japonica cultivar-group)
MRALSLARASSPPPLLLHLRRALAPASSSSPAPVLLLRPAVSCSSLFVSDRAAAARRSSGSSRRSMASQQFPPQNQETQPGKEHAMDPRPEAIIQSYKPANKLKDKVAIVTGGDSGIGRAVCLCFALEGATVAFTYVKGQEEKDAEETLRALRDIRARTGAKDPMAIPADLGYDDNCRKVVDEVAGAYGGAIDILVNNAAEQYERPSITDITEDDLERVFRTNIFSYFFMSKHAVKRMRDRRGGAGAGGCSIINTSSINAYKGNKTLLDYTATKGAIVAFTRALALQLAEEGIRVNGVAPGPIWTPLIPASFAEEKVRQFGSQVPMGRAGQPSEVAPSFVFLASDDASYMSGQMLHVNGGVIVNG

SEQ ID NO: 31752 - protein, 551 aa, Coprinopsis cinerea okayama7#130
MVPHDTQDEDLSVLIDRDYLVVGVKGHPPTIKGKLYSAVDTASSVWQLEPHSSRLSARDRTISTTSTTSTQSSYAFVSDPDISSSFAASLEVSDAEDGYFSSAPSPTVLQGELERTTAGGIPPRRRLPSNIASRSTSPGRAIFQNMQIASSFSSLESLHSPQSGRLLTIHLEKEKSIIWPSLITGPVPETMSPTLTNSVVFNSSEELEHQYNMDPTSLALIGLEYADIRKNKEEAFEYFLRAWHQAHVPSATMRLVSLYLPLNATETVEELEPEEQPKRGSFPYYFQCIGGLKGVAQLYLEAGLLHLEGAASTLLAASYSSLSSLRVPIQTQTGTDGGTEAWKRDREAAAKYFERARALQPDMDVPTIPEDNVSAINKQELDVQMPSIDLSDSVTPESIGTSDPASDHEYPTIRRRQKKTEMAVVERTEKLADDIDSTWYLYIPGLVGAGTALLVLGVWRACADGGANRLYDILPDDKTRLQYLPNLIKGDLDSIRPDVREFYEKHNVSVVEDGSQYATDLMKCVDAISEEEEKGRQPQVCILVVQVRKAT

SEQ ID NO: 31753 - protein, 448 aa, Clostridium perfringens ATCC 13124
MEVKKYVDNLMEDLKKNNPGESEFLAAAEEVLYSLVPVLEKNPKYMEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSSGYVYDENGIDLEVVKEIKEVKRGRISEYVNYVKTAKFTEGCRGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSRNAASEYGHDGNLIVGANIAGFKKVADAMLDHGII

SEQ ID NO: 31754 - protein, 476 aa, Novosphingobium aromaticivorans DSM 12444
MTAYPSLHMIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVHEG

SEQ ID NO: 31755 - protein, 513 aa, Saccharomyces cerevisiae
MTSKNLYSNKRLTTSTNTTVRFASTRSTGVENSGAGPTSFKTMKVIDPQHSDKPNVTMTGSGWGAISFLKHIDTKKYNVSIISPRSYFLFTPLLPSAPVGTVDEKSIIEPIVNFATKKKGNVTYYEAEATSINPDRNTVTMKSLSAVSQTYQPENHTGTHQAEPAEIKYDYLISAVGAEPNTFGIPGVTDYGHFTKEIPNSLEMRRTFAANTEKANLLPKGDPERRRTTSIVVVGGGPTGVEAAGETQDYVHQDTRKFTPALAEEVQIHLVEATPIVLNMFEKKTSSYAQSHLENTSIKVHTRTAVAKVEEKQLLAKTKHEDGKMTEETIPYGTLIWATGNKARPVITDTFKKIPEQNSSKRGLAVNDFLQVKGSNNIFAIGDNAFAGLPPTAQVAHQEAEYLAKNFDKMAQMPNFQKNTSSRKDKIDTLFEENNFKPFKYNDLGALAYTGSERAIATMRSGKRTFYTGGGLMTFYLWRILYLSMITSARSRLKVFFDWIKLAFFKRDFFKGL

SEQ ID NO: 31756 - protein, 307 aa, Synechococcus elongatus
MISADPPQVHPAGTFDVKAYLKERQALVEAALEASIPVAYPEKIYDAMRYSLMAGGKRLRPILCLATCELMGGTVEMAMPTACALEMIHTMSLIHDDLPAMDNDDYRRGKPTNHKVYGEDIAILAGDGLLAYAFEYVVEQTKNVPAEYLLKIVARLGHAVAATGLVGGQVVDLECEGQPDIGLETLHFIHSHKTGALLEASVVSGALLTGAHESDVARLSRYAANIGLAFQIVDDILDITSTRDVLGKTVGKDVAAQKMTYPRLWGLEKSRQEAERLVAEAKAELAVYGAAAVPLQAIADYITSRSH

SEQ ID NO: 31757 - protein, 122 aa, Glycine max
MATTLMFFRPTMIRASAGSPAKPDPRNRKPVSSNWWAPLFGWPADPDYMGPLQKASEKSDPEREVGLDLGRPRSKFTAGCFTEKKAKELRKKTVETSTFHDIMYHSAIASRLASDVSKGYEK

SEQ ID NO: 31758 - protein, 389 aa, Oryza rufipogon
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 31759 - protein, 497 aa, Triticum aestivum
ACSLAGHWGLGKLIVFYDDNHISIDGDTEIAFTEDVSGRFEALGWHTLWVKNGNDGYDEIRKAIQEAKSVTDKPTMIKVTTTIGFGSPNKANSYAVHGAALGTSEVEATRANLGWPYEPFFVPEDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETAGAYKVAVLNRKRPSILALSRQKLPHLPGTSIEGVAKGGYTISDNSTDNKPDFIIMSTGSEVEIAVKAAEELTKEGKTVRVVSFVCWELFDEQSDEYKESVLPEAVTARISIEAGSTLGWQKYVGSKGKTIGIDKFGASAPAPKIYKEYGITAESVIAAAKSL

SEQ ID NO: 31760 - protein, 324 aa, Synechococcus elongatus
MEQHYRDTIEQAIARALDRTELPPILDEPVRYALASGGKRLRPLITLLAAEACGSSPADAAPVAAAVEILHNFTLIHDDIMDRSPLRRGRPTVYRAWDDATAILAGDTMMGIAYRLLSEHYPAEVCQHLVAECSSAFVDVCIGQAEDLAFRTMPSVTMDDYLRMIGRKTARLFATAAVAGGIVARAPHDVLAALRTYGTALGMAFQIRDDVLDLFGSPEFGKELGQDLREGKKTFPTLSAAAHATDPNDLATFAAYFAGTPPTDSEEIAQMRERCRRLGALEHAESLIAHYLSTANAALESHLPSTSARDRLCALARATRNRHL

SEQ ID NO: 31761 - protein, 669 aa, Thermoplasma volcanium GSS1
MTLTVCPYCGTGCQINVEYRNGHFTVHGYNKSIVNQGKLCIKGYQGLSYSSSSQRLNYPMIRKNGILTKVTWNEALDYVSEKLKTIRNKYGADAVAFQSSAKCTNEENYLMQKIARMFGTNNIDHCARSCHSSTVAGLIKTIGTAAATGSIKSLKSTKTYFIIGSNTTEQHPIIGTTVLKGKKSGSYLIVADPRKTKLASNADIFLQFRPGTDVALLNSIMFVILKENLYDEEFIKNRTEDFDKLAAEIEKYPPELTEAITGVDAELVRRAAEIYAKYKPSAILYGMGITQHIHGTENVMSVSNLALMTGNIGKYGAGIFPLRGQNNVQGSSDMGALAEFYPGYIPVDSEGVKRFEDLWKTELPKKVGLTLSEMFDAAAAGKVKAIYLMGENPVITEANVAEVEKGIENLELFIVQDIFLTETASLADVVLPAATALEKDGTFTNTERRVQRIVSVKSPPGEAKQDWWILSEIAHRLVGTERYRSVEDVFNEITQAIPNYSGIRYQDIYPTGKQWPVNEQNPDGTEILHTVKFTRGLGRFYPVSYEPPSEIADAEYPFILTTGRNYYHWHSGTMTRRSDILERESPSPYVEISMMDAKQLNIRDGQAIDVESRHGRITLPAKVTDKIPTGIIFVPFHFKEARVNLLVGDNLDPYSKIPEFKVVAARVIV

SEQ ID NO: 31762 - protein, 385 aa, Arabidopsis thaliana
MCIYASRQTVCPYLTPFKVKRPKSREMNSSDVNFSLLQSQPNVPAEFFWPEKDVAPSEGDLDLPIIDLSGFLNGNEAETQLAAKAVKKACMAHGTFLVVNHGFKSGLAEKALEISSLFFGLSKDEKLRAYRIPGNISGYTAGHSQRFSSNLPWNETLTLAFKKGPPHVVEDFLTSRLGNHRQEIGQVFQEFCDAMNGLVMDLMELLGISMGLKDRTYYRRFFEDGSGIFRCNYYPPCKQPEKALGVGPHNDPTAITVLLQDDVVGLEVFAAGSWQTVRPRPGALVVNVGDTFMALSNGNYRSCYHRAVVNKEKVRRSLVFFSCPREDKIIVPPPELVEGEEASRKYPDFTWAQLQKFTQSGYRVDNTTLHNFSSWLVSNSDKKST

SEQ ID NO: 31763 - protein, 449 aa, Arabidopsis thaliana
MDAKMFDTICSRDAISWLPDEVLGKILSLIPTKQAVSTSLLAKKWRTIFRLVDHLELDDSFSLQAVKDQTPGLRKHVRFVFTEDFKIFVDRTLALQCDYPIKNFSLKCHVSKYDERQKACVGRWISNVVGRGVFELDLRMKDPGIHFLPPHLVASKTLVKLTLGTQLCLGQLPSYVSLPSLKSLFIDTIVFYDIEDLCCVLLAGCPVLEELSVHHHDFIATPHTISSPTLKRLSVDYHCPDDVDSASHMSFDLPKLVYLEYSHCALGEYWQINLESLVEAKLDLGLERKVLRMDVTDLIIGIRNVQSLHLSPDSVHVIYSYCRHGLPVFKNLVNLSFGSKNKRGWRLLANLLKQSTKLETLIVKDLNGYTGDVSMPLNKVTSLHILGYRGTADEVKQLKSFIGEFECLELVQVDVAEAAEDNGKILQSKRDLMMLLGVSLPSKCQFKVT

SEQ ID NO: 31764 - protein, 161 aa, Phaseolus vulgaris
MFLMVTEFINYSEQIIRAARYIGQGLMITLSHANRLPVTIQYPYEKIISSERFRGRIHFEFDKCIACEVCVRVCPIDLPIVDWKLETDIRKKRLLNYSIDFGICIFCGNCIEYCPTNCLSMTEEYELSTYDRHELNYNLIALGRLPVSVIDDYTIRTIQIK

SEQ ID NO: 31765 - protein, 393 aa, Phaseolus vulgaris
MNISTIRKDFMIVNMGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFREREFIYDLFEAATGMRMMHNFFRIGGVATDLPYGWVDKCSDFCDYFLTSIAEYQKLITRNPIFLERVEGVGVVDVKEVINWGLSGPMLRASGIQWDLRKVDNYECYEEFHWEVQWQKEGDSLARYLVRIGEMVESIKIIQQALEGLPGGPYENLEIRCFDREKEPEWNEFEYRFISKKSSPSFELPKQELYVRIEAPKGELGIFIIGDQNGFPWRWKIHPPGFINLQILPQLVKRMKLADIMTILGSIDIIMGEVDR

SEQ ID NO: 31766 - protein, 121 aa, Oryza sativa (japonica cultivar-group)
MSSPHVLVVDDTHVDRHVVSMALMRHNVRVTAVESVMQALMFLDSEHDVDMIVSDYCMPDMTGYNLLMEVKKSPKLAHLPVVIASSDNIPERIRKCLDGGAKDYILKPVKIVDVPRIMKYI

SEQ ID NO: 31767 - protein, 515 aa, Oceanospirillum sp. MED92
MKEKAVVIQMSINRSQLPAPLYTAEQTRVLDRTAIEEFSIPGIRLMQRAGHAVFAEIVERYPSLRSMTILCGSGNNGGDGFVIALLARQKGVKVQLLCVGQNDFADKLKGEAKEAWVQLQAIDPEYQLYADDIDFEGELVVDALLGTGLSGAVRGAYASAIHKINQSSRSVVAVDIPSGLCADSGRVLGCAVRADLTLSFIGLKRGLLTSQAVDHCGELLFDDLKVPEEVCDRIPVNVFRTTSDDLNEFLPQRSRSAHKGNFGRVLIVGGNSGMGGAALLAAQAAMRSGAGLVSLATREAHVTASLVRCPEVMVHAVESTGALAPLLEQAEIIVIGPGLGQNAWSDQMLRAAFASNKPMVLDADALNLLSDRHKSLLRPRDNWICTPHPGEAARLLRSSVAEIEEDRFASVEQLQNRLGGSVVLKGAGSLVCAGEAVYLCNAGNPGMAVGGMGDVLSGICGAFMAQGLSPELAARLAVYVHARSADKIVEKQGERGLLASDLFAAIPGVINGKYE

SEQ ID NO: 31768 - protein, 627 aa, Bordetella bronchiseptica RB50
MPAATDPDIAALVARAAAVAPERRSGTLRDLDHIVILMQENRGFDHYYGALPGARGRADPHRAPTPDGDVFVQAHAGQRLAPYPLAPALPPGQPLGHLTPHTWDDAQRAWNDGRMDQWLAAKGRLGMGYYRPEELPLQTALARAFTLCEAYHCSMHAGTNPNRLFLWTGTNDPHGQAGGPALVNTHDRPGPAHEGYAWTTYPERLQAAGVDWAIYQDMADNYHDNPLAGFRQYRAELAGGAARAPLRERALSTRTLAALAEDAANGRLPQVAWIIAPAADSEHPEVSSPAQGAAFSARVLDILTRDPALWRRCALLLTYDENDCFFDHMPPPAPPGAAGGGSTADTAGEYHQARGGPSAGTPDDPRALHGRAYGLGPRVPMLVVSPFSRGGWLDARVYDHTSVIRLLESRFGVAEPNISPWRRAVCGDLSHAFDFTGAQDQAGAPGPRSRPSPYACHVEAWAADGRQRVRMANPGHATLVLHVYDCLRLAQGPRRYTIEPGRQWEDSWPDAGADLACDLWILGPDGFHRHIRRHGAAAPLAAAWRDQPPALLLENRGAQALQARIESAYGEAPALLRLAPGEQAAWPYEPSASRGWYDLTASAAGQSLRLAGRMRAAGPGRPDPRLG

SEQ ID NO: 31769 - protein, 167 aa, Oryza sativa (japonica cultivar-group)
MGEKTEYRDRLVENAFMGLFARKIKKYAVISSSGGKEKKKSSSRSSSCRHVGQLGLRVQRRPHHSLFPLARRSIRVTAVESVMQALMFLDSEHDVNMIVSDYCMPDMTGYDLLMEVKKSPKLAHLPVVIASSDNIPERIRKCLDGGAKDYILKPVKIVDLPRILNYI

SEQ ID NO: 31770 - protein, 391 aa, Corynebacterium crenatum
MSTLETWPQVIINTYGTPPVELVSGKGATVTDEQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLRAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVTRKGELFKELLAKVDGVVDVRGRGLMLGMVLERDVAKQAVLDGFKHGVILNAPADNIIRLTPPLVITDEEIADAVKAIAETIA

SEQ ID NO: 31771 - protein, 109 aa, Cyanidium caldarium
MFKNIIIVVAVTLCALFTNEHVVYSANLEHGEQIFSANCAACHAGGNNVIMPEKTLKAEALEANNIKNISAIANQVKNGKNAMPSFSRLSDSDIEDVANYVLSKADKGW

SEQ ID NO: 31772 - protein, 357 aa, Arabidopsis thaliana
MEETKMSLLDDSFTSAMTLTNSGVPQVPDRYVLPPSQRPALGSSLGTSETTLPVIDLSLLHQPFLRSLAIHEISMACKEFGFFQVINHGIPSSVVNDALDAATQFFDLPVEEKMLLVSANVHEPVRYGTSLNHSTDRVHYWRDFIKHYSHPLSKWIDMWPSNPPCYKDKVGKYAEATHLLHKQLIEAISESLGLEKNYLQEEIEEGSQVMAVNCYPACPEPEMALGMPPHSDFSSLTILLQSSKGLQIMDCNKNWVCVPYIEGALIVQLGDQVEVMSNGIYKSVIHRVTVNKEVKRLSFASLHSLPLHKKISPAPKLVNPNNAPAYGEFSFNDFLNYISSNDFIQERFIDTIKKSSS

SEQ ID NO: 31773 - protein, 388 aa, Bdellovibrio bacteriovorus HD100
MAEYINPDYVPEPEKMNVKKGLDGVVMDTSSVSKVNPHTNSLIYRGYPVQDLAENCSFEEVAFLMYNGELPNAGQLAEFSKKERSYREISTTLLNVIKALPQKCHPMDSIRTAVSFLGAEDARIWDASPATNMDKAMMLLAKIPTMVAADYRFKKGLDFIPPKADLSIAENFFHMCFGKVPQKEVVKAFDVSLILYAEHSFNASTFTARVVTSTQSDIYSATVAGIGALKGPLHGGANEMVMHMMKEIADPAKAEQWMLDALAQKKKVMGFGHRVYRSGDSRVPTMKKYAQVMADVTGEQKWMQMYTALEKVMVDKKKIYPNLDFPAGPAYYMMGFEIDFFTPIFVMARTTGWSAHIMEQTADNRIIRPLSEYVGAEQRKVTPISERK

SEQ ID NO: 31774 - protein, 575 aa, Saccharomyces cerevisiae
MQCRSIVHRLYSKVSHVTTPIFYPNAKPHLGHLYSSLLSDVYHRWQLFKGNLSFFTTGTDEHGLKIQCASESNGFDQPKKFVDKLYPEFVQLDKIYGINYTRFIRTTDPDHIENVMKLWELCLKNGYIYMGEHKGWYSISDETFYPESKVIKDPKNDGKYLNTESKNEVVYQSETNYFFRLSLFNKKIVDHIRKNPDFIFPASKRDQILKELETGGTLPDLSISRPSARLKWGIPTPNDPSQKVYVWFDALCNYLSSIGGIPSILSNATEVVSRHYSDKSNVKGQLLIPYPKEVQRNTIHVIGKDIAKFHTVYWPSFLLAAGLPLPRQIVVHGHWLCNGMKMSKSLGNVVDPIDMARYYGADIVRWFLLENSKLEEDGDFQEAKLYETRELLVSKWGNLINRCCGSKFNIERAVMKFSDKANFQFQEIFQNEPIVSERIENLAKLLNKSQEVFDEKIAIFQYPQLLRHVWSIINDANTLVQNSKPWERELDQQDNIIFLAMETSRILSILCQSIIPSLSQSFLDRIDVSKEKRTINYARLGSDKTYGKQSNKKGREVPLKKIPFRLQEEQTNMRS

SEQ ID NO: 31775 - protein, 226 aa, Bordetella bronchiseptica RB50
MLTQQELKQQAAEAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 31776 - protein, 537 aa, Glycine max
MKDLRLSLFHGPSTFSTEREMEAASWPTIILLLIIMIWAWKMLNWLWLRPKRLERLLREQGLQGNSYTLFVGDLKEFGKMRNEALSKPMNLFSHDIAPRVLSFIQHTVNKHGKNSFIWFGPIPRVTLTDPEQIKDVLNKIYDFGKPDMNPHVRLLAPGLVSHEGEKWSKHRKIINPAFNLEKLKNMLPLFIKCCDDLISKWEGMLSSDGTSETDIWPFFQNLASDVISRTAFGSSYEEGRRIFQLLKEQTELTIQTFLKVNIPGWRFVPTTTHRRMKEINKDIEASLMDMINKRETALKAGEATKNNLLDILLESNHKEIQEQGNKNVGMNLEEVIEECKLFYFAGQETTSVLLVWTMILLSMYPDWQTRAREEVLQVFGNRKPNFEGLNHLKIVTMILNEVLRLYPPVVGLARKVNEDVKLGNLSLPAGVQISLPIVLVHHDCELWGDDAKEFKPERFSEGLLKATNGRVSFFAFGGGPRICIGQNFSFLEAKIALSMILQRFSFELSPTYTHAPTSVITLQPQHGAHLILHKVEI

SEQ ID NO: 31777 - protein, 814 aa, Burkholderia mallei ATCC 23344
MRKMKLVMVGNGMAGVRTLEELFKLAPDLYDVTVFGAEPHPNYNRILLSPVLAGEQTLEQIVLNDYAWYASHGVTLHVGKKIVKIDRVKRVVIADDGTEAAYDRLLLATGSNPFMLPVPGAQLDGVLGYRDIADTQAMIDAAARHTHAVVIGGGLLGLEAANGLKLRGMDVTVVHLAPTLLERQLDAKAGDLLRASLEARGLTFLMPKQTQALVGDEHGRVRAVHFKDGGECKADLVVMAVGIRPNTALAESAGLYCNRGLVVNDTMQTYDPRIYAVGECVSHRGIAYGLVAPLFEQAKVAANHLAQFGIGRYTGSVTSTKLKVTGIDLFSAGDFLGGDDTEDITLSDPIAGVYKKLVIKDDRIVGACLYGDTADGAWYFKLLREGRNIADIRETLMFGETSLGDTGHSGATRAMTMADDAEVCGCNGVCKGTIVSAIKEKGLFTLDDVRKHTKASASCGSCTGLVEQILMSTLGGDYSASPKAKPVCGCTDHTHAEVRAAIREHKLLSVPEAMRFLEWRTPNGCSSCRPALNYYCISTWPHDAKDDPQSRFINERAHANIQKDGTYSVVPRMWGGVTSADELRRIADVVDKYAIPTVKVTGGQRIDLLGVKKEDLPGVWRDLGMPSGHAYAKALRTVKTCVGSEWCRFGTQDSTLMGQQLERALWRMYAPHKVKLAVSGCPRNCAESGIKDVGVIGVDSGWEIYVGGNGGIKTEVAQFFCKVKTHEEVLEYAGAFLQLYREEGWYLERTVHYLERVGLDHVKARVLDDAENRRALWDRLQFALKDEPDPWHDTQDAKVDLRQFIPIAVAPADA

SEQ ID NO: 31778 - protein, 247 aa, Glycine max
MYVASMRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKAVCMERYRRRDDEEYRQSSDIDIEREDECGICMDMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 31779 - protein, 271 aa, Triticum aestivum
  misc_feature (252)..(252): Xaa can be any naturally occurring amino acid
  misc_feature (261)..(261): Xaa can be any naturally occurring amino acid
  misc_feature (264)..(264): Xaa can be any naturally occurring amino acid
MSARWFDLPLESKMKVVWTTPEANRGYSAPGREKVSQLTDLADVEKMRAALPDIKESLEIGRENEAGHPNYWLEESGELVGFRKDMLGFFEQCRQLHVEVMKAIAVGMGLDDGFFDGFVDVGDNTLRLLHYPSVQSNVFKMNPGTVRAGEHSDYGSITLLFQDVRGGLQVKSPTGQFVDATPIEGTVVVNAGDLLARWSNDMIKSTIHRVVEPPQKEAESYPPRYSIAYFCNPNFKSFIEAIPGTFETEKGXKYDGIHSGXYLXQRLTATY

SEQ ID NO: 31780 - protein, 951 aa, Burkholderia mallei ATCC 23344
MTVDTLAQPIAPSTPGAVRETRSTCCYCGVGCGVVIETRRDANGRDTIVGVRGDPDHPANFGRLCSKGSTLHLTATPERYAQTRATHPELRASRDATRTRVSWDDALEHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGALKAIWIVCTNPAHSIPSQALARAGLERAEFVVLQDAYAHTGTAPYADVLLPAATWGEKEGTVTNSERRISRVRAATQPYGDARADWRIAADVGHRLEARLAPGRPTLFPYEDAEAIWNEHRATTLGRDCDIGGLSWPLLARDGPQQWPFPAGATQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVAFSVAGAAGATEDSAAVLRDYVDTGASVGALGRLLLFAGRVPLQTAPARGRTICNCVGVSEREIGAVLAADAPSAAPIERLANLQERLKCGTQCGSCIPELRRLIAETATAAAPPPR

SEQ ID NO: 31781 - protein, 540 aa, Corynebacterium glutamicum ATCC 13032
MADISTTQVWQDLTDHYSNFQATTLRELFKEENRAEKYTFSAAGLHVDLSKNLLDDATLTKLLALTEESGLRERIDAMFAGEHLNNTEDRAVLHTALRLPAEADLSVDGQDVAADVHEVLGRMRDFATALRSGNWLGHTGHTIKKIVNIGIGGSDLGPAMATKALRAYATAGISAEFVSNVDPADLVSVLEDLDAESTLFVIASKTFTTQETLSNARAARAWLVEKLGEEAVAKHFVAVSTNAEKVAEFGIDTDNMFGFWDWVGGRYSVDSAVGLSLMAVIGPRDFMRFLGGFHAMDEHFRTTKFEENVPILMALLGVWYSDFYGAETHAVLPYSEDLSRFAAYLQQLTMESNGKSVHRDGSPVSTGTGEIYWGEPGTNGQHAFFQLIHQGTRLVPADFIGFARPKQDLPAGERTMHDLLMSNFFAQTKVLAFGKNAEEIAAEGVAPELVNHKVMPGNRPTTTILAEELTPSILGALIALYEHIVMVQGVIWDINSFDQWGVELGKQQANDLAPAVSGEEDVDSGDSSTDSLIKWYRANR

SEQ ID NO: 31782 - protein, 673 aa, Oceanobacillus iheyensis HTE831
MARENAFYITTPIYYPSGKLHIGNAYTTIACDVMARYKRMRGFDVFYLTGSDEHGQKIEQKAKEMNISPKAYVDDMAEGMKKLWNTLEISNDKFIRTTEEQHKKVVADIFERFLEQGDIYLDEYEGWYSVPDETFYTETQLEDVERDDDGNVIGGKSPDSGHPVELIKEESYFFRMSKYADRLLKFYEDNPEFIQPESRKNEMINNFIKPGLEDLAVSRTTFSWGVQVPSNPKHVVYVWIDALTNYITALGYGSEDTSLYDKFWPADVHMVGKEIVRFHTIYWPIMLMALDLPLPKKVFAHGWLLMKDGKMSKSKGNVVYPEMLVERYGLDALRYYLMREVAFGSDGVFTPEDFISRVNYDLANDLGNLLNRTVAMINKYFDGKVPEFKGEVTSFDGELQTTANNAVKEYEKHMEGMQFSDALKQVWILISRANKYIDETEPWIVAKDEGRRNELASVMVHLAESLHAAALMLQPFLTHAPKKIAEQLGLGEEYGLDWGTIGFGNFPENTTVVKKGTPIFPRLDLDEEAAYIRDQMANGANAASSEDETGDWDPNETDLVSEKEKQIKYDVFDKVELKVAEVKDCSKVEGADKLLKFRLDAGDNGDRQILSGIAEYYSEPEQLIGKKVVIVANLKPRKMRGEISQGMILSAEYDGKLQIVEAPSEAPNGSSIS

SEQ ID NO: 31783 - protein, 423 aa, Triticum aestivum
  misc_feature (10)..(10): Xaa can be any naturally occurring amino acid
  misc_feature (241)..(241): Xaa can be any naturally occurring amino acid
  misc_feature (381)..(381): Xaa can be any naturally occurring amino acid
  misc_feature (397)..(397): Xaa can be any naturally occurring amino acid
  misc_feature (402)..(402): Xaa can be any naturally occurring amino acid
  misc_feature (404)..(404): Xaa can be any naturally occurring amino acid
  misc_feature (417)..(417): Xaa can be any naturally occurring amino acid
  misc_feature (421)..(421): Xaa can be any naturally occurring amino acid
GTGGRGGATXWGEAPPDPFNCIHVADTPTLDALKKGAPERWRLIKAHGTAVGLPTDDDMGNSEVGHNALGAGQIYAQGAKLVDLALASGKIYEGEGFKYIQQSFETGTLHLIGLLSDGGVHSRIDQLQLLLKGASEHGAKRIRVHILTDGRDVLDGSSVTFVETLENDLAKLREKGVDARIASGGGRMYVTMDRYENDWQVVKRGWDAQVLGETPHKFPSALEAVKKLRDDPKANDQYLPXFVVLDESGKPVGPIVDGDAVVTFNFRADRMVMLAKALEYEDFDKFDRVRFPRIRYAGMLQYDGELKLPSHYLVAPPEIERTSGEYLARNGVRTYACSETVKFGHVTFFWNGNRSGYFNPNLEKYEEIPSDTGIPFNVQPXMKAVEVAEKARDAILXGKFDXVXVNIPNGDMVGHTXDLEXTI

SEQ ID NO: 31784 - protein, 92 aa, Brassica napus
MVTKTEERELNQLENQVENGGGGIWEYLCLVRKLKVRRSEIVLKHGLSILNDSGKRFSLGPDEWTLYEQVAIAAMDCQSLAVAQVSCLPLPH

SEQ ID NO: 31785 - protein, 336 aa, Galiella rufa
MVVKVGINGFGRIGRIVFRNAIEHEDIEIVAVNDPFIAADYAVYMLKYDSTHGRFKGEVSHKDGDLIVNGKTIKMYQERDPASIPWSETGAYYVVESTGVFTTIEKASAHLKGGAKKVVISAPSADAPMFVCGVNLEKYSKDINILSNASCTTNCLAPLAKVINDNFGIVEGLMTTVHSYTATQKTVDGPSAKDWRGGRTAAANIIPSSTGAAKAVGKVIPALNGKLTGMSMRVPTQNVSVVDLTVRLEKGASYEEIKKVVKAAAEGDYKGVLEYTEDELVSSDLNGNNASSIFDARAGISLNEKFVKLVAWYDNEWGYSRRVLDLISYIAKVDAK

SEQ ID NO: 31786 - protein, 172 aa, Exiguobacterium sibiricum 255-15
MEFKQHIKEVENWPKEGISFKDITSLMQNGPAYKQSVDALIDYARKQGADVIAGPEARGFVVGCPAAYAMEIGFVPVRKEGKLPRETVRVEYGLEYGKDVLTMHHDAIQPGQRVVILDDLLATGGTIEATIKMIEQLGGTVAGIGFLIELDGLGGREKLEGYDILSLIRYAD

SEQ ID NO: 31787 - protein, 346 aa, Rhodococcus sp. RHA1
MSVESIVQSTRIVLASRPDGAPTTDNFRLEAVNLPDPAEGQVLIRVIYLSLDPYMRGRMSAAESYADPVEIDEVMVGGTVGQVVDSRHPDFATGDYVLGYAGWQSHAVVDGNQLRTLDRRAAPLSTAVGVLGMPGFTAYSGLLKIGQPKAGETVVVAAASGPVGSAVGQIAKLKGARAVGIAGGPEKCAYLLDELGFDAAVDHRSPNFAEELRAACPDGIDVYFENVGGAVAAAVLPLLNLYARVPVCGLIAQYNDTETPEGPDRLPGFFTRVLVKSLTIRGFIQREFVSEMYADFQRDVSGWIRDGRFAYREDIVDGLENAPAAFIGLLRGSNFGKLVVRVAEED

SEQ ID NO: 31788 - protein, 115 aa, Zea mays
LEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVE

SEQ ID NO: 31789 - protein, 148 aa, Brassica napus
MEQTFIMIKPDGVQRGLVGEIICRFEKKGFTLKGLKLITVDRPFAEKHYQDLSAKPFFSSLVDYIISGPVVAMIWEGKNVVLTGRKIIGATNPAASEPGTIRGDFAIDIGRNVIHGSDSVESANKEAALWFPDGPVNWQSSLHSWIYE

SEQ ID NO: 31790 - protein, 92 aa, Oryza sativa
  misc_feature (34)..(34): Xaa can be any naturally occurring amino acid
  misc_feature (54)..(54): Xaa can be any naturally occurring amino acid
  misc_feature (60)..(60): Xaa can be any naturally occurring amino acid
  misc_feature (80)..(80): Xaa can be any naturally occurring amino acid
RVAVKGLVGRSISGRKLGVRQWPRGLCRTTRRPXAGVVVKYGEKSVYFELEEIXKTTGPXWTLYGYEAPSPDNPLHSKFXERFAGPFTKRGL

SEQ ID NO: 31791 - protein, 113 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIEL

SEQ ID NO: 31792 - protein, 449 aa, Thermoplasma volcanium GSS1
MMQEELNGIKIKVTPPGPEAKKIIELNDKYLARSTQSLPVVGKLGKGVYVEDVDGNVYLDFASGISVTNLGHLDPYVTQKVEEQLHKLWHFPGTDFYTEMQVLAAKSLIEVTPGKFNKKVFFTNSGTESVEAAIKIAKSYTHRERFIGFIGAFHGRTQGSLSFTASKPIHHKGFFPSMPGVEHVPFPNPYRNPFNIDGYEEPDELVNRVIDYIETYLLKTYVPPEDVAGILAEPIQGEGGYIVPPMNFFKELRKLADKYHIPLLIDEVQSGFGRTGKFFASEHFGVEPDVITLAKSIASGIPMGAAVMKEEMNFSENGLHSNTFGGNLIASAACVATIDEMKKLNAVENAAKQGAYMKKRLVELQNKYNEIGDVRGLGLMLAIDFVKDRRTKEPNSKLRNDVINNAFKNGLILLSTGSSAIRIIPPLIITQEQVDEGIEVLDKAIKMSK

SEQ ID NO: 31793 - protein, 735 aa, Saccharomyces cerevisiae
MSRRNPPGSRNGGGPTNASPFIKRDRMRRNFLRMRMGQNGSNSSSPGVPNGDNSRGSLVKKDDPEYAEEREKMLLQIGVEADAGRSNVKVKDEDPNEYNEFPLRAIPKEDLENMRTHLLKFQSKKKINPVTDFHLPVRLHRKDTRNLQFQLTRAEIVQRQKEISEYKKKAEQERSTPNSGGMNKSGTVSLNNTVKDGSQTPTVDSVTKDNTANGVNSSIPTVTGSSVPPASPTTVSAVESNGLSNGSTSAANGLDGNASTANLANGRPLVTKLEDAGPAEDPTKVGMVKYDGKEVTNEPEFEEGTMDPLADVAPDGGGRAKRGNLRRKTRQLKVLDENAKKLRFEEFYPWVMEDFDGYNTWVGSYEAGNSDSYVLLSVEDDGSFTMIPADKVYKFTARNKYATLTIDEAEKRMDKKSGEVPRWLMKHLDNIGTTTTRYDRTRRKLKAVADQQAMDEDDRDDNSEVELDYDEEFADDEEAPIIDGNEQENKESEQRIKKEMLQANAMGLRDEEAPSENEEDELFGEKKIDEDGERIKKALQKTELAALYSSDENEINPYLSESDIENKENESPVKKEEDSDTLSKSKRSSPKKQQKKATNAHVHKEPTLRVKSIKNCVIILKGDKKILKSFPEGEWNPQTTKAVDSSNNASNTVPSPIKQEEGLNSTVAEREETPAPTITEKDIIEAIGDGKVNIKEFGKFIRRKYPGAENKKLMFAIVKKLCRKVGNDHMELKKE

SEQ ID NO: 31794 - protein, 336 aa, Hypocrea ceramica
MVPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 31795 - protein, 338 aa, Hypocrea ceramica
MAPIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 31796 - protein, 195 aa, Zea mays
  misc_feature (55)..(55): Xaa can be any naturally occurring amino acid
LVCQDVIFVTLNCCYFRVVATAIAYFRRVYTRKSMSDYDPRLVAPTCLYLASKVXDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 31797 - protein, 748 aa, Yersinia pestis CO92
MLMRLREVVEKVAMATGLTEALELLVNETCLAMDTEVCSIYLADNDRRCYYLMATRGLKKPRGRTITLAFDEGIVGLVGRLAEPINLADAQSHPSFKYVPQVKEERYRAFLGVPIIYRRQLLGVLVVQQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQVLAARVLTAQMTTDVRHLTAAFMERRGLGGLIRGGK

SEQ ID NO: 31798 - protein, 114 aa, Clostridium perfringens ATCC 13124
MSDCIFCKIVAGEIPSKKIYEDDKVLAFHDISPEAPVHFLVIPKEHIASLNEVNEENAEVFAHIFKTINKLVNEQGIAEDGYRVVTNCGEQGGQTVGHIHFHVLGGRNLNWPPG

SEQ ID NO: 31799 - protein, 414 aa, Chondrus crispus
MAFVAPVATVRATTKSSVCQVQGRSTFAQFSGMKKVNQSSRLQPAQSGSAFGGYSDANDAFYTRVSGIVAATFGPTMKVRVAINGFGRIGRNFIRCWAGRSDSNMEVVCINDTSGVKTASHLLKYDSILGTFDADVSAGEDTISVNGKTIKIVSNRNPLQLPWKEMNIDIVVEATGVFVDAPGAGKHIEAGAKKVLITAPGKGDGIGTFVVGVNEKDYSHDKYDIVSNASCTTNCMAPFMKVLDDEFGVVRGMMTTTHSYTGDQRLLDAGHRDLRRARSAALNIVPTTTGAAKAVALVVPSLKGKLNGIALRVPTPNVSVCDVVMQVNKKTFKEEVNGALLKASEGAMKGIIKYSDEPLVSCDHRGTDESTIIDSSLTMVMGDDMIKVVAWYDNEWGYSQRVVDLGEVMARQWK

SEQ ID NO: 31800 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLASETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 31801 - protein, 338 aa, Dianthus caryophyllus
MAPIKIGINGFGRIGRLVARVILQREDCELVAVNDPFITTEYMTYMFKYDSVHGQWKHHDIKVKDEKTLLFGEKAVTVFGNRNPEEIPWGGTGADYVVESTGVFTDKDKAAAHLKGGAKKVIISAPSKDAPMFVVGVNEHEYKPELDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRIEKPATYEQVKAAIKEESEGKLKGILGYTEDDVVSTDFVGDNRSSIFDAKAGIALNDNFIKLVSWYDNEWGYSTRVVDLIAHIHKTCQ

SEQ ID NO: 31802 - protein, 338 aa, Pisum sativum
MGAKIKIGINGFGRIGRLVARVALKRDDVELVAVNDPFITTDYMTYMFKYDSVHGQWKNDELTVKDSNTLLFGQKPVTVFAHRNPEEIPWASTGADIIVESTGVFTDKDKAAAHLKGGAKKVIISAPSKDAPMFVVGVNENEYKPEFDIISNASCTTNCLAPLAKVINDRFGIVEGLMTTVHSITATQKTVDGPSSKDWRGGRAASFNIIPSSTGAAKAVGKVLPALNGKLTGMSFRVPTVDVSVVDLTVRLEKAATYDEIKAAIKEESEGKLKGILGYTEDDVVSTDFIGDTRSSIFDAKAGIALNDKFVKLVSWYDNELGYSTRVVDLIVHIAKQL

SEQ ID NO: 31803 - protein, 371 aa, Oceanospirillum sp. MED92
MAVEAIMSTYNRLSVAFERGEGSWLYDTDGNKYLDALCGIAVCGLGHSHPAVTHAICDQASNVIHTSNLYTIPNQQQLAERLTQISGMDNVFFGNSGAEANEAAIKLARRYGHAVKKVENPTIIVMENSFHGRTMATLSATGNRSAQAGFEPLVSGFVRAPYDDVDAIKAIAENNPNVVAILVEPIQGESGIQIPAPDYLNKLRDICDENEWLLMLDEVQSGNGRSGKYFAYQHNDILPDVVTTAKGLGNGVPIGACLARGTAAKILIAGTHGSTYGGNPLSCAAALAVVNTIMDENLCERATELGNKIVAGFEEQIGHADYVKEIRNKGLLIAIELTEAGTELAVLSKVKGILLNVTGGGKVVRMLPPLT

SEQ ID NO: 31804 - protein, 342 aa, Physcomitrella patens
MVGSAKIKVGINGFGRIGRLVARVALERDDIELVAINDPFITPEYMTYMFKYDSTHGQWKKTEVTLHSEGHLTFGGNPVAVYACRDPSEIPWGKHGADFVVESTGVFTDKDKAAAHLKGGAKKVVISAPSKDAPMFVMGVNENKYSDEDIVSNASCTTNCLAPLAKVINDKFGILEGLMTTVHATTATQKTVDGPSSKDWRGGRSAATNIIPSATGAAKAVGKVLPELNGKLTGMAFRVPTTDVSVVDLTVRLEKPASYDAIKTAIKEASEGQMKGILGYTEDDVVSTDFITDSRSSIFDAKAGIALSDTFVKLVAWYDNEWGYSNRVVDLIVHMAKQGTSQ

SEQ ID NO: 31805 - protein, 112 aa, Oceanospirillum sp. MED92
MSVIDTIKEQIDNNDILLYMKGTPRFPQCGFSSRASEAVMGCGERFAFVNILENPEIRAELPKYANWPTFPQLWVKGELIGGCDIICEMAANGELAELIKEASAGSEEQSAE

SEQ ID NO: 31806 - protein, 549 aa, Mycobacterium tuberculosis CDC1551
MQMTITVEPSVTTGPIAGSAKAYREIEAPGSGATLQVPFRRVHLSTGDHFDLYDTSGPYTDTDTVIDLTAGLPHRPGVVRDRGTQLQRARAGEITAEMAFIAAREDMSAELVRDEVARGRAVIPANHHHPESEPMIIGKAFAVKVNANIGNSAVTSSIAEEVDKMVWATRWGADTIMDLSTGKNIHETREWILRNSPVPVGTVPIYQALEKVKGDPTELTWEIYRDTVIEQCEQGVDYMTVHAGVLLRYVPLTAKRVTGIVSRGGSIMAAWCLAHHRESFLYTNFEELCDIFARYDVTFSLGDGLRPGSIADANDAAQFAELRTLGELTKIAKAHGAQVMIEGPGHIPMHKIVENVRLEEELCEEAPFYTLGPLATDIAPAYDHITSAIGAAIIAQAGTAMLCYVTPKEHLGLPDRKDVKDGVIAYKIAAHAADLAKGHPRAQERDDALSTARFEFRWNDQFALSLDPDTAREFHDETLPAEPAKTAHFCSMCGPKFCSMRITQDVREYAAEHGLETEADIEAVLAAGMAEKSREFAEHGNRVYLPITQ

SEQ ID NO: 31807 - protein, 440 aa, Bacillus anthracis str. Ames
MKQHPFKIASLGMQHMLAMYAGAIIVPLIVGGGLGLNQKELTYLVSIDLLMCGVATILQALSNRFFGIGLPVVLGCTFTAVGPMIAIGKQYGVSSIYGAIIAAGLFVVIFAKLFGKLVKLFPPVVTGSVVTVIGVTLVPAAINDMAGGVGSKDFGSLENLALAFGVLLFIIIMYRFFDGFIRSISILLGLLFGTIVAAFMGKVSLQAVGEADWFHGIQPFYFGTPTFELTPIITMILVACVGIVEATGVYFALSDICNKKIGEKELTKGYRAEGLAMVLGGIFNAFPYTTYSQNVGLVQLTGVRNRVIIYTCGGMLIALGFIPKIAAITTIIPKSVLGGAMLAMFGMVMAYGIKMLSSVDFGRQENLLIVACSVGIGLGVTVVPTLFSQLPESIRILTDNGIVLGSASAVLLNIVFNMVPQRKVKVKDEPVPMQSAVREA

SEQ ID NO: 31808 - protein, 287 aa, Raphanus sativus
EFMNEVRLIARLQHINLVRILGCCIDADERMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWVLGSEATAIPQPKPPVYCLIPSFYANNPSSSRPSDDDESWTMNEYTCSVIDAR

SEQ ID NO: 31809 - protein, 454 aa, Rhodococcus sp. RHA1
MTDSTSTLGRGLKVRHLTMMGLGSAIGAGLFLGTGVGIATAGPAVLVSYLLAGIIVVFVMRMLGEMGAAIPASGSFSHYARIGIGEWAGFVMGWLYWFMLIMVLGAEITGASGIVSGWLPGVPQWVVALVFVIFFAAVNLAKVSNFGEFEFWFAAIKVTVIIAFLVIGVLLVFGLLPDTEPVGTTNLFGHGGFMPEGFAGVAAGLLVVAFAFGGIEIVTIAAAESEDPERSIAVAMRSVVWRISVFYLGSISIMVLVLPWDSSDLKSGPFVAVLNQAHIPYVAGFMELVVVVALLSAFNANIYGTSRMAYSLSRRGDGPAFMARISNSGVPLNAVLLSVFFGFVSVLLNWWLPDDLLGLLLNAVGSALLVIWIFIVVSHLRLRPRLEREGKLTVRMWLFPWLSYLTLAMLGGFVVLMLFDSDARTQLISTCVLFLVIAALGVLNTRLRQRSQTV

SEQ ID NO: 31810 - protein, 290 aa, Raphanus sativus
EFMNEVTLIARLQHINLVQILGCCIDADEKMLIYEYLENLSLDSYLFGKTRSSKLNWKERFDITNGIARGLLYLHQDSRFRIIHRDLKVSNILLDKNMIPKISDFGMARIFARDETEANTKRVVGTYGYMSPEYAMKGIFSEKSDVFSFGVIVLEIVTGKRNIAFNNLNYENNLLGYAWSNWKEGKALEIVDPDIVDSLSPLSSTFQPEEVLKCIQIGLVCVQELAEHRPTMSSVVWMLGSEAAEIPQPKPPGYWVRRSSYEIDPSSSRQCDDDDSWTVNQYTCSVIDAR

SEQ ID NO: 31811 - protein, 117 aa, Vibrio fischeri ES114
MSNIIKALEDEQLKQDLPKFAPGDTVVVQVKVKEGDRERLQAFEGVVIAIRNRGLHSAFTVRKISNGEGVERTFQTHSPVVNSIEVKRRGAVRRAKLYYLRERSGKSARIKEKLAKK

SEQ ID NO: 31812 - protein, 101 aa, Zea mays
  misc_feature (34)..(34): Xaa can be any naturally occurring amino acid
NVVRKKLQLAGVTAMLLACKYEEVSVPVVEDLIXICDRAYTRADILEMERRIVNTLNFNMSVPTPYCFMRRFLKAAQSEKKLELLSFFMIELSLVEYEMLQ

SEQ ID NO: 31813 - protein, 453 aa, Frankia sp. EAN1pec
MKGVFVGLTTLDSVYLVDRLPGADEKCVARDFAMNAGGPATNAAVTFAYLGGRACLVSAIGTSPAAALVHADLARYGVRHIELVPEQSGDGAAGPYGALAAQGVAGPAGQHGPPGKPTGLRSGGTRSGYGPAGPLTGYPHVRGRGGPGLPGGATHSPAGAVKPAGHVHGPVGGAHGGGHGGHGSGPGGGHGGPGGHGAIGGHGGHGGIGGHGVAGGAGLGGAGVLGGMAGLAGAVQTGPNTAAAGHLAGQSAMSYALPMSAVMVTSQTGERAVTSTHGMVPRCTANTSAAAAVADADVVVLDGHQVDAAIGLLRTLRGSGPPVLLDGGSWKPGTEQILPFVDVVICSTAFRPPGFDPGADILGLLLRYGPFFVAVTDGPGPIRWATAERRGHVLPPVVAARDTLGAGDVFHGAFAWMMAHGALATDELVGALGEASRVAARSVQTFGPRSWMT

SEQ ID NO: 31814 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 31815 - protein, 109 aa, Zea mays
FLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLV

SEQ ID NO: 31816 - protein, 161 aa, Trema tomentosa
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSPEMKNAWGEAYDQLVAAIKSEMKPSST

SEQ ID NO: 31817 - protein, 115 aa, Zea mays
LLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLV

SEQ ID NO: 31818 - protein, 181 aa, Oryza sativa
  misc_feature (125)..(125): Xaa can be any naturally occurring amino acid
MLPSRQRSIFHLGEEGGGAADAEHLGADHGDGHGDHGIISIHQQRLRVVGLQIVLAQTRHHHRQQHGHVVLKQMQMVSPPPAARHRRRRRPCGDFLSACSLCRRELGPDKDVYMYRGEQGFCTRXEECRWQQIMTDEARERDAMAKKERLGLHHRTPRPPPAAMRGVLRRKGTKLAVPGPA

SEQ ID NO: 31819 - protein, 340 aa, Pinus sylvestris
MGSTGKIKIGINGFGRIGRLVARVALTRDDIELVGVNDPFISTDYMSYMFKYDSVHGKWKHHEVNVKDSKTLLFGEKSVAVFGCRNPEEIPWGEVGAEYVVESTGVFTDKEKASAHLKAGAKKVVISAPSKDAPMFVVGVNEHQYKSDVNIVSNASCTTNCLAPLAKVINDKFGIVEGLMTTVHSITATQKTVDGPSNKDWRGGRGAGFNIIPSSTGAAKAVGKVLPALNGKLTGMAFRVPTPDVSVVDLTVRLEKSATYDEIKAAIKAESEGNLKGILGYTEDAVVSTDFIGDSRSSIFDAQAGIALSDNFVKLVSWYDNEWGYSSRVVDLIVHMAATQ

SEQ ID NO: 31820 - protein, 360 aa, Atriplex nummularia
MAKVKIGINGFGRIGRLVARVILQSDDCELVAINDPFITTDYMTYMFKYDSVHGQWKHHELKVKDEKTLLFGERPVTVFGNRNPEEIPWGQTGADYVVESTGVFTDKDKAAAHLKGGAKKVIISAPSKDAPMFVVGVNEHEYKSELNIVSNASCTTNCLAPLAKVINDKFGIVEGLMTTVHSITATQKTVDGPSAKDWRGGRAASFNIIPSSTGAAKAVGKVLPALNGKLTGMSFRVPTVDVSVVDLTVRLEKEATYEQIKAAIKEESEGKMKGILGYTEDDVVSTDFVGDNRSSIFDAKAGICLNGNFVKLVSWYDNEWGYSSRVVDLIRHMSKTTSKLDSVALACVDAVSTLILSSEC

SEQ ID NO: 31821 - protein, 338 aa, Glomerella cingulata
MAPIKVGINGFGRIGRIVFRNAIEHPEVEIVAVNDPFIETKYAAYMLKYDSTHGIFNGEIKQEGNDLVINGKTVKFYTERDPAAIPWKETGADYVVESTGVFTTTDKAKAHLQGGAKKVIISAPSADAPMYVMVVNEKSYDGSADVISNASCTTNCLAPLAKVINDKFGIVEGLMTTVHSYTATQKTVHGPSAKDWRGGRTAAQNIIPSSTGAAKAVGKVIPELNGKLTDMSMRVPTTNVSVVDLTARIEKGASYDEIKQAIKEAAEGPLKGVLAYTEDDVVSTDMIGNPNSSIFDAKAGISLNNNFVKLVSWYDNEWGYSRRVLDLLAHVAKVDASK

SEQ ID NO: 31822 - protein, 569 aa, Clarkia lewisii
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDSVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSISILLPTLDAYRIGQLLAIYEHRVAVQGFVWGINSFDQWGVELGKSLATQVRKQLHGSRVKGEPVEEGFNFSTKTLLTRYLQATSDVPADPSTLLPNI

SEQ ID NO: 31823 - protein, 317 aa, Clarkia lewisii
LVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPAQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATTDVPADPSTLLPNI

SEQ ID NO: 31824 - protein, 353 aa, Zea mays
MADESWRVPTPVQELAAGVVEPPTQFVLQEQDRPGSGTLLFATDMPEPIPVVDLSRLAAADEASKLRSALETWGLFLVTKHGIEASLMDDVMAASRDFFYQPLEAKQEYSNLIGGKRFQMEGYGNDMVKSKDQILDWQDRLQLRVEPQDERNLAYWPKHPDSFRDLLEKYASKTKIVRNKVLRAMGKTLELGEDYFISQIGDRASAIARFNYYPPCPRPDLVFGIKPHSDGGAVTILLVDKDVGGLQVQKDGVWYTVPSMPHTLLVNLGDSMEIMNNGIFKSPVHRVVTNAEKERLSLAMFYGVEGQRVLEPALGLLGEERPARYRKIMASDYIIGLRQGIAEGQRFIETLKI

SEQ ID NO: 31825 - protein, 371 aa, Nocardia farcinica IFM 10152
MPESPYLVIHPERVRDNYRALAAAVSGRGLRGTRIRYAVKASPVPELIRLLDTEGAEFDVASIGEIDLCRAQGVAPHKLCYGNTVKKAADIARAHAVGVRRFAFDTEDDLLRIAEHAPGAQVECRFLASAPQSRTPFGTKFGCAPQEAARLLVRARDLGLEVAGPYFHVGSQQLDPDAWRIGIEQAGHIANALSDKEIPVTSVNIGGGLPIAYADAAPALDRIAAVIEEAAARHLPPTATLVVEPGRALVGNAGTIHAEVVAVRIAPDGRRWVYLDIGRYNGMAETENEYIAYRFVTERDGDPVDEAVVAGPTCDGDDVLYQRTRVLLPTTLRAGDRVQILDTGAYTASYSSVSFNGFPPLTVHVSGAERE

SEQ ID NO: 31826 - protein, 287 aa, Raphanus sativus
EFMNEVRLIARLQHINLVRILGCCIDPDEKILIYEYLENSSLDYFLFGKKRSSNLNWKDRFAITNGVARGLVYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWMLGSEATAIPQPKPPVYCLIPSFYANNPSSSRPSDDDKSWTMNEYTCSVIDAR

SEQ ID NO: 31827 - protein, 290 aa, Raphanus sativus
EFMNEVTLIARLQHINLVQVLGCCIDGDEKMLIYEYLENLSLDSFLFGKTRSSKLSWKERFDITNGVARGLLYLHQDSRFRIIHRDLKVSNILLDKNMIPKISDFGMARIFERDETEASTMKVVGTYGYMSPEYAMNGIFSEKSDVFSFGVIVLEIVTGQRNRGFYNLNYKNNFLSYAWSNWKEGRALEIVDPVIIDSLSPLSSTSQPKEVLKSIKIGLLCVQEHAEDRPTMSTVVWMLGSEETEIPQPNPPGYCVRRSPHELDPSASRQLDDDESWTVNQYTCSVIDAR

SEQ ID NO: 31828 - protein, 207 aa, Lilium longiflorum
MSSRPRGRGRGWGRRPQRRSRRTPSRRRQAKLFVGNIPYDDSEKLANLFDKAGVVEVAEVIYNRETDQSRGFGFVTMSTVEEAERAVEMLHRYDINGRNLTVNKAAPRGSRPERPRESDPSLRVYVGNLPWQVDDSRLEQLFSEHGKVIDARVVYDRQSGRSRGFGFVTLATREEVDDAIAALDGQSLEGRALRVNVAEERPRRSSF

SEQ ID NO: 31829 - protein, 389 aa, Legionella pneumophila str. Paris
MSLITSYSPMPVTFTHGEGVWLYDEQGKKYLDGLSGIAVCGLGHAHPDVTRTIQEQAARLIHTSNVFHIKEQELLAAKLTSMARMEQVFFANSGAEANEAAIKLTRLFGHKKGIETPSIIVMEKAFHGRTMATLTASGSRKVQAGFEPLVPGFIRAPFNDLDAIHTIAANREDVVAVMVEPIQGEGGIYPAEEGYLRALANLCEQNDWMLILDEIQTGNGRTGKLYSCMHYDIQPDILTTAKGLGNGMPIGACLMSKRAKDLFKPGNHGSTFGGNPLACATALTVLEVIERDKLCEHVTKNSALLMDKLISNLGEHPHVKAIRGKGYMIGIELDRPANDMRVLGLENQVLFNITAETVVRLLPPLIISEDEIDELVNRITRTINQFTNQ

SEQ ID NO: 31830 - protein, 287 aa, Raphanus sativus
EFMNEVRLIARLQHINLVRILGCCIDADEKMLIYEYLENSSLDYLLFGKKRSSNLNWKDRFAITNGVARGLLYLHQDSRFRIIHRDMKAGNILLDKNMIPKISDFGLARIIARDQTEASTDNPIGTYGYMSPEYAMYGVLSEKTDVFSFGVIVLEIVTGKRNRGFYQSNPENNLICYAWTHWAQGRALEIVDPVIVDSLSSTFQPKEVLKCIQIGLLCIQERAVHRPTMSSVVWMLGSEATAIPQPKPPVYCLIPSFYANHPSSSRQSNDDESWTMNEYTCSVIDAR

SEQ ID NO: 31831 - protein, 116 aa, Anabaena variabilis ATCC 29413
MNQNLLWFEKLKFNNQDLIPAIAQDYRDGTVLMMAWMNSESIQKTLSTGEAHYWSRSRSQLWHKGATSGHIQKVKELFYDCDGDTILLKVEQIGDIACHTGARSCFFNAVPIYPQS

SEQ ID NO: 31832 - protein, 133 aa, Zea mays
  misc_feature (68)..(68): Xaa can be any naturally occurring amino acid
FIKHCFFSTYGAFASTSDHGAGGCCLHQQLPESMIELISQDNPLPEKGKLLQAVMKAGPLLQTLILAXPLAQWRHPPPPVESFEIAPVTILLPPPHQQLRQESFITFNLWRVSGRRVFFEGTDSSTQNKVHRI

SEQ ID NO: 31833 - protein, 556 aa, Legionella pneumophila str. Paris
MATKVTKRGMDLLRDPILNKGTAFSLQERDEFALHGLIPTTVETLEQQVIRCLDAYSAKEEPLEKHIYLRALQDRNEVLFYRFIIDNLVDILPIIYTPVVGQACEMFSHIYRQPRGVFLSYPERDKLDSIIQNIASTRSIKVIVVTDGERILGLGDQGAGGLGIPIGKLSLYTSCGGIHPSNTLPIILDVGTNNKERLDDPEYIGWRHARISGKDYDDFVDQFVQSIKRHMPHVLLQFEDFAQQHAYPLLERYKDQLCTFNDDIQGTASVAVAAILAATRVTNTPLKEHRVALLGAGSAGCGISEQLVHAMMNQGLSEEEARSRFYLVDRYGLLHDEMTDLLPFQKGFVRSSTSLQNWKLEKQGEITLTDVINNAQPTILLGVSGQPNQFKEAMIKTMLSYCERPIIFPLSNPTSRAEAIPQDLLNWTAGKALIATGSPFEPVAINGHKIEIAQCNNSYIFPGVGLGVVAGQAKRVTDLMMMAAAVALSELAPAIRTGEGRLLPELNSIREVSQHIARAVILQGIKEGHIGPMNDNEIDDSIKRTMWTPQYEPYVL

SEQ ID NO: 31834 - protein, 290 aa, Raphanus sativus
EFMNEVRLIARLQHINLVRILGCCIDADEKILIYEYLENSSLDSHLFGEKRSSKLNWKDRFDITNGVARGLLYLHQDSRLRIIHRDVKVSNILLDKSMIPKISDFGMAIIFAREETEANTRNVVGTYGYMSPEYALDGVFSEKSDVFSFGVIVLEIVSGKRSRGFYSLNHENNLLSYAWSHWTEGKALEIVDPVITDSLSSLPSTFQPKEVLKCIQIGLLCVQERAEHRPTMSSVVWMLGSEATEIPQPNPPGYYVGRCPYENNPSSRRLCDDYESWTVNQYTCSVIDAR

SEQ ID NO: 31835 - protein, 290 aa, Raphanus sativus
EFMNEVTLIARLQHINLVQVLGCCIEADEKMLIYEYLENLSLDSYLFGETRSSKLNWKERFDIINGVARGLLYLHQDSRFRIIHRDLKASNILLDKNMIPKISDFGMARIFERDETEAKTRKVVGTYGYMSPEYVMDGIFSEKSDVFSFGVIVLEIVSGKKNRGFYNMSNENNLLSYVWSHWKEGRALEIVDPVILDSLLSLPSTYQPQEVLHCIQIGLLCVQEHAENRPMMSSVVWMLGSEATEIPQPKPPGYCVIRSPYELDPSSSKKCDDNESWTVNQYTCSVIDAR

SEQ ID NO: 31836 - protein, 388 aa, Schizosaccharomyces pombe 972h-
MESVFGRVRNETSERGKYGLVSVKAGKLQRKPGTNILQADHRKGVIYMQMASDELLHFYWKERARVSREVEDDYIIFPEEAEFIKIDECTTGRVYALKFKSSSQIHFYWMQEYSDEKDKETASLINQLIADPVNTTRTINSHNNSSSRGTDDSSTSQLLQLFGAASQDALQDFNWEVLSPTAEAPAILPRFPNVNESANMYRASSESNLNGPHATAGENGEDHEEATASPLDENIDYTHSRTLELLEQLQPLILNETTFVEPFSIDRESHRVITHPRVYPKIFPHSPSDLLRISGRAELSENRDFFKHLSSLMEAVAKPESESLREICNLSLEQVQSASGAELFLHALYDRLVNEGVIVISHITQEGSDGEVEEEGDVEMRESNEKDE

SEQ ID NO: 31837 - protein, 404 aa, Rhodococcus sp. RHA1
MRSQPHVLGIVLAGGEGKRLYPLTADRAKPAVPFGGAYRLIDFVLSNLVNAGYLRLCVLTQYKSHSLDRHISQTWRLSGFAGEYITPVPAQQRLGPRWYTGSADAILQSLNLVYDEDPEYIVVFGADHVYRMDPEQMVQHHIESGAGVTVAGIRVPRSEAFAFGCIDSDESGRIVQFLEKPAHPPGTPDDPNMTFASMGNYVFTTKVLVDAIRADSENSDSDHDMGGDIIPALVEAGEASVYDFKDNIVPGATDRDRGYWRDVGTLDAFYDAHMDLVSVHPIFNLYNRRWPIRGETENLAPAKFVQGGLAQESVVGAGCILSAATVRNSVLSSNVMVDSGATVEGSVLMPGVRIGKGAVVRRAILDKNVVVGDGEIIGVDLERDKQRFAVSNGGVVAIGKGVWI

SEQ ID NO: 31838 - protein, 711 aa, Legionella pneumophila subsp. pneumophila str. Philadelphia 1
MKISAIKTWLPLLIIIVLLGLFLGLGLNKYVSFASLRDNHEWLIAITKSHFYLVSFVFIIIYTVAVALSIPGAIFLTLIGGFLFGILWGTFLVVLSATLGATILFFAVQSSLGEVFSKRASGWVKRMRSGFKDNAFSYLLTLRLIPLFPFWVINIVSAVLGVSASTFIIATFIGIIPGSIVYVSVGNGLGELFAASLQPNLGIIFEPKFILPLLGLAALSLIPVFYKKKGKQGTEKMKDKDLFCDLAIIGGGSAGLSIAAGCSQLGLQVVLVEPNKMGGDCLNYGCIPSKTLLNTAKIFYQTKHSTVLGIQAKSVKIDFLQVMQQVHNVIACIAKNDSVERFTSLGVQVIQEAGHFIGPKQFKLKRKIIRAKHFVIATGSSPAIPPIQNLNKVSYLTNETIFNLKVQPEHLIVIGGGPIGCELAQAFAMLGSKVTILEAFTILPKDDADCVAIIRSQLESMQIALYEQIKINKIEESADKTISVHLENQDNPITITGSHLLVSTGRVANVDGLGLEKAGVQYTTRGINTNARLQTTNKKIYAIGDVTGPYQFTHMASYQAGIALRNIAFKWPAKVDYKAVPWVTYTEPELAHVGLLASEALKDPTLKITEFAFAEVDRAQAENKVNGKIKIITGKKAKILGVSIVGAHAGELILPWVIAVKERKSLRTFTDAIAAYPTFSEISKRVAGEYYKPFIFSSKIRTFVRWLNKLG

SEQ ID NO: 31839 - protein, 144 aa, Chenopodium rubrum
MGSKIFLLLGLSIAFAILISSEVAARELAETAAKTEGYNNGGGYHNGGGGYNNGGGYHNGGGGYNNGGGYHNGGGGYNNGGGYHNGGGGYNNGGGHHNGGGGYNNGGGYHGGGGSCYHYCHGRCCSAAEAKALEATTAQVKPQN

SEQ ID NO: 31840 - protein, 406 aa, Streptomyces coelicolor A3(2)
MTQHTDVVVIGGGQAGLAAGYHLRRQGLDFVVLDARATPGGAWRHAWDSLHLFSPAAFSSLPGRLMPAQPGEEYPEAGHVVAYLSDYEKRYGLPVRRPVQVTGVHDEGRLLRVETDSGTWHARAVISATGTWWRPFLPAVPGRGDFAGRQLHTVSYRGPQDFAGRRVIVVGGGNSGAQIAADLAYDTELTWVTRRPPRYLADDIDGRALFDAATALPHSRLRSSGGTPIAPSTPAAPAPQASHRWATSSPYRRCARPGTPGGSRRPRCSSAWTATVPSGPTARGRRSTRSSGAPASARRSRTWRPSACAAGAGTSPRWARRPRTSHACTSSATATGPAPPPPPSSASGVRPATRPALSPNSSTRQGDPRAIGRKGADTGMTTGPAGAGYRTVSSCPIAASTDGSTR

SEQ ID NO: 31841 - protein, 946 aa, Saccharomyces cerevisiae
MAGQVLDGKACAQQFRSNIANEIKSIQGHVPGFAPNLAIIQVGNRPDSATYVRMKRKAAEEAGIVANFIHLDESATEFEVLRYVDQLNEDPHTHGIIVQLPLPAHLDEDRITSRVLAEKDVDGFGPTNIGELNKKNGHPFFLPCTPKGIIELLHKANVTIEGSRSVVIGRSDIVGSPVAELLKSLNSTVTITHSKTRDIASYLHDADIVVVAIGQPEFVKGEWFKPRDGTSSDKKTVVIDVGTNYVADPSKKSGFKCVGDVEFNEAIKYVHLITPVPGGVGPMTVAMLMQNTLIAAKRQMEESSKPLQIPPLPLKLLTPVPSDIDISRAQQPKLINQLAQELGIYSHELELYGHYKAKISPKVIERLQTRQNGKYILVSGITPTPLGEGKSTTTMGLVQALTAHLGKPAIANVRQPSLGPTLGVKGGAAGGGYSQVIPMDEFNLHLTGDIHAIGAANNLLAAAIDTRMFHETTQKNDATFYNRLVPRKNGKRKFTPSMQRRLNRLGIQKTNPDDLTPEEINKFARLNIDPDTITIKRVVDINDRMLRQITIGQAPTEKNHTRVTGFDITVASELMAILALSKDLRDMKERIGRVVVAADVNRSPVTVEDVGCTGALTALLRDAIKPNLMQTLEGTPVLVHAGPFANISIGASSVIADRVALKLVGTEPEAKTEAGYVVTEAGFDFTMGGERFFNIKCRSSGLTPNAVVLVATVRALKSHGGAPDVKPGQPLPSAYTEENIEFVEKGAANMCKQIANIKQFGVPVVVAINKFETDTEGEIAAIRKAALEAGAFEAVTSNHWAEGGKGAIDLAKAVIEASNQPVDFHFLYDVNSSVEDKLTTIVQKMYGGAAIDILPEAQRKIDMYKEQGFGNLPICIAKTQYSLSHDATLKGVPTGFTFPIRDVRLSNGAGYLYALAAEIQTIPGLATYAGYMAVEVDDDGEIDGLF

SEQ ID NO: 31842 - protein, 290 aa, Saccharomyces cerevisiae
MCDKSKTVLDYTIEFLDKYIPEWFETGNKCPLFIFFSGPQGSGKSFTSIQIYNHLMEKYGGEKSIGYASIDDFYLTHEDQLKLNEQFKNNKLLQGRGLPGTHDMKLLQEVLNTIFNNNEHPDQDTVVLPKYDKSQFKGEGDRCPTGQKIKLPVDIFILEGWFLGFNPILQGIENNDLLTGDMVDVNAKLFFYSDLLWRNPEIKSLGIVFTTDNINNVYGWRLQQEHELISKVGKGMTDEQVHAFVDRYMPSYKLYLNDFVRSESLGSIATLTLGIDSNRNVYSTKTRCIE

SEQ ID NO: 31843 - protein, 319 aa, Yersinia pseudotuberculosis IP 32953
MSKIVSLGIHVLDVLGRHVNRFPPGGELDIINEIRLTVAGTAAGMSVDLAKLGGDVYAMGAVGLDESGNFIIDTLRRYGVNTDHIVRKSEVQTSCSMLPIRPNGERPVLHVLGANAAYRLEDIHWDVIASADILHFGGTYLLPGLDGPPTATILKFAKEHGVTTTLDLLVNAQPDLLAKLEPALPYIDYFMPGLDEARAICGLDKRADVIAFFLNRGVGHTVFKMGAEGSSIASLDMAEVLIPAYKAQVVDSTGCGDSYCAAFIMGLTKGWDLATSGRFASAAASLVVSGLGSDAGIIDFEHTLKVMNTAETLPIAQET

SEQ ID NO: 31844 - protein, 180 aa, Marinobacter sp. ELB17
MDYFSQSIKQAIRTVPDWPKPGVTFRDITTVLQNKTAFRKLIDAFVHRYHDQHIDAIAAVDARGFIIGSALAYELNASLVLIRKKGKLPFDTLVEDYELEYGTASVELHKDALKPGDKVVLVDDLIATGGTMLAASRLIRRIGAEIVEVAAMIDLPDLGGSDKLRAEGLTVYTVCSFEGE

SEQ ID NO: 31845 - protein, 104 aa, Saccharomyces cerevisiae
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 31846 - protein, 344 aa, Oceanospirillum sp. MED92
MKAHKISQAPIPMRSVGPIKITGPVLEEKISVPLATYETPLWPSVGRGARVSALTDGIKATVVDERMSRSILLEADDAEAAMLALSSIKSRMSDINAVVAESSRFAKLIDMHSQIVANLIYLRLEFTTGDASGHNMVTNAADKIIPWVLSEYPQLRYSSISGNYCSDKKATAVNGILGRGKYVVTEILIPRDVCERRLKTTPEKVVDLNIKKNLIGTMVAGGLRSANAHYANMLLAFYLATGQDAANIIEGSQGIVHAEVRDGDLYFSCTIPNLIMGSVGNGKGIDFVEENLAQLGCKEDREPGANARRLAAICAATVLCGELSLLAAQTNPGELMEAHLKLER

SEQ ID NO: 31847 - protein, 321 aa, Magnaporthe grisea 70-15
MAFTPRGRGAPRGGGGFRGGDRGGRGGGGRGGGSFRGGDRGGRGGGRGGPRGGRGGPARGGRGGGRGGKPGAAGGKKVIVEPHRHKGVFVARGGKEDLLATINLVPGESVYGEKRIAVENSNKGDDDTPATKTEYRIWNPFRSKLAAGILGGMDNIFMKPGAKVLYLGAASGTSVSHVADLVGPTGNVYAVEFSHRSGRDLINMATKRTNVIPIVEDARHPLKYRMVVPMVDCIFADVAQPDQARIVALNASLFLKKGGGTCISIKANCIDSTAPAEEVFASEVEKLRAEKFFPKEQLTLEPYERDHAMVTAVYQQREFIE

SEQ ID NO: 31848 - protein, 325 aa, Medicago truncatula
MPATAGRVRMPANNRVHSSAALQTHGIWQSAIGYDPYAPNKDDKDASQSQPNAGPDADNAYASFQGLLQLAKITNSEVDVSRGACKKCGRVGHLKFQCKNNVKIKDDKEEKDFDAMQSLGLVRMDKLKGKAEKVDKGSNVESSEEEEDDSESSDSEIDSEIERAIVKRSGKKVSEKRGSYRKKDDSDDDESDKDSDRKRKKRGREKKRSVKTKRDASASDDSVERRRRKKKREHRRSRRDKSPDDSDEYRHKKRKSRKEKRRRRSRVSDSDSETSEDSTSRHKRKSKRTSSSTDSDSGDGYNGSRKGRDTKKSEKRKRRHHGDDD

SEQ ID NO: 31849 - protein, 347 aa, Brassica oleracea
MGRKKLELSERHSVAMAASLQSAATFFQSAKISTAPSRGSAHLRSAQTVGKSFGLETSSARLTCSYQSDIKDFAGKCSDAVKIAGFALATSALVVSGASAEGAPKRLTYDEIQSKTYMEVKGTGTANQCPTIDGGSETFSFKPGKYAGKKFCFEPTSFTVKAESVSKNAPPEFQNTKLMTRLTCTLDEIEGPFEVSSDGSVNFKEEDGIDYAAVTVQLPGGERVPFLFTVKQLDASGKPDNFTGKFLVPSYRGPSFLDPKGRGGSTGYDNAVALPAGGRGDEEELSKENVKNTAASVGEITLKVTKSKPETGEVIGVFQSLQPSDTDLGAKVPKDVKIQGVWYGQLE

SEQ ID NO: 31850 - protein, 314 aa, Oryza sativa (japonica cultivar-group)
MRAGDMPGRGARRRPDLTLPMPQRDAPTSLAVPLPLPPLEELERVRRVGSGAGGTVWMVRHRGTGKEYALKVLYGNHDDAVRRQIAREIAILRTAEHPAVVRCHDMYERGGELQILLEYMDGGSLDGRRIADERFLADVARQVLSGIAYLHRRHIVHRDIKPSNLLIDSARRVKIADFGVGRILNQTMDPCNSSVGTIAYMSPERINTDLNDGAYDGYAGDIWSFGLSILEFYMGKFPFGENLGKQGDWAALMCAICYSDPPEPPAAVSPEFRSFVGYCLQKNPAKRPSAAQLMQHPFVAGPQPQPLAAPPPSS

SEQ ID NO: 31851 - protein, 499 aa, Oryza sativa (japonica cultivar-group)
MENSQVWLLWGALSVAVLFYLSTLRRRYAGGKPLPPGPTPLPLIGNLHLAGGTFHHKLRDLARVHGPVMTLKLGLATNVVISSREAAIEAYTKYDRHLAARATPDTFRACGFADRSMVFIPSSDPQWKALRGIQGSHVFTPRGLAAVRPIRERKVGDLIAYLRAHAGEEVLLGQAMYTGLLNLVSFSYFSIDIVDMGSQMARDLREVVDDIISVVGKPNISDFYPFLRPLDLQGLRRWTTKRFNRVFSIMGDIIDRRLAHIRDGKPRHDDFLDSLLELMATGKMERVNVVNMLFEAFVAGVDTMALTLEWVMAELLHNPAIMARVRAELSDVLGGKEAVEEADAARLPYLQAVLKEAMRLHPVGALLLPHFAAEDGVEIGGYAVPRGSTVLFNAWAIMRDPAAWERPDEFVPERFLGRSPPLDFRGKDVEFMPFGSGRRLCPGLPLAERVVPFILASMLHTFEWKLPGGMTAEDVDVSEKFKSANVLAVPLKAVPVLIK

SEQ ID NO: 31852 - protein, 289 aa, Raphanus sativus
EFMNEVRLIARLQHVNLVRVLGCCIDADEKMLIYEYLENLSLDSYLFGKKRSFKLNWKDRFAITSGVARGLLYLHQDSRFRVIHRDMKVSNILLDKNMIPKISDFGMARIFAREETEANTSKVVGTYGYMSPEYALNGVFSEKSDVFSFGVIVLEIVSGRRSRGFYHLDHENNLLSYAWSHWTGGSALEIVDPVIVDSLSSLPSTFQPEEVLKCIQIGLLCVQERAEHRPTMSSVVWMLGSEATEIPRPNPPGYYVGRSPYENNPSSSGPGDDESWTVNQYTCSVIDAR

SEQ ID NO: 31853 - protein, 407 aa, Nocardia farcinica IFM 10152
MNALWHGFADMGAVARDGAFVVARGAGAYVYDEAGNRYLDATAGLWFTNVGHGRAEIADAVAAQLRRIAHYSNFGDIAEPPTRELAERLSAIAPIPGSKIFFTSGGSDSVDTAAKFARRYWHEVGRPGKTIVVGRQRAYHGMHVAGTALSGLPPNRDGYGELMPDARTVDWDDPKGLLALIEEVGAERIAAFFCEPIIGAGGVYLPPEGYLTEVRAICADHDILFVADEVVTGFGRIGGSWFASSRFDLRPDLMTTAKGLTSGYLPMGAVFIAPHLAEPFFAGGVWWRHGYTYGGHAASAAAALANLDILERENLLAEATRLEATLHAELAPLAQHPRVAEVRSGLGAVAAVQLADPAEAPAFVKALRAEGVSSRAAGQGALQISPAFVMTDEQVRELAAAFARALG

SEQ ID NO: 31854 - protein, 347 aa, Oryza sativa (indica cultivar-group)
MELSLITFTATGAAAAFTSPKIKRRMRMAPTMASKPGAKVKVSAGCKTCRGKGAVECPGCKGTGRNKKNGNIFERWKCFDCQGFGLKSCPSCGKEGLTPEQRGETRCILPCKSAQKEYTRKCLNFVGKASPPPESTVLHVDHLSRNVNEDHLKEIFENYGEVVNVELSMDRVVNLPRGYGYVEFKNRADAEKALLYLDGGQIDGNVVKVRFALPPQQQRAAASPKALHPSPKRDVVDHNKVGPSAEKATKQQPRKLTLPSILFATLILNHNQSLYFYWVQHLLKESQLHLQEGDLLQVEELNHLGVGLILLQFAVEQLPLQSGVVELLAGDQDPQSEGAHPLRPLED

SEQ ID NO: 31855 - protein, 287 aa, Raphanus sativus
EFMNEVRLIARLQHINLVRILGCCIDADEKMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQESAEHRPTMSSVVWMLGSEATAIPQPKPPVYCLIPSFYANNPSSSRPSDDDESWTMNEYTCSVIDAR

SEQ ID NO: 31856 - protein, 159 aa, Zea mays
MSRFGRSGPPPIRDTYSLLVLNITFRTTADDLFPLFDKYGEVVDIYIPRDRRTGDSRGFAFVRYKYEDEAQKAVDRLDGRLVDGREMMVQFAKYGPNAERIQKGRIMETVPKPRGRSRSRSPRRGYRDDHRGRDSRRRSRSRSGDRYGRDRYRERDHHR

SEQ ID NO: 31857 - protein, 290 aa, Raphanus sativus
EFMNEVTLISRLQHINLVQVLGCCIEGDEKMLIYEYLENLSLDSYLFGKTGKSKLSWKERFDITNGIARGLLYLHQDSRFRIIHRDLKVSNILLDKNMIPKISDFGMARIFARDETEANTMKVVGTYGYMSPEYVMHGTFSEKSDVFSFGVIVLEIVTGKRNRGFNNLDNENNLLSYAWVNWKEARALEIVDPVIVDSLSPLSSTSQPQEVIKCIQVGLLCVQELAEHRPTMSSVVWMLGSEATDIPQPKPPGYCVRRTPYELDPSSSRQYNDDESVTVNQYTCSVIDAR

SEQ ID NO: 31858 - protein, 292 aa, Pseudomonas fluorescens Pf-5
MIAGSMVALVTPMDAQGNLDWDSLSKLVDFHLQEGTNAIVAVGTTGESATLDVNEHIEVIRRVVTQVAGRIPVIAGTGANSTREAIELTTNAKIAGADACLLVTPYYNKPTQEGLYQHFRAIAEAVDIPQILYNVPGRTACDMQAETVIRLSSVKNIIGIKEATGDLQRAKAILAGVPGDFLVYSGDDATAVELILLGGKGNISVTANVAPRAMSQMCAAAMAGDAAKAREIHETLMPLNKTLFIESNPIPVKWALHEMGLMPDGIRLPLTWLSAACHEPLRQAMRQSGVLV

SEQ ID NO: 31859 - protein, 895 aa, Arabidopsis thaliana
MKITEGRFRLSLLLLLLLISAATLISAADYSPTEKILLNCGGGASNLTDTDNRIWISDVKSKFLSSSSEDSKTSPALTQDPSVPEVPYMTARVFRSPFTYTFPVASGRKFVRLYFYPNSYDGLNATNSLFSVSFGPYTLLKNFSASQTAEALTYAFIIKEFVVNVEGGTLNMTFTPESAPSNAYAFVNGIEVTSMPDMYSSTDGTLTMVGSSGSVTIDNSTALENVYRLNVGGNDISPSADTGLYRSWYDDQPYIFGAGLGIPETADPNMTIKYPTGTPTYVAPVDVYSTARSMGPTAQINLNYNLTWIFSIDSGFTYLVRLHFCEVSSNITKINQRVFTIYLNNQTAEPEADVIAWTSSNGVPFHKDYVVNPPEGNGQQDLWLALHPNPVNKPEYYDSLLNGVEIFKMNTSDGNLAGTNPIPGPQVTADPSKVLRPTTRKSKSNTAIIAGAASGAVVLALIIGFCVFGAYRRRKRGDYQPASDATSGWLPLSLYGNSHSAGSAKTNTTGSYASSLPSNLCRHFSFAEIKAATKNFDESRVLGVGVFGKVYRGEIDGGTTKVAIKRGNPMSEQGVHEFQTEIEMLSKLRHRHLVSLIGYCEENCEMILVYDYMAHGTMREHLYKTQNPSLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEENGKGVCGDMDMDEIKYDDGNCKGKNDKSSDVYEGNVTDSRSSGIDMSIGGRSLASEDSDGLTPSAVFSQIMNPKGR

SEQ ID NO: 31860 - protein, 345 aa, Xylella fastidiosa Dixon
MEVHFTPVLNTCMAVSSLQHNHLSDTALIASARRVIEIEREALTLLNERIGAPFVAACRLILNSHGRVISTGMGKSGHIARKIAATLASTGTPAFFVHPGEAGHGDLGMITDSDVILALSYSGESDEVRMLLPVLKRQGNPIIAMTGRPQSTLAQAADVHLDVSVTTEACPLDLAPTSSTTTSLVIGDALAVALLDARGFTAEDFARSHPAGHLGRRLLLHITDVMHSGDDLPAVHEEATLSEALLEMTRKRLGMTAIVDNEGRLQGVFTDGDLRRALDSNIDVRNARINEVMTRHPKTINADQLAAEAARLMEANKINGLIVVDPQQRAVGALNIHDLLHAKIV

SEQ ID NO: 31861 - protein, 121 aa, Zea mays
LLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 31862 - protein, 721 aa, Mycobacterium tuberculosis CDC1551
MSSNNAGESDGTGPALPTVWPGNAYPLGATYDGAGTNFSLFSEIAEKVELCLIDEDGVESRIPLDEVDGYVWHAYLPNITPGQRYGFRVHGPFDPAAGHRCDPSKLLLDPYGKSFHGDFTFGQALYSYDVNAVDPDSTPPMVDSLGHTMTSVVINPFFDWAYDRSPRTPYHETVIYEAHVKGMTQTHPSIPPELRGTYAGLAHPVIIDHLNELNVTAVELMPVHQFLHDSRLLDLGLRNYWGYNTFGFFAPHHQYASTRQAGSAVAEFKTMVRSLHEAGIEVILDVVYNHTAEGNHLGPTINFRGIDNTAYYRLMDHDLRFYKDFTGTGNSLNARHPHTLQLIMDSLRYWVIEMHVDGFRFDLASTLARELHDVDRLSAFFDLVQQDPVVSQVKLIAEPWDVGEGGYQVGNFPGLWTEWNGKYRDTVRDYWRGEPATLGEFASRLTGSSDLYEATGRRPSASINFVTAHDGFTLNDLVSYNDKHNEANGENNRDGESYNRSWNCGVEGPTDDPDILALRARQMRNMWATLMVSQGTPMIAHGDEIGRTQYGNNNVYCQDSELSWMDWSLVDKNADLLAFARKATTLRKNHKVFRRRRFFEGEPIRSGDEVRDIAWLTPSGREMTHEDWGRGFDRCVAVFLNGEAITAPDARGERVVDDSFLLCFNAHDHDVEFVMPHDGYAQQWTGELDTNDPVGDIDLTVTATDTFSVPARSLLVLRKTL

SEQ ID NO: 31863 - protein, 228 aa, Burkholderia thailandensis E264
MRRPSPSCPMAFLLHQARFFTTVNHLRDLPPTVQPEIAFAGRSNAGKSTAINVLCNQKRLAFASKTPGRTQHINYFSVGPAAEPVAHLVDLPGYGYAEVPGAAKAHWEQLLSSYLQTRPQLCGMILMMDARRPLTELDRRMIEWFAPTGKPIHSLLTKCDKLTRQESINALRATQKSLDAYRDAGYAGKLTVQLFSALKRTGLDDAHALIESWLRPAAADEDHAAVAE

SEQ ID NO: 31864 - protein, 521 aa, Oryza sativa (indica cultivar-group)
MAKLLLEHGANTEDINGLILRTIAEKSDHTLIQTEMADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMEAAGIHETTYNSIMKCDVDIRKDLYGNIVLSGGIVLDSGDGVSHTVPIYEGYALPHAILRLDLAGRDLTDSLMKILSERGYSFTTSAEREIVRDIKEKLAYVALDYEQELETAKNSSSVEKSYELPDGQVITIGAERFRCPEVLFQPSMIGMEAAGIHETTYNSIMKCDVDIRKDLYGNIVLSGGTTMFPGMLIMWISKDEYDESGPAIVHRKCF

SEQ ID NO: 31865 - protein, 326 aa, Bradyrhizobium sp. BTAi1
MGNCVSGWTRYRPPHHSSLVRRSREAAAETEANVPDFTALKARKFLTGLIGAPIAHSASPAMHEHAAAALGVRCHYQLIEVAGADRAGLATLLEGVRRLGFAGVNVTYPYKEAVVELLDELAPKAAAMGAVNTVVVRDGRLIGHNTDTTGFERAVAPLLSQTGRGAVALIGAGGVGKAIAFALANLNVAGLRIYDTERARAERLARLLPASTGAVVVDSVERALQGAAGVVNGTPIGMLPNRGTPVPDHLLRTDLWVADAVYSPLWTPLLKAAKARGAQVLLGRELAIYQAADAFELFTGLAPSTEAMGAAFDNHMAERYPAVDAA

SEQ ID NO: 31866 - protein, 295 aa, Medicago truncatula
MYNLKVLKFSRVFSNSFNGPLQVGSYSKEGKSLFSYLSYFITLVSIAGSKTRNLQSVIARLKHKKNRWDHSLLKEHVGSSLLGNTMNLVKDEIIDNENHVHRSDNNSEDFEEVNDGQYSSLKLIDDSCFISLELNDFFESNLPKLVKGCKRVLLYSTLKHGISLRTLIRNSSQLTTPGLLIVGDMKGAVFGALLDCPLIPTTRPKYQGTHQTFVFTNLDSHPRIFRPTGVNRYYYLCSNDSFAFGGGGGFALYLDGDLLTGTSGPCDTFENHCLAHTPEFEIKNVELWGFTHTSS

SEQ ID NO: 31867 - protein, 211 aa, Vibrio fischeri ES114
MSNFELKHKATNKISEKIAYKITQCLKFLLNIFYGSKYAKRAVILETIAAVPGMVAGMFNHLKALRRMKDDQGWIQELLSEAENERMHLMIFLDIAKPRWIERLLVLLGQAVFIVVYSFIYLLSSKIAHRVVGYFEEEACKSYTEYLAKIDEGTVENEAAPQIAIDYYQLPSDAMLRDVILKIRNDEAKHRDRNHSFADAYETHDLPAHQR

SEQ ID NO: 31868 - protein, 249 aa, Schizosaccharomyces pombe 972h-
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLAEREANETINVVVRQLNAIADKVQNWSKIVIAYEPVWAIGTGKTATPEQAQEVHAEIRKWATNKLGASVAEGLRVIYGGSVNGGNCKEFLKFHDIDGFLVGGASLKPEFHNIVNVHSL

SEQ ID NO: 31869 - protein, 463 aa, Bacteroides thetaiotaomicron VPI-5482
MSLNIAKDSKKRVVIVGGGFGGLKLANKLKKSGFQVVLIDKNNYHQFPPLIYQVASAGMEPTSISFPFRKIFQHRKDFYFRMAEVRAVFPEKNMIQTSIGKAEYDYLVLAAGTTTNFFGNKHIEEEAMPMKNVSEAMGLRNALLANLERAVTCSNKQEQQELLNIVVVGGGATGVEVAGVLSEMKKFVLPNDYPDMPSSLMHIYLIEAGSRLLAGMSEDSSSHAEQFLREMGVNILLNKRVTDYRDHKVTLEDGSEIATRTFIWVSGVTGVSFGNMNTSVIGRGGRIKVDAFNRVEGTNNVFAIGDLCILSGDEDYPNGHPQLAQVAIQQGELLAKNLIRLEKGKEMKPFHYRNLGSMATVGRNRAVAEFSKVKMQGWFAWVMWLVVHLRSILGVRNKVVVLLNWVWNYFTYDQSMRMIVYARKAKEIRDREAIEATTHWGKDLMQEPQPAKQEPQPNSKEIV

SEQ ID NO: 31870 - protein, 100 aa, Arabidopsis thaliana
  misc_feature (81)..(81): Xaa can be any naturally occurring amino acid
  misc_feature (89)..(89): Xaa can be any naturally occurring amino acid
MAWAMLSSGTMVASPAQATMDAPFNGLKSYAAFPATRNANNDITYITSNCGRVNCMQVWPPIGKKNVETLSYLSDLTDFQXAKEVDYLXIRNKWISLVKY

SEQ ID NO: 31871 - protein, 286 aa, Schizosaccharomyces pombe 972h-
MAIPFLHKGGSDDSTHHHTHDYDHHNHDHHGHDHHSHDSSSNSSSEAARLQFIQEHGHSHDAMETPGSYLKRELPQFNHRDFSRRAFTIGVGGPVGSGKTALLLQLCRLLGEKYSIGVVTNDIFTREDQEFLIRNKALPEERIRAIETGGCPHAAIREDVSGNLVALEELQSEFNTELLLVESGGDNLAANYSRDLADFIIYVIDVSGGDKIPRKGGPGITESDLLIINKTDLAKLVGADLSVMDRDAKKIRENGPIVFAQVKNQVGMDEITELILGAAKSAGALK

SEQ ID NO: 31872 - protein, 590 aa, Xylella fastidiosa Dixon
MPHSAHRSTPTLHTQMNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDHLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLLLQKITNGDMLIIDGNSGEIIVNPSPQDLRHYHSRLRERAKEQRELEQLRSKHSRTRDNVDIVVQANAESPDDVSQAYTLGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSATTLLRARDRKSIEEWMAAHANTTPT

SEQ ID NO: 31873 - protein, 1411 aa, Aspergillus nidulans FGSC A4
MPARLHSRPQGNSTLASSQEAGDHADRPSSPQVHLTYEDEDAIAEIHRTLTKKDHDYSEPHLSFDKFLEEELRAGRKKPNLGVCFQSLSTWGTGGEHVNVKTLGTALWRTLIFQDVYEWTIKPWLAKPEPESGRSGCSTFLRTIAGYHSSFLGVTGSIAYSGLSLEDVRKHYRGQVAYVPEDDVHFPTLSVRQTLEFALQSKTPKRYHDRIPRYLEIYGRVFGMSHTMDTLVGNEYIRGVSGGERKRISIIESLATDSSVMCWDNSTRGLDASSALDYARSLRIMTDTCGKATLMTLYQASDAIYDLVDKVLLIDEGRMLYQGPAHEAKAYFHDLGYECGPMQTVSDFLTSITIPERRKFREGWEQRAPKGPIELEQAFRKSAAFMNVQKEVRSYDSQGFGGRSRAESHSDTDYESLEDVKEALQTDKSRFVSSKSPYTISLFRQVVLCAKRQIWQIRGHMSPLYIKLISSVIYGLLVGSMFYDQPQTTDGMYSRGGVIFYSSILLAWLQMSELEEAMQGRDILSRQKKFAFVRPSAVCLARVVADIFIAALLTFLYLVVVYFLSGLKSDAGAFFIDFLFIYMCTISLTAQFRLFAAASSNFEVALRYTGFLVLLCIVFGGYVLSVDKMMADVPWVGWIAYITPALYTYEAMMAAEFHNTNFTCSPASVVPAGPVYTDIAYQTCAYAGSQIGSTIVNGDDYLAVKYGFYFSHVWRNFGILCLFTVASVAATCLLSEIMEWEPDSAGPVQYKKSRKQLRKIANISDEEERPVQVNQTSPSASDTDGPSVGALTATKSTFTWDNLELFVRVGKENRKLLDGVSGYCKPGTLTALVGASGAGKSTLLTALTQRQSSGDLTGTIIGYCEQMDIHDESSTIREAFEFSALLRQDSTVPDQEKLAYARTVLETLDLVELQNAIIGSLDIEKKKRVTIGVELCARPELLLFLDEPTSGLDSQAASSICALLRRLADQGLAILCTIHQANQEQFEMFDRVLALSPGGKTYYFGEVGEAGHSIFDYFAKYGQKPENITNAADYIIEVVVGGMKNTASTVDWAAVWNQSVEAQQVQQDLERFRNMKQESLPSLDMQSQAMPAISRQIFLLTQRTSRQFWRSPEYPYSRLYASFLHALINCLTYLQIGNSTTDLQSKAFSCFLVLMLVPEFINAISARFIMNRDLWKAREGPSGAYGWVAFCTAQIISEIPYAIISAVVFFVLYYFSVGLPLGFAAGYSFLMFFLFFLFATSWGQWIAALSADSVVAATLMPFFIIMCETMNGILQPHKYMPAFWAYTMYYVTPFTYWIGGVLTSVLRGVPVICDENELTVFQSPPNITCSEYAGSWLAEKGVGYLSNPDGSGECGYCEYSYGDDYLSTIGLDSSKIWPYFGIFVAFVVSNYLMVYLLVYIRSVMKPFRRRT

SEQ ID NO: 31874 - protein, 707 aa, Aspergillus nidulans FGSC A4
MIPMLAATLAEAFILQRSVFTDTPLRTVVFGSAAVNLLILAIYNVWIWPFFLDPLRHLPRAPGRFNMLRFIFDNPRGRLPLLWMKTVPNDGLIYFRDLLNRTQLLATNHQALLDVMSTNTYDFEKPWRAREFLARIIGFGLILSEGAAHKRQRRALTPFFTIKNVRALYTLMWDKTNQLLVEMDKQISRCPMEGTSPDSGWGKVEMSVWARYFTLSRLTLDVIGPAAMGRDFRSLQNAENKVADSFLAILEPTKEKIAFLAINFLLPQWFAKKLPWRLNQVIEEQVGYLRDLCKEIVHEKRAAITATKVTASELEADILGSMMLSGDFTDDELVDQMLTFLAAGHETTASALTWTCYLLTLHPEVQDRLRAEIRTAIPHSTHPVTHSDLESLPLLNGVCQEVLRLYPTVPSTIREAVRDTTVAGKHVPKGTKIMLCPYAINRAPEFWGADGDAFRPERWIDTDPVTGKTSVNNHGGAATNYAQITFLHGQRSCIGKDFARAELRCAVAGVVGRRLTTYMQMEDTYTGCWGMSNAHSGHHEECQKLHRIGTGIDINDSGIILYLKNHGALHIPALVSAEAAMKKGKRMKKTIIMKTALASLITAYVPAECTRPESMNERDPTRNLRREAGSGPKNIPPRTENGWVHPRICSQPRRNDVQTAYGEQCDSGPDAIDKSVAGYPARGRQQKSADKLFACLWGDVVLEAKVI

SEQ ID NO: 31875 - protein, 331 aa, Idiomarina baltica OS145
MAAFGTVFMPEMSIAEYQDGQWHSPQISTANSLSLHPGAHALHYASTCFEGLKAFKHADGSVHIFRLDQNIKRMRQSSKLLALPEIDTTLLEHMIVDIVKHFKNEVPNPPGSMYIRPTHIGTEPAIGKAASPATQSLLYVLLSPVGDYFAGGTRPLKLLIETDGMRCAPHMGMIKSGGNYASALNPIMQARAQYDADQVLFCPNGDVQETGAANFLLIDGDEIITKDLDSSFLHGITRDSILTLAKDMGMKVSERALSVDELLDRAQKPATEAALSGTAAVLTPVGSLIHNEQTITIGSGEEGPKTQLLRRALNEIQWGERADSFGWLTAV

SEQ ID NO: 31876 - protein, 283 aa, Burkholderia thailandensis E264
MCLIVFDWQPDAAHGPVLTLAANRDEFFRRTSAPLAWWSDAPHVLAGRDLEGGGTWLGVARDGRFAALTNYRAPFDIRAGAPTRGKLVSEFLTGENVAPLDYLANVAEKAVFYNGFTLLAGDVARGELAWYCNRPADAQPAPDAPVSVAPGMHGLSNARLDTPWPKLVGKRSALGALLTDDAAAPLDALIELMRDTREADDDALPHTGIPLERERALSAAFIETPEYGSRGTTVLRVARDIEGRLRFDVKERCDDDGSHRIVRPGAFERAFTFDVDASGQARR

SEQ ID NO: 31877 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPNANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 31878 - protein, 399 aa, Idiomarina baltica OS145
MGRAAAPSGASTGSREALELRDGDKNRYLGKGVEQAVANINGAIAEALRGAEAVNQNAIDEIMLRLDGTDNKEKLGANAILAVSLAVAKAAAAYKNMPLYQHIAELNNTPETYSMPLPMMNILNGGEHADNNVDIQEFMIQPVGASSFKEGLRMGAEIFHALKKVLQQRGLSTAVGDEGGFAPNLGSNEEALQVIVEAVEKAGYRMGDDVTLALDCAASEFYKDGQYNLSGEGKSFDAEGFASYLAELCDRYPIISIEDGLDESDWDGWKVLTEKLGDRVQLVGDDLFVTNTRILQEGIDKGIANSILIKFNQIGSLTETLAAIEMARKAGYTAVISHRSGETEDATIADLAVGTAAGQIKTGSLCRSDRVAKYNQLLRIEGELDGKAPYRGRQEVKAG

SEQ ID NO: 31879 - protein, 462 aa, Nocardia farcinica IFM 10152
MEGWTMDDRVPRGRLARGSRLGRLAAGQAVRGVGTKVAMLGRTEQARRALAERSALQAAQQLVTVLGGMKGAAMKLGQMLSVLDVDLVPESHRELFRTKLAELRDRAPHVAFAAMRRVIEDDLGPMARIFADFDETPIAAASIGQVYRARLRDGRAVAVKVKYPGVDQAVEADLRNLRMIARLWKSVLPSAADTAVLDEVALNIGGELDYRREARDQHRVASRYRGHPYVLVPDSIIEHCGPNVLVTELVDGRPFDELRALPDADRDHLGELIYRFYINSLFVDYEFCGDPHPGNVLLAADGRAAFVDFGLYHRMNPVDADFERDCLRAAGEHRADDLYAAWVGRGIVDPDSGVTAQDCLEYVWAAAGWHLLDEPITITPEIATGAVVLAVDPRAVRFRGVHRQHLPREHVFSRRADLFTYAVLGQLVCTANWHLLAREWLLGDTPHTEVGRAIARWRAERG

SEQ ID NO: 31880 - protein, 700 aa, Corynebacterium efficiens YS-314
MTTLTLSPDLQALTERKYPSDWSDVDTRAVDTVRVLAVDAVENCGSGHPGTAMSLAPLAYTLYQRVMNVDPTDTNWAGRDRFVLSCGHTSLTQYIQLYLGGFGLEMDDLKALRTWGSLTPGHPEYRHTNGVEITTGPLGQGLASAVGMAMAARRERGLFDPEAPEGESPFDHHIFVIASDGDLQEGVTAEASSLAGTQQLGNLIVFWDDNRISIEDNTEIAFTEDVVARYKAYGWQTIEIEGGEDVVAIEAAVEEAKKDTTRPTFIRLRTVIAYPAPNAMNTGASHGAALGAEEVAAIKEILDFDPEKHFHIDDEVIAHTRKLAERAAEKKVAWQEKYDRWAAANPEAKALHERLITRALPEGFADNLPTWEPDAKGIATRKASEAVLQELGKTLPELWGGSADLAGSNNTIIKGEPSFGPESISTETWTAEPYGRNLHFGIREHAMGAIMNGIALHGGTRPYGGTFLIFSDYMRPAVRLAALQGTDAYYVWTHDSIGLGEDGPTHQPVETLAALRAIPNLSILRPADANETSAAWRAALEYKEGPKGLALTRQNVPVLEGTKEKAAEGVRRGAYVLVEGSKQTPDIILMGSGSEVQIAVEAAGILESEGVAARVVSVPCMDWFAEQDAEYIESVLPSEVTARVSVEAAIAMPWYRWLGTRGKAVSLEHFGASADYQTLFEKFGITTEAVLEAARATLDA

SEQ ID NO: 31881 - protein, 451 aa, Pseudomonas fluorescens Pf-5
MTTTTITVQDPHASPEHARQLDTLYARIRWRLLPLLMLCYMVAFLDRVNIGYAQLQMKQTLPFGDAVYGLGAGIFFIGYFIFEVPSNLMLKRSGVRKTLLRIMFCWGLVAAAMMFVSTPMQFYVLRFLLGAFEAGFFPGVILYFTYWFPAPRRGQVIAIFMTAAAVAGLIAGPVSGSILKYLDGTVGLHGWQWMFMIQGLPASVLGVVAFFYLQDSPARARWLSPGEQRLLDADMARDLANARDKSQDSLAQMFRDPRIYLLSTAYFMFLGATYMLVFWMPSLIQGWGSKDLLQVGLITAIPNIVGIVGMVLIGQHSDKHRERRWHFVGCMAIAVFGLAVTTLLNGHLLLSVTALGFAYVGIKAGTPIFFALVSEYLSVAATAGGIAFISSLGNLGPAVTPWLNGVINSHTGGHVSSMYLGIVMYLLAGGLVLVTARIARVPKVAAVVAES

SEQ ID NO: 31882 - protein, 397 aa, Rhodococcus sp. RHA1
MSIVSEPTTPQKVELTDEEIFAGHIGGKLSVETTTALDTQRALSIAYTPGVAQVSRAIAADETLADRYTWTSRLVVVVSDGSAVLGLGDIGPRASLPVMEGKSALFKNFAGLNSIPLVLDTKDPDEIVETLIRLRPSFGAVNLEDISAPRCFEIEKRVIEALDCPVMHDDQHGTAIVVLAALKGAVKVQDRDIHQLRVVISGAGAAGVACANILLAAGIADVTVLDSKGIVSKDRQDLNEVKVDLAARTNPAGRRGGIVEALDGADVFLGVSAGTVPEELIATMAEGSIVFALSNPDPEIHPDVARKHAAIVATGRSDFPNQINNVLAFPGVFRGALDAGARRITEGMKLAAAEAILSVVGDELAVDKIVPSPLDPRVAPAVAEAVAAAARAEGVTG

SEQ ID NO: 31883 - protein, 232 aa, Brassica napus
  misc_feature (204)..(204): Xaa can be any naturally occurring amino acid
YSPARFVASSYHHRREHHQSPISVLHGPVSCSCSPPMRIGTSHRAGGANGLFSRFVRKAVGSCVDYELGPSDELTLFPMEDGSETKQPYAMDLLRRAQLRHKIFEDECVIKAFYEAEKAHRGQMRASRDPYLQHCVETAMLLANIGANSTVVVAGLLHDTMDDSFMTYDYILRNFGAGVADLVQGVSKLSQLSKLARENNTACXTVEADRLHTMFLAVADARAVLIKLADRL

SEQ ID NO: 31884 - protein, 399 aa, Corynebacterium efficiens YS-314
MGYFTCRETMRTWESISMNRKIAVVGLGSTGSMALWHLSRTPGIEAIGFEQFGIGHGYGAYTGESRLFRMAYHEGSTYVPLLRRARELWLQLGAASGRQLLHNFGVLSTGKEDTAAFQSLLASVSDHDLPHERLTAQQLRERYTGMDTRDDEAGVLDLQGGALRPELAVISAIEQARRNGARVYDHTGITGIEDTGAGVRITTGDSEMMVDQVIVTTGAWSAAVVPEIRDLIEVRKLVLTWFLPTDTAAFTPDRMPCFIRDRDGFHIFGAPSVDGYSVKIAGLDLWGGPSCPRVEESDLRLERAAVSAFGRRVHDLFPGVLPEPNRYSVHYDTYTSTKAPIIDRVGDVVVLTGGSGHGFKLAPAYGELATRLAVGIDNPLLSPDFAITAHDRFVGAVAA

SEQ ID NO: 31885 - protein, 457 aa, Bacteroides thetaiotaomicron VPI-5482
MKQYDAIIIGFGKAGKTLAAELSNRGWQVAVVEQSDEMYGGACPNVACIPTKTLIHESEISTLLYHNDFDKQSNMYRQAIARKNKLTSFLRENNYEKLSKRPNVTIYTGKGSLVSANTVKVALPEEEIELQGKEIFINTGSTPIIPSIEGIQQSRNVYTSTTLLELDILPKHLIIVGGGYIGLEFASMYAGFGSKVTLLEAGNRFMPRNDSDIAKSVREVMEKKGVEIRLNVRTQSIHDTHDGVTLTYSDTSDGTPYFVDGDAILIATGRKPMIEGLNLQAAGVEVDAHGAIVVNDQLHTNAPHIWAMGDVKGGAQFTYVSLDDFRIIRDQLFGDKKRDINDRDPLPYAVFIDPPLAHIGITEEEALRKGYSFKVSRLPATSVVRSRTLQQTDGMLKAIINSHSGKIMGCTMFCTDAPELINMVAMAMKTGQTSTFLRDFIFTHPSMSEGLNQLFDV

SEQ ID NO: 31886 - protein, 636 aa, Schizosaccharomyces pombe 972h-
MSDNVQQQVDSVGSVTEKLQKTNISRPRKYIPPFARDKPSAGAAPAVGDDESVSSRGSSRSQTPSEFSSNYGGRREYNRGGHYGGGEGRQNNYRGGREGGYSNGGGYRNNRGFGQWRDGQHVIGARNTLLERQLFGAVADGTKVSTGINFEKYDDIPVEVSGGDIEPVNEFTSPPLNSHLLQNIKLSGYTQPTPVQKNSIPIVTSGRDLMACAQTGSGKTAGFLFPILSLAFDKGPAAVPVDQDAGMGYRPRKAYPTTLILAPTRELVCQIHEESRKFCYRSWVRPCAVYGGADIRAQIRQIDQGCDLLSATPGRLVDLIDRGRISLANIKFLVLDEADRMLDMGFEPQIRHIVEGADMTSVEERQTLMFSATFPRDIQLLARDFLKDYVFLSVGRVGSTSENITQKVVHVEDSEKRSYLLDILHTLPPEGLTLIFVETKRMADTLTDYLLNSNFPATSIHGDRTQRERERALELFRSGRTSIMVATAVASRGLDIPNVTHVINYDLPTDIDDYVHRIGRTGRAGNTGQAVAFFNRNNKGIAKELIELLQEANQECPSFLIAMARESSFGGNGRGGRYSGRGGRGGNAYGARDFRRPTNSSSGYSSGPSYSGYGGFESRTPHHGNTYNSGSAQSWW

SEQ ID NO: 31887 - protein, 147 aa, Oryza sativa (japonica cultivar-group)
MNHHQQIRSTTAAEQQEASAGGGGGEEYEDLMPVMAGRLGAEGLLSELRAGFRLLADPARGAITAESLRRSAASVLGLGGGGGEMTVEEAAAMVREGDQDRRRRAERGEFCVLMVRLSPGIMGDAEGWLEEAIADELLRSLKEVTPA

SEQ ID NO: 31888 - protein, 141 aa, Glycine max
  misc_feature (123)..(123): Xaa can be any naturally occurring amino acid
MVLKGLCERIVSSKCSSKSSTETVDNTQVPVYSKAGSSDCKFPKASLWSSIFTSGFSVVETYSESSASEKKAVPSRSSGWAAAVRKVVTGGSMRRFQERVLGSSRTDISSSDGDIWLLGVCHXISQQESSGGVYSNGLASF

SEQ ID NO: 31889 - protein, 344 aa, Nostoc sp. PCC 7120
MVQERTIPKFNTANAKITKEEGLLLYEDMTLGRFFEDKCAEMYYRGKMFGFVHLYNGQEAVSTGVIQAMRPGEDFVSSTYRDHVHALSAGVPAREVMAELFGKATGCSKGRGGSMHMFSAEHGLLGGYAFVAEGIPVAAGAAFQSKYRREVLGDPNADQVTACFFGDGAANNGQFFETLNMAALWKLPIIFVVENNKWAIGMAHDRATSDPEIYKKASVFNMVGVEVDGMDVLAVRAVAQEAVARARAGEGPTLIEALTYRFRGHSLADPDEMRSKAEKEFWFSRDPIKKLAAYLIEQNLADEAELKAIERKIQDVIDDAVKFAESSPEPDPSELYRFVFAEDE

SEQ ID NO: 31890 - protein, 324 aa, Oryza sativa (japonica cultivar-group)
MTMPFAVSDPSASVEEMVAAAAADDECVCVWLEEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVKLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 31891 - protein, 170 aa, Triticum aestivum
  misc_feature (53)..(53): Xaa can be any naturally occurring amino acid
  misc_feature (79)..(79): Xaa can be any naturally occurring amino acid
  misc_feature (136)..(136): Xaa can be any naturally occurring amino acid
  misc_feature (141)..(141): Xaa can be any naturally occurring amino acid
MEVVKKAAMAAGAFDAVVCSHHAHGGKGAVDLGVAVQRACESQAEPLKFLYPXLDSSIKEKIEFIAKFYGASGVEYSEXAEKQIEMYTKQGFSTFPICMAENSVPPFLHVPSHEGAPSDFVLHRTAAHRRHTSRLXSAYGXLSTMPGFLSRPCFYKFEFTPATGKVMGFS

SEQ ID NO: 31892 - protein, 478 aa, Mesorhizobium sp. BNC1
MATYKAPLMLIGGEWTKGSGEPKEVINPATEEVIAMLPSATEADLDRALQSAQRGFREWQELSAEQRCDIIMRGCRILRERAAEIAPLITIEQGKPVEEARLEIIRAASIIEWDANEGRRAYGTIVPSDPGFNRYGIKLAIGPVAAFTPWNFPISSPGRKLGGALGAGCSVIIKSSEETPAATCALVQCLLDGGLPPEVINIVSGKSSMISAYLIASPVIRAITFTGSTPVGKHLAKLAAEAMKPVVMELGGHSPVIVFDDVDADKIARQAVAAKFRNAGQICTAPTRFIIQEKAHDAFVESFVKAASAIKVGNGLEADTQMGPLANSRRLRALEELVADARAKGATVATGGKRIGNRGYLFEPTVLTDVPDDADVVNVEPFGPIAPVVRFREFEEAIEIANRLPYGLCSYAFTNSQAYSHELAHRVESGIMSLNHFGTSQADTPFGGVKESGYGREGGYETLDAFMITKFVSQQITA

SEQ ID NO: 31893 - protein, 177 aa, Brassica napus
  misc_feature (11)..(11): Xaa can be any naturally occurring amino acid
ISSQQWYKTYXGGEQRDVRVIVASLYLKDAKETVEGMPEVEAVQLDVSDSESLLKYVSEVDVVLSLLPASCHASVAKTCIELKKHLITASYVDDETSGLHEKAKHAGITILGEMGLDPGIDHMMAMKMINEAHIRKGKVKSFTSYCGGLPSPAAANNPLAYKFSWNPAGAIRAGRNP

SEQ ID NO: 31894 - protein, 503 aa, Marinobacter sp. ELB17
MYSAGSVRNLDRYLIDEQGVDGFELMQAAARSAFRQLLRRWPQCRRVLVLCGAGNNGGDGYLLATCALRRGLGVTCLVLSDPAKLQGDARKAWQRASDQKISMVTAAQSADTDLTSFLEQADVTVDAMLGTGLNGAPRGEFARVIVLCNQSAAGVLALDVPSGLNATTGAAAGDVVAADATVTFIGLKAGLFTGHGPAVCGEVVFEDLGVAQQLGGCTEPVLATRADWSSVTLGISKRAANAHKGNFGHVLVVAGDRGFGGAGLLVAEAAARSGAGLVSLATRQEHVAAALSRCPAVMSHGVVHGSELAPLLAAATVVVCGPGLGQSAWGQQMLQQVLECNKPQVLDADALNLMAGGLMAKKASVAADNRILTPHPGEAARLLGCTVAEVEIDRLSAARKLQSRYGGTILLKGAGTVIATLHGRIFVVSGSNPGLATGGMGDVLAGIAGSLLAQLTDSTQAVVTAAALHLAAANMATQQFGYMGLQPTDVIDALPRVLACSGH

SEQ ID NO: 31895 - protein, 987 aa, Saccharomyces cerevisiae
MQSQDSCYGVAFRSIITNDEALFKKTIHFYHTLGFATVKDFNKFKHGENSLLSSGTSQDSLREVWLESFKLSEVDASGFRIPQQEATNKAQSQGALLKIRLVMSAPIDETFDTNETATITYFSTDLNKIVEKFPKQAEKLSDTLVFLKDPMGNNITFSGLANATDSAPTSKDAFLEATSEDEIISRASSDASDLLRQTLGSSQKKKKIAVMTSGGDSPGMNAAVRAVVRTGIHFGCDVFAVYEGYEGLLRGGKYLKKMAWEDVRGWLSEGGTLIGTARSMEFRKREGRRQAAGNLISQGIDALVVCGGDGSLTGADLFRHEWPSLVDELVAEGRFTKEEVAPYKNLSIVGLVGSIDNDMSGTDSTIGAYSALERICEMVDYIDATAKSHSRAFVVEVMGRHCGWLALMAGIATGADYIFIPERAVPHGKWQDELKEVCQRHRSKGRRNNTIIVAEGALDDQLNPVTANDVKDALIELGLDTKVTILGHVQRGGTAVAHDRWLATLQGVDAVKAVLEFTPETPSPLIGILENKIIRMPLVESVKLTKSVATAIENKDFDKAISLRDTEFIELYENFLSTTVKDDGSELLPVSDRLNIGIVHVGAPSAALNAATRAATLYCLSHGHKPYAIMNGFSGLIQTGEVKELSWIDVENWHNLGGSEIGTNRSVASEDLGTIAYYFQKNKLDGLIILGGFEGFRSLKQLRDGRTQHPIFNIPMCLIPATVSNNVPGTEYSLGVDTCLNALVNYTDDIKQSASATRRRVFVCEVQGGHSGYIASFTGLITGAVSVYTPEKKIDLASIREDITLLKENFRHDKGENRNGKLLVRNEQASSVYSTQLLADIISEASKGKFGVRTAIPGHVQQGGVPSSKDRVTASRFAVKCIKFIEQWNKKNEASPNTDAKVLRFKFDTHGEKVPTVEHEDDSAAVICVNGSHVSFKPIANLWENETNVELRKGFEVHWAEYNKIGDILSGRLKLRAEVAALAAENK

SEQ ID NO: 31896 - protein, 115 aa, Mycobacterium tuberculosis CDC1551
MTLDPKIAARLKRNADGLVTAVVQERGSGDVLMVAWMNDEALARTLQTREATYYSRSRAEQWVKGATSGHTQHVHSVRLDCDGDAVLLTVDQVGGACHTGDHSCFDAAVLLEPDD

SEQ ID NO: 31897 - protein, 522 aa, Arabidopsis thaliana
MAEFPEPGTVNPDSDLSNGRAEKPEIDTSAPFESVREAATRFGGFGFWRPSLNKLPDASQENIQEPDIMGLKAQAFELQRELIVKERETLEVLKELEATKATVLKLQQRNEAYEEDTLREEVDSHIKPAGVVLKDLSQAKMNLCKIASIRESVEQLKNKLNEERAALEKTRERLMEKSLKVFSLEEEEVRVRFAKEGQTGEKDLGMLNEVQRLSRQAQEVKKTGENAELEVVKAMAETESTRDKIRTAKIRLVAARKMKEAAREAEAVAIAEIEAVTGSMNVGKAEAVTISAEEYSVLARSARDAEEEARKRVEDAMSRVEEANVSKKDVLKKVDEAAQEIETSKRVLEEAVERVDAANASKIEAEEALRKWRSENGQRRRLSSSVNNTSKFKSRRETTTRLMDVNGLHLTYDVVDGSSSSSTVPVLKPTMSIGQILSKKLLLAEDSDMNVANERRKMSLGQMLAKNSSSDKTVSKRSEGKENEKRTKTRKRKSFGFAKISVLLNKESKNKKKKKKIALNLR

SEQ ID NO: 31898 - protein, 262 aa, Corynebacterium efficiens YS-314
MSPMARKPLIAGNWKMNLDHQQAIGTVQKLAFALHKDYYEKVDVAVIVPFTDLRSVQTLVEGDKLQITYGAQDVSQHESGAYTGEVSASMLAKLNCSWVVVGHSERREYHNETDELVAAKAKAALSKGISPIVCVGEPLEIREAGTHVDYVVEQTRASLAGLSADELANTVIAYEPVWAIGTGKVASAADAQEVCKAIRGLVTELAGEEVAEGMRILYGGSVKAETIAEIVSQPDVDGGLVGGASLDGEAFAKLAANAANAV

SEQ ID NO: 31899 - protein, 107 aa, Synechococcus sp. RS9916
MDSQTKERIEALIQTSPIFVFMKGTKLMPQCGFSNNVVQILNAMGMAFETFDVLSDMEIRQGIKEFSEWPTIPQVYVKGEFIGGSDILIEMYNSGELKEKLEIALAS

SEQ ID NO: 31900 - protein, 405 aa, Corynebacterium efficiens YS-314
MAVKTLKDLLDEGVDGRHVIVRSDFNVPLNDDREITDKGRIIASLPTLKALTEAGAKVIVMSHLGRPKGEVNEKYSLAPVAEALSDELGQYVALAADVVGEDAHERANGLTEGDILLLENVRFDPRETSKDEAERGAFADELAALAADNGAFVSDGFGVVHRAQTSVYDIAKRLPHYAGRLVENEISVLEKIAENPEAPYTVVLGGSKVSDKLGVIEALASKADSIIIGGGMCYTFLKAQGHDVQKSMLQDEMIDTCKDLLERFGDKIVLPVDLTWASEFAKDAEKKVTDLDSAPEGWLSLDIGPKSVEKFADVLGASKTIFWNGPMGVFEFEAFSDGTRGVAQAIIDATANNGAFSVVGGGDSAASVRVLGLDEEGFSHISTGGGASLEFLEGKELPGVAILKD

SEQ ID NO: 31901 - protein, 276 aa, Rhodococcus sp. RHA1
MSEFAGKVVVITGAGSGIGRALALNLAGRGARLAISDMDTVGLAETARQAEALGAEVKADHLDVTQREAVLAYADDVRAHFGKINQVYNNAGIAYHGEFEKSEFKDIERIMDVDFWGVVNGTKAFLPHLIASGDGHVVNVSSLFGLLSMPGQSAYNSAKFAVRGFTESLRQEMLIAKHPVKVTCVHPGGIKTAIARNATAGPGEDLDTFAKFFDQKLARTTPEAAAETIVNGVRKSKPRVLIGADAKFLDAWVRLVGPSYQRVVALVAGRVLPKSN

SEQ ID NO: 31902 - protein, 334 aa, Corynebacterium efficiens YS-314
MTIRVGINGFGRIGRNFYRAVLERSDDLEIVAVNDLTDNKTLSTLLKFDSILGRLSEEVEYDDESITVGGNRIAVYAERDPKNLDWAAHNVDIVIESTGFFTDAQAAKAHIDAGAKKVIISAPASNEDATFVYGVNHQDYDPENHHVISGASCTTNCLAPIAKVLNDKFGIENGLMTTIHAYTGDQRLHDAPHKDLRRARAAAVNIVPTSTGAAKAVALVLPELKGKLDGYALRVPVITGSATDLTFTTNSDVTVESINAAIKEAATGELAETLAYTEEPIVSTDIVTDSHGSIFDAGLTKVSGNTVKVVSWYDNEWGYTCQLLRLTELVASKI

SEQ ID NO: 31903 - protein, 383 aa, Novosphingobium aromaticivorans DSM 12444
MLSDRHVKGRPHEMKTRAAVAFAPKQPLEIVELDLEGPKAGEVLVEIMATGVCHTDAYTLDGFDSEGIFPSVLGHEGAGIVREVGPGVTSVKPGDHVIPLYTPECRQCKSCLSGKTNLCTAIRATQGQGLMPDGTSRFSYKGQTVFHYMGCSTFSNFTVLPEIAVAKIREDAPFKTSCYIGCGVTTGVGAVINTAKVQVGDNVVVFGLGGIGLNVIQGARLAGAGKIIGVDINPDREEWGRKFGMTDFLNSKGMSREDVVAKVVAMTDGGADYTFDATGNTEVMRTALEACHRGWGTSIIIGVAEAGKEISTRPFQLVTGRNWRGTAFGGAKGRTDVPKIVDMYMTGKIEIDPMITHVMGLEEINTAFDLMHAGKSIRSVVVF

SEQ ID NO: 31904 - protein, 325 aa, Arabidopsis thaliana
MGYEKFTWVIQNFTYLQYLQCSQSNIFVIGGCKWFLKGYHDAKYLSLFLMVATSKTLPCGWRRHTRFRLTVVNQLSDELSQQRETEKWFDQNVFLSGYQKMLLLTKLNAKKGGFLVNNEVKIVVEVDVLQVIGNLDVSEESLEVNQPMKRIKLNDDGASVKESIDVNGFQVLPSQAESLKHIFEKHPEMALKFRAKNQHMRTSSINLLLNIIETLCQSLQDLSIDDLGQAEQALTYLENSGFKVDWLERKLEEVKEKKMEEQIGKSRMQELEEELKVFKQKCSDIEALLEKEKQKCSDIEALLEKEKVKALAAARAPPLRLDDVV

SEQ ID NO: 31905 - protein, 353 aa, Schizosaccharomyces pombe 972h-
MAVKGDDVKWKGIPMKYIALVLLTVQNSALILTLNYSRIMPGYDDKRYFTSTAVLLNELIKLVVCFSVGYHQFRKNVGKEAKLRAFLPQIFGGDSWKLAIPAFLYTCQNNLQYVAAGNLTAASFQVTYQLKILTTAIFSILLLHRRLGPMKWFSLFLLTGGIAIVQLQNLNSDDQMSAGPMNPVTGFSAVLVACLISGLAGVYFEKVLKDTNPSLWVRNVQLSFFSLFPCLFTILMKDYHNIAENGFFFGYNSIVWLAILLQAGGGIIVALCVAFADNIMKNFSTSISIIISSLASVYLMDFKISLTFLIGVMLVIAATFLYTKPESKPSPSRGTYIPMTTQDAAAKDVDHKH

SEQ ID NO: 31906 - protein, 219 aa, Pseudomonas fluorescens Pf-5
MQNIIDGFLKFQREAFPQRSELFKQLASTQNPGTLFVTCSDSRVVPELLTQQEPGDLFVIRNAGNIVPSYGPEPGGVSATVEYAVAVLGVSDIVICGHSDCGAMTAISTCKCLDHLPAVANWLRHAESAKVINAARQHASPAEHLDALVRDNVIAQLANLKTHPSVALALEQGRLNLHGWVYDIESGAIVALDGNTQRFVSLAEYPHTCALASQASSAA

SEQ ID NO: 31907 - protein, 560 aa, Zea mays
MGKSPGKWIKSVLLGKKSTKSGPTKSNESKADNNRYSTGEDRTLSESSPVISEPVLVNIHKNVAINGKAADASDRARQQDPQSQSVVESRSSAPAAQLGEDQAAAKAQAAFRGYLARRSFRALKGIVRLQALIRGYLVRRQAVSTLRATWLIVKFQALVRGRNVRLSGSRMQLNVKFGQSNFGGVRSSDAWKEKLSSNAYVRKLLSSPIVLEPLHFQYDKRDPNSTYNWFERWTIGCIWKPAFQPKRVADGKPLVKKASYAMETQSAKLKRNIRKGSAAIAGSFHTSGESDKVKRNPKNFSSFPADSVPDSQLSELEKVKRNLRKVTDSMAEASKISSSRVDSSKVCNSTAEVPKESNPVAEISKIRSLLNGISDHQDIQCENTRESSFPLGTQEDSDNDHLLRYSNMDSLDLVPGLKSDQEIQLDSVSIGENVDDPTVVAPAVEEMSPQNIDTEDNVLCKKEEARSKEEHLSNGSLRTSKRKSSFPNKSEYVENGTHATPVQPRQPSYMAATESAKAKLRAQNSPSLDSDSAAEKNGFTRRHSLPSSTKSRALKAEWKR

SEQ ID NO: 31908 - protein, 225 aa, Aeropyrum pernix
MAGELHGFNVTKPLKREALSLASTLDSHARAIGAVNTMVAGEEGWEGFNTDWKGFLDSLKLYTASPPDTALVIGAGGAGRAAAYALATWGAGRVLIASRTGLTARRAAQDLAGLGAEVEPVPPGGLEDAAAASDVVVNATPLGWDGVSTPVERGFREGCIAVDMVYRPLATPFLRRAAASGCTPVDGLWMLAIQAAENIAVWLGLEASPVELRTYALEAMRGGRG

SEQ ID NO: 31909 - protein, 685 aa, Aspergillus oryzae
MSTVLLRSRPDQTALRRIGVLSSRLYSSKLPRPTRLATSRALPLRQNSVPQCLASRAFFNSHHSIRHQSTAPESTDASRKSSFRNAFFKTFAYCGFFIVMSGAAVVAFFIYDATTYREHSSAEDIPVSELALNPRRGGPKNLPVADVLVGDYDSEAMTEQKDKPRLVILGTGWGSIALLKQLNPGDYHVTVVSPTNYFLFTPMLPSATVGTLGLRSLVEPVRRIVQRVNGHFLKGEAVDVEFSEKLVEVSGVDANGQKQNFYVPYDKLVIGVGCTTNPHGVKGLENCHFLKTIDDARQIKNQVLENMELACLPTTSDEERKRLLSFVVCGGGPTGVEFAAELFDLLNEDLLYSFPKILRNEISVHIIQSRTHILNTYDEALSKYAEARFARDHVDVLTNSRVKEVRDDKVVFTQMEDGKPVLKEIPMGFCLWSTGVAPAEICKKLSAKLDAQNNKHALETDSHLRLIGAPLGDVYAIGDCSTVQNNVADHIVSFLRTIAWEKGKDPEKLHLTFREWRDVANRVRKRFPQASNHLRRLDRLFEQYDKDHSGTLEFGELSELLHQIDNKLTSLPATAQRANQQGEYLGRKLTKIAAALPGMRANEIDHGDLDEAVYKAFKYKHLGSLAYISNAAVFDFGGMNFSGGVLAMYLWRSVYFAESVSLRTRCMLAMDWAKRALFGRDLMSF

SEQ ID NO: 31910 - protein, 111 aa, Zea mays
NIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 31911 - protein, 336 aa, Burkholderia xenovorans LB400
MTIRVAINGYGRIGRNTLRAFYENGKKHDIEIVAINDLGDARTNAHLTQYDTAHGKFPGEVSVDGDYLVVNGDKIRVLANRNPAELPWGELNVDVVMECTGFFTTKEKASAHIKGGAKKVIISAPGGKDVDATIVYGVNHHVLKASDTVISNASCTTNCLAPLVKPLNDKIGLVNGLMTTIHAYTNDQVLTDVYHEDLRRARSATHSQIPTKTGAASAVGLVLPELNGKLDGYAIRVPTINVSIVDLSFIAARDTTVEEVNAIMKEASEGSLKGILGYNQAPLVSIDFNHNPASSTFDATLTKVSGRLVKVSSWYDNEWGFSNRMLDTAVALAHAK

SEQ ID NO: 31912 - protein, 662 aa, Burkholderia xenovorans LB400
MANAIRALSMDAVQKANSGHPGMPMGMAEIGVALWSRHLRHNPKNPQWADRDRFVLSNGHGSMLLYSLLHLTGYDLPIEELKNFRQMHSKTPGHPEYGITPGVETTTGPLGQGLANAVGMALAESLLATEFNKPDATIVDHHTYVFVGDGCLMEGISHEACSLAGVLKLNKLIAFYDDNGISIDGEVVHWFHDDTPKRFEAYGWNVIPNVVGHDVEAVDAAIKQAKQSDKPTLICCKTVIGEGSPNKAGSHDSHGAALGDKEVAATREKIGWKWEPFVIPQEVYAAWDATEAGARNESEWDKAFAAYAAKYPQEAAEFKRRNAKQLPADWKEKAKAIIAGANERAETVATRKASQQAIEALSAVLPELLGGSADLTGSNLTNWKAAKPVRVNAEGKAAGNYVNYGVREFGMSAAINGVALHGGFKAFGGTFLTFSDYSRNALRVAALMKAPSIFVFTHDSIGLGEDGPTHQSIEHVASLRLIPHLQVWRPADTVETAVAWTHAVEHHGPSCLIFSRQNLPFSERTDAQIANIEKGGYVLRDWNDEIVARKIILIATGSEVELALNAVEPLAREGIAARVVSMPSTTVFDKQDAEYRERVLPQGVRRVAIEAGVTDFWRKYVGLEGGVVGIDTFGESAPAGVLFKHFGFTVEHVVETAKAALG

SEQ ID NO: 31913 - protein, 293 aa, Burkholderia xenovorans LB400
MSAPLLFRPSLDAVYGFPHAKRVTQVVSPYQRIEVWDTPQLGRLFTLDGRPMTSTGDEFIYHECMVHPAALAHPSPQAALVLGGGDGGAARQLLRHAGIERIVVAELDAEVVRLTREHLPEVHGGAFDDPRVELVIGDAAHYVAHAAPARFDLVVFDLTPPDSPAAGLYTPTFYQQLKRVMRPIAAVSVHLGSPYFHAARIARLLDDLRAAFAVVRTMNTFIPLYGSLWIMATASDTLDPAALAADTLIERLAARRIGPLMHYDAGTHAALFSASRSVRDKLRRCCEIKFWVC

SEQ ID NO: 31914 - protein, 219 aa, Aspergillus oryzae
MSLFRAGNFACFRAGRLAAPINARFLSTNTGRGDPSVKTSPADAPAVPPKDSSLIRQEGPAEAMARHQPDYEATIDHGTSKFSPVPKRVMDGSEPGDTVPAAVLSGAPTDLQARTVRIYRPSKPATQSGTWHQHHWRMDWDVLQKGHRWENPLMGWQSSADNMQGTHLNFKSKEDAIMFAQKQGYEYFVQEPNERRFVPKAYANNFVHEPKKIKHIRTK

SEQ ID NO: 31915 - protein, 1442 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLVFLRYLYRLQKFNCILQFYSQLDSKQININHRIYSIVSWAFLNLNRYEDAEKFINIHISKASIFPRTHMLDSLIHGFSITRDDPSKGLLILRDCLRNHGAFPSSLTFCSLIYRFVEKGEMDNAIEVLEMMTNKNVNYPFDNFVCSAVISGFCKIGKPELALGFFESAVDSGVLVPNLVTYTTLVSALCQLGKVDEVRDLVRRLEDEGFEFDCVFYSNWIHGYFKGGALVDALMQDREMVEKGMNRDVVSYSILIDGLSKEGNVEEALGLLGKMIKEGVEPNLITYTAIIRGLCKMGKLEEAFVLFNRILSVGIEVDEFLYVTLIDGICRKGNLNRAFSMLGDMEQRGIQPSILTYNTVINGLCMAGRVSEADEVSKGVVGDVITYSTLLDSYIKVQNIDAVLEIRRRFLEAKIPMDLVMCNILLKAFLLMGAYGEADALYRAMPEMDLTPDTATYATMIKGYCKTGQIEEALEMFNELRKSSVSAAVCYNRIIDALCKKGMLDTATEVLIELWEKGLYLDIHTSRTLLHSIHANGGDKGILGLVYGLEQLNSDVCLGMLNDAILLLCKRGSFEAAIEVYMIMRRKGLTVTFPSTILKTLVDNLRSLDAYLLVVNAGETTLSSMDVIDYTIIINGLCKEGFLVKALNLCSFAKSRGVTLNTITYNSLINGLCQQGCLVEALRLFDSLENIGLVPSEVTYGILIDNLCKEGLFLDAEKLLDSMVSKGLVPNIIIYNSIVDGYCKLGQTEDAMRVVSRKMMGRVTPDAFTVSSMIKGYCKKGDMEEALSVFTEFKDKNISADFFGFLFLIKGFCTKGRMEEARGLLREMLVSESVVKLINRVDAELAESESIRGFLVELCEQGRVPQAIKILDEISSTIYPSGKNLGSYQRLQFLNDVNEEEIKKKDYVHDFHSLHSTVSSLCTSGKLEQANEFVMSVLSCMPR

SEQ ID NO: 31916 - protein, 523 aa, uncultured archaeon GZfos18F2
MALDPTKYKDWQISEDAEKGMPMPEEWREKLGLEKEEILPMGRLAKLDFLKIIDRLKDKPDGKYIEVTAITPTPLGEGKSTTACGLMEGLGKRGVNVGGALRQPSGGPTMNIKGTAAGGGISLLIPMTEFSLGLTGDINDIMNAHNLAMVALTARMQHERNYNDEQLQRLTGMRRLNVDPTRVEMGWIIDYCAQALRNIIIGIGGRFDGFTMQSKFGIAVGSECMAILSIIRDLADLRNRLDKITLAFDKSGKPVTTGDLEVGGAMTAWMRNTINPTLMCTAEYQPCMVHAGPFANIAVGQSSIISDRIGLKMFDYHVTESGFGADIGFEKFWNVKCRYSGLKPHVSVLTSTIRALKMHGGGPRVVAGLPLAEEYTKENVELVERGCENMVHHINTIRKAGINPVVCINCFHTDTHDEIEAVRRAAEAAGARCAKSTHWADGGEGALEFADAVIDACNEESNFKHLYPLEMKLRDRVETIAREVYGADGVSWTPEAEAKAKMLEGDSQYDDYATMMVKTHLSV

SEQ ID NO: 31917 - protein, 180 aa, Synechococcus sp. RS9916
MRSRLSLTALALVAGLAGAPCSALAQSGEQGSAEATKVLASEGAGFNTAAVQSLLNRGDAAVASGNLEQARKDYDTARAASKQLLAFYRDLSGAFRGLDARIPREMDTKGRAALGLLAESNLRLAALFRRQNQPEVAVPVLVEVVRLMTPSNPQGQKAYQSLLELGFVETPFSAAKVGGN

SEQ ID NO: 31918 - protein, 408 aa, Sphingomonas sp. P2
MRSIAIVGANLAGGRAVEALRQAGFDGRITLIGEEPWRPYERPPLSKEVLWDPANVPDNFFLQDEAWYDDNRIDMRLGTRAEAIDLAGGGVRLSGGELVQADRILLATGGHARKLNLAGSNCANVHYLRTRDDATRMALDLREGASIVIVGMGVIGAEVAASAVKLGCKVTVVEPMPVPMERALGRRFGQWLGEEHRKRGVATHFNCGVTGFRFSDNRVSAVEADDGTVIPCDAVIVGVGIVPATSLARDAGIEVNNGIIVDRRCQTSNLAVFAAGDVAEQDGFFGGRFRQETYQNAADQAQAAALAMLGQEVSYCKPMWYWSDQFDLNIQFCGQIPVEAEVAIRGEMDSNAFVAFFLAGEAIEGVLTVNRAPDMGVGKRLVERRARASAASLADAGMSLRDLLKQAG

SEQ ID NO: 31919 - protein, 572 aa, Medicago truncatula
MKARKGKRSEVFWPSTVMKKWLNIKQKVYDFSEDEADTETESEDDDTSCKGYNMIRRHRRGKSETLRAQYINTKEVRVTIGTWNVAGKHPCNDLEIEGWLCTEEPSEIYIIGFQEVVPLNAGNVFGAEDNKPIPKWEEIIRRTLNKSSEPETKQKSYSAPPSPIRTNSFDTQINPLEKEGEKSIIGIEKNFELRKIYDIDLQTILDWPERPLDAIHDVDSTPKLRRVLSSSARIGLNLMDSASLYGYGMKRSHQSSGNLNLLWREKQQEMMPKVFDSLADVSDEENDTFSELLIDKDVNGIGSVKSQPKYVRIVSKQMVGIYVSVWVQRKLRRHVHHLKVSPVGVGLMGYMGNKGSVSVSMSVFQSRMCFVCSHLASGQKDGAEQRRNSDVHEILQRTRFSSVFDTDQPRTIPSHDQIFWFGDLNYRINMSDGEVRKRVALKKWDELMNYDQLSNELCRGHVFEGWKEGLINFPPTYKYEVNSDKYVGEDTQEGEKKRSPAWCDRILWLGKGIKQLKYQSAENQLSDHRPVSSIFLVNVEVIDHRKLQRAINFASAVVHPEIFLEEDRDLAC

SEQ ID NO: 31920 - protein, 575 aa, Medicago truncatula
MKGKRSEVFWPSTVMKKWLNVKQKVYDFSEDEANTETDESEDDDTSCKDYEMKRHRRRKSETLRAQYINTKEVRVTIGTWNVAGKHPCNDLEIEGWLCTEEEPSDIYIIGFQEVVPLNAGNVFGAEDSKPIPKWDALIRRTLNKSSEPGTKKKSNSAPPSPIRRISSFNTQINPLDSALDKKEEIKTIISIEKNLQLSKIYDIDLQTILDWPELRLDPIHHVDSSPKMRRVQSTSDSASLYGFEMKSLHQSSGNFSLLWSEKQQEIVPQVFDSHLDVSDMLSDEDNDTFSELANNEDANGIISVKSHPKYVRIVSKQMVGIYVSVWVQRKLRRHVHHLKVSQVGVGLMGYMGNKGSVSVSMSVFQSRMCFVCSHLASGQKDGAEQRRNSDVHEILQRTRFSSVFDTDQPQKIPSHDKIFWFGDLNYRINMSDGEIRKLVDLKKWNELMKFDQLSNELCKGHVFEGWKEGLINFPPTYKYEFNSDKHVGGNTQEGEKRRAPAWCDRILWLGKGIKQLKYQSAENQLSDHRPVSSIFLVDVEVIDHRKLERAIYFASAVVHPDVFLKEDEDEDLSYQ

SEQ ID NO: 31921 - protein, 120 aa, Zea mays
  misc_feature (69)..(101): Xaa can be any naturally occurring amino acid
LLEETLFLTVNIIDRFLARENVVRKKLQLAGVTAMLLACKYEEVSVPVVEDLILICDRAYTRADILEMXXXXXXXXXXXXXXXXXXXXXXXXXXXXXXXXXLELLSFFMIELSLVEYEML

SEQ ID NO: 31922 - protein, 185 aa, Zea mays
  misc_feature (51)..(51): Xaa can be any naturally occurring amino acid
  misc_feature (114)..(114): Xaa can be any naturally occurring amino acid
YLRDFEIETIGLKDTPRRCSDKNCGARLKDTVLDWDDALPPEEMNLATEHXRSADLVLCLGTSLQITPACNMPLMSIKNGGRVAIVNLQATPKDKKASLVIHGLVDKVIAGVMXKKCVRWTLRVTSIHGLRAPLPFLQSVKVSFPERPDLKSVVLKEQPFSLQRETSMNKPFFMLLTLNFSDGCS

SEQ ID NO: 31923 - protein, 493 aa, Picrophilus torridus DSM 9790
MKIYIDGEWRDSSSGETIKKYNPSTGEVLDTFPAATRNDVDAAIDSAEDAFKRWSDMTSMERSKILYKALELISKDKDQLTDLLIKENGKVKREAMDETEGVIDQLQYYTEFERKLTGDIVEGTSNKRKIFQYKVPYGIVIAITPWNFPAAMVIRKLAPALLTGNTVILKPSSDTPLTAEWLVKKFVDAGIPKGVLNLITGKGSEIGDYIVEHKKVSLITMTGSTSTGQRIMEKASKNMAKLILELGGKAPFMVWKDANIERALKSLVWAKYLNVGQSCIAAERLYIHEDIYDEFMKKFIEVSKRIKLGDPESSDMGPLINKSAVETTEKYVDIARSSGYKILLGGKKPELSGKYKNGYFYEPTIIENVPQDSPLFQEEIFGPVIGAESVSSVDELYEKANDSKYGLASYLFTEDPELIFEASEKIRFGELYVNMPGPEASQGYHTGFRLTGQAGEGSKYGISEYLKLKNVYVDYSRGNLSISTVNDDLFKNL

SEQ ID NO: 31924 - protein, 119 aa, Schizosaccharomyces pombe 972h-
MSAIGSLIFCSECGNLLESTTAQWTTCDQCQSVYPSEQFANLVVETKSSASAFPSALKLKHSIVQVESQKEEAATIEEKCPKCGNDHMTFHTLQLRSADEGSTVFYECPRCAYKFSTNN

SEQ ID NO: 31925 - protein, 267 aa, Brassica napus
MDPQLTEVSQQLERFKAAFVRKDYNTCSDLLSRLKVLLTKFTSLPPLFENTPNAAQELAIARDIYEHAVVLSVKTEDQDAFERDFFQLKPYYVDARDRLPPSPQENLILGLNLLRLLVQNRIAEFHTELELLSSATLENPCIKHAVELEQSFMEGAYNRVLSARQTAPDATYVYFMDLLAKTIRDEIAGCSEKAYDYVSISDARQMLLFSSDQELLTYVNEEHPEWEVKDGFVVFQKAKETAPCKEIPSLQLITQTLSYARELERIV

SEQ ID NO: 31926 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 31927 - protein, 533 aa, Aspergillus nidulans FGSC A4
MANVTLPSGSMSYPELLQVAKQDSSLSWPEQLWWAHYTFWNNDVLATGVMTFLAHELIYFGRCIPWIVADALPSVFRRFKIQDHKTPSFSDQWTCVKYILAIHFIVELPLIVLFHPMMEVCHVQYTLPFPKLSLFAAQVALFFIVEDTYHYWLHRAMHWGPLYRSIHRIHHQYAAPFGLTAEYASPAETFLLGLGTICPPLILGSITGDVHLITVLGWMALRQLQAIDAHSGYDFPWSLRRIVPFWGGADWHDDHHRYFWGNYSSSFTHWDIYVAVTRTRGKEVQVLGTEVCEVAVPVPDPRAKLGANQGHIIVGNGASPTGRIYPASAASSFLRKAALLCSGPLVPLFAWMQHTKRLFSPLHLPRPTAILRLFCVCYPLSPICWHIMAHSMRVLVYARVSDIPGNPQARHIALGDLLTGNLLGRRFYATPRPPVYDHVHIPADFDSSQPLERWFIFDLNVGETLSRSEVTRLPHLVYLASRQGDEWIFIRRDTSIENAKSKAASFTWGGRSEQKLVSELQNQSGGHSVGPDT

SEQ ID NO: 31928 - protein, 366 aa, Frankia sp. EAN1pec
MTDGPQAVTVEAVVAVEKGAPVALTRIIVPPPGPGEARVRVQACGVCHTDLHYREGAINDDYPFLLGHEAAGTVESVGDGVTSVVPGDYVVLAWRAPCGTCRSCLRGAPWYCFDSRNAVNPMTLQDGTPLSPALGIGAFTPLTLVAAGQCVKVDPAVPPQAAGLIGCGVMAGFGAAVNTGRVTRGETVAVFGCGGVGDAAIAGASVAGARRIIAVDVDDRKLEWARGFGATHVVNSRNEDPVEAVRALTDGNGADVVIEAVGRPETYRQAFFSRDLAGRLVLVGVPDPSMTVELPLIEVFSRGGSLASSWYGDCLPTRDFPIIIDLHRGGRLDLAAFVTETVGIGDVERAFERMRRGDVLRSVVLI

SEQ ID NO: 31929 - protein, 156 aa, Zea mays
  misc_feature (9)..(9): Xaa can be any naturally occurring amino acid
  misc_feature (60)..(60): Xaa can be any naturally occurring amino acid
  misc_feature (128)..(128): Xaa can be any naturally occurring amino acid
LENKISIGXVSLPGGIMSNPCHTYATPLGHGFFPRETSQHHLAHLLPLLRVALAESDVPXANLTCVCYTKGPIMGDPLQVVTAARVLSRLWRKPLMAVNHCVAHIKMGRAVTESVDPVVLYVYSGNMXVIAYSEGRYMIFRVLIDIAIGNCLDRVA

SEQ ID NO: 31930 - protein, 467 aa, Pseudomonas fluorescens Pf-5
MTTTTERKGIHLTRSLKSRHIFMLSLGGVIGTGLFMGSGVTINQGGPWGAILSYLGAGFLMYLVMVCLGELSVQMPVSGSFQAHATKYIGPATGFMIGWVYWMSWATTVGLEFTAAGMLMQRWFPGVPIWYWSALFVALLFGINALATRAFGEAEYWFAGVKVLAILSFIVVGALVIFGVIDLPSGAPAPMFDNLKGDSLFPNGLPAVFAVMMTVVYAFQGCEIMGVAAGETDQPEKSIPRAVRNVVFRVLIFYVLAVMVLAAIIPWQQAGLVESPFVQVFDMVGIPYAADLMNFVILTAILSVGNSGLYASTRILWAMSKSGMAPKALSPLSKQGVPLRALFITLCFALISLMTSFIAADTLFMVLMAVSGMAGTVTWIVIALAQYRFRRQFLREGGQLEQLKYRAPWFPLVPLLCIVLCSSLFVFLALDETQRPSLYWGSGFIALCYGAYYLMQRKRQLQPAAAV

SEQ ID NO: 31931 - protein, 219 aa, Zea mays
GNPDGATPPHIVEKLVQVAQREDTHGYSTSKGIPRLRRAISRWYKDRYAVDIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVIHDLAYADIVYDGWKAPSIMQVPGAKDIAVEFFTLSKSYNMAGWRIGFMVGNPEL

SEQ ID NO: 31932 - protein, 126 aa, Oryza sativa (indica cultivar-group)
MGNPFLNRTVDGFLKIGAVGACKVAAEDTFDCLHRGDVSKHKLEHMLKKMCKEGAYWGTVAGVYVGMEYGVERIRGRHDWKNAMIGGALSGALISAASNNHKDKIIKDAITGGAVATAVEFINYLT

SEQ ID NO: 31933 - protein, 443 aa, Sulfolobus tokodaii str. 7
MLKKFNLIFSKDTGVITLSELDKKAIEISSKYKGKIQILPKVPIKSIDDFAVLYTPGIAAVSKEIAKNKELSFHYTYRWNAIAIVTDGTRVLGLGDIGPEAAMPVMEGKALIFKYLGGVDAIPLPIGTKDPDKIIETVKILEPAFGGINLEDIESPKCFYILDKLRQTVEIPVWHDDQQGTAGATLAGLITSLEITGKDPKNIRVILYGAGAANIATARLLYKYGVPYENMIVIDSKGPLYKGRNDEDSMKLENPWKYELLEKTNKIGARTIEDAFKGADVLIAASKPGPGVIKSDWIKLMNKDPIVFALANPVPEIWPDEAKNAGARIVATGRSDLPNQVNNSLIFPAVFRGALDVRAKTITDEMVIEAARELASFAREKGINENYIIPKMTEWEVYPRVAAAVGMKAIQQGIARVSLSYDEIYSSAREIINSARKLLSSLT

SEQ ID NO: 31934 - protein, 564 aa, Triticum aestivum
  misc_feature (488)..(488): Xaa can be any naturally occurring amino acid
  misc_feature (505)..(505): Xaa can be any naturally occurring amino acid
MAVEVRRATPPRGGARPGEGRGARVQAGDALPLPIRHTNLIFSALFAASLAYLMRRWREKIRSSTPLHVVGLTEIFAICGLVASLIYLLSFFGIAFVQSVVSNSDDEDEDFLIASAQPKPAPAPAVPAQCALLQSAGPAPEVMPEEDEEIVSQVVAGKIPSYVLETKLGDCRRAAGIRRESLRRITGREINGLPLDGFDYASILGQCCEMPVGYVQLPVGVVGPLLLDGRRLYVPMATTEGCLVASTNRGCKAIAESGGASSVVFRDGMSRAPVARFPTARRAAELMRFLENPDNFDTLSVVFSRSTRFGRLQGVKCALAGRNLYMRFTCSTGDAMGMNMISKGVQHVLDYLEEDFPDMDVVSISGNFCSDKKSAAVNWIEGRGKSVVCEAIIREEVVQKVLKTNVQSLVELNVIKNLAGSAVAGALGGFNAHASNIVSAIFIATGQDPAQNVESSQCITMLEAVNGGRDLHISVTMPSIEVGTLGGXGTQLASQSACLDLLGVXKGANREPRDSNARLLATVVAGAVLAGELSLISAQAAGHLVQSHMKYNRSRKDMSNSAAC

SEQ ID NO: 31935 - protein, 107 aa, Synechococcus sp. RS9916
MTIYIGNLSFQAEQEDLLDLFSQYGEVKSASLPLDRETGRKRGFGFVEMSSDADEQKAIDDLQNVEWMGRMIRVNKATPRERTGGGGGGRGGYGGGGYGGGGGGNRW

SEQ ID NO: 31936 - protein, 350 aa, Streptomyces coelicolor A3(2)
MPLPRETLPPDTGGSREGSEFTPLLRDVREQQLLERRTGWYARTIAVNALGLAAVGTGMALLGDSWWVLALAPVLAVLCARTAFIGHDAGHAQISGSRAVNRRIGLVHGNLLLGMSYAWWNDKHNRHHANPNHIDKDPDVAADVLVFTSGQAATRTGFRGRLTRHQAWLFFPLTLLEGLALKLHGFQHLRRQRGRARLVEGALLVAHVAGYVTLLLATMPLAHALVFAALHQALFGLHLGMAFAPNHKGMDMPDPDSEAEKWGHLRRQVLTSRNVRGGFLTDWFLGGLNYQIEHHLFPSMPRPHLGLAQAAVKAHCRDLGIPYAETGLVDSYRQALRHMHEVGEPLRADI

SEQ ID NO: 31937 - protein, 428 aa, Rhizobium sp. MTP-10005
MSTNYMSAASVRTKNPAGVIATCGLMIMFDGYDLVVYGAVAPALLKEGAWALNPAMVGRAAALTLVGMLLGALFAGTMADRIGRRKVVLISLAGFSAMMIASAMTPNFLAFEITRFFAGLGLGALLPTVTALVLEFSPPKRRAQANSLSFLGYLIGGIISGLMGILLLESYGWRPLMLIGGLPLILLPIFMRFLPESPEWLASKGRQAEADGICDTYGLQRITPHAKIQKGGVGALFSEGRLLSTLNAWGIHFCSLLLTFGMVNWLPTIMNKMGYDISSALSFSIMLNVGAAIGILIGGRFADKGNVKVVVAVLFAIGAASIWALTVNKGPLLYLFVALAGAGTIGTQILANVLVGRLYPVHIRGTGLGFSLAVGRLGGIAGPMIGGLVLQRGLAPEWNFYIFGSIALVGLALTVLTLLYRTSGDGRV

SEQ ID NO: 31938 - protein, 219 aa, Wolbachia endosymbiont of Drosophila ananassae
KQQVMYVMTHDSIGVGEDGPTHQPIEHLASLRAIPNLYVFRPADAVETLECVSIALEKKESPALFALSRQNVSYMRKFYSDIDQSANLSKFGAYILCECSKELKVTIFATGSEVEIAVEAREKLQEKGIGTRIVSMPCWRLFDEQSDEYKAAILNNDSIKVAIEAGSEMGWHKYIGSNGIFIGMKSFGESAPYKTLYEHFNISADHVVKCVCEKLVYIQ

SEQ ID NO: 31939 - protein, 510 aa, Oryza sativa
  misc_feature (204)..(204): Xaa can be any naturally occurring amino acid
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLINIPMSNCINSKINKIYVLTQFNSQSLNRHIARTYNIGEGVGFGDGFVEVLAATQTTGESGKRWFQGTADAVRQFLWLFEDARLKRIENILILSXGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 31940 - protein, 249 aa, Mycobacterium tuberculosis CDC1551
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRG

SEQ ID NO: 31941 - protein, 1113 aa, Corynebacterium efficiens YS-314
MPKRSDINHVLVIGSGPIVIGQAAEFDYSGTQACRVLKEEGLRVTLINSNPATIMTDPEMADHTYVEPIEPEYIEKIFQKEIEQGHPIDTVLATLGGQTALNAAIQLDRLGILEKYNVELIGADIDAIERGEDRQKFKDIVATIGGESARSAVCHNMDEVYATVEELGLPVVVRPSFTMGGLGSGLAYTMEDLDRIAGGGLAASPEANVLIEESILGWKEYELELMRDGDDNVVVICSIENVDALGVHTGDSVTVAPAMTLTDREYQIMRDQGIAIIREVGVDTGGCNIQFAVNPEDGRIITIEMNPRVSRSSALASKATGFPIAKLAAKLAIGYTLDEVTNDITGVTPAAFEPTLDYVVVKAPRFAFEKFPGADDTLTTTMKSVGEVMSLGRNYIAALNKALRSLETKQLGFWTKPDEYFAGERATDLQAVLEDLRRPTEGRLYDVELAMRLGATIEELYDASSIDPWFLAELKALVDFREKLEDAPVLDEALLREAKFMGLSDLQIAAVRPELAGEDGVRRLRHSLGIRPVFKTVDTCAAEFEAKTPYHYSAYELDPAAESEVAPQTEREKVLILGSGPNRIGQGIEFDYSCVHAALELSRVGYETVMVNCNPETVSTDYDTADRLYFEPLTFEDVMEVYHAESESGTVAGVIVQLGGQTPLGLAERLKAAGVPIIGTSPEAINMAEDRGEFGDLLGRAQLPAPAFGTAHSFEQARAVANEIGYPVLVRPSYVLGGRGMEIVYDEASLEDYIQRATELSTEHPVLVDRFLDNAIEIDVDALCDGEEVYLAGVMEHIEEAGVHSGDSACALPPMTLGAQDIEKVRQSTRALALGIGVKGLMNVQYALKDDILYVIEANPRASRTAPFVSKATGVHLAKAASRIAVGATIADLRAEGMIPTGYDGGSLPLDAPIAVKEAVLPFNRFRRPDGRSLDTLLSPEMKSTGEVMGLADNFGAAYAKAETGAFGTLPTEGTVFVSVANRDKRSVILAIQRLDSMGFNILATEGTAGMLRRNGIDCEVVLKSSDVREGVEGRSIVDRIRDGEVDLILNTPAGSAGARHDGYEIRGSAVTVGVPLVTTVQGVTAAVQGIEALRRGELTVRALQELDHAVKA

SEQ ID NO: 31942 - protein, 323 aa, Triticum aestivum
MAGGGELVVSFGEMLVDFVPTVAGVSLAEAPAFLKAPGGAPANVSIAVARLGGEAAFVGKLGDDEFGRMLAAILRDNGVDDGAVVFDAGARTALAFVTLRADGEREFMFYRNPSADMLLTADELNVDVIKRAAVFHYGSISLIAEPCRSAHLRAMEIAKEAGALLSYDPNPREALWSSREEARTKILSIWDQADIVKVSESEVEFLTGIDSVEDDVVMKLWRPTFKLLLVSLGGQGCKYYARDFRGVVPSYKIQQVDTTGAGDAFVGALLQKIVQDPSSLQNQEKLVEAIKFANACGAITTTKKGAIPSLPTEIEVLQLMESA

SEQ ID NO: 31943 - protein, 292 aa, Oryza sativa (japonica cultivar-group)
MPNSPLLPTLLSHLFFFFSSPDREAGGIAEAGGSRSRIGPDLAGDDAVGVGRRGCGGGAGACRSPGGRSCGGRPRKLEGDLDVKLSSYARLAARSSSAADAASASSPSERSSWKFHGVRDPVAARKAAGRQRRHEPLRRLKGPKTFVLQKVGRQREILQGFGQEFRRTRGNLSSIREHADLLSSVRDDITESKATGGMSPRVHLLRERASIHGSINQIDEVIGQAQSTRVALSNQRALFGDVQGKVKQLGEKFPVIRGLLGAIKRKKSKDTIILSAVIAACTIFLIIYWLSK

SEQ ID NO: 31944 - protein, 402 aa, Pseudomonas fluorescens Pf-5
MRFSRLTQRIAGDGAAAWDIHYRALAKRERGEEVWLLSVGDPDFDTPQPIVQAAIDSLQAGHTHYADVRGKRALREAIARRHQQRSGQVVDAEQVVVLAGAQCALYSVAQCLLDPGDEVIVAEPMYVTYEAVFGACNAQVVPLPVRAEDGFRVQPEAVAARITGKTRALVLNSPHNPTGASIPRSTWEALAALCIEHDLWLICDEVYSELLYEGEHVSPASLPGMAERTATLNSLSKSHAMTGWRLGWVVAPTALAAHLENLALCMLYGSPEFIQDAAVVALEQPLPQLREMAEAYRQRRDLVCDCLADCPGARPLKPDGGMFVMVDIRATGLSAQAFSERLLDEQGVSVLAGEAFGPSAAGHIRLGLVLQADDLREACRRIALCARQCLAERDAPVTVQPV

SEQ ID NO: 31945 - protein, 369 aa, Nicotiana tabacum
MAIENNEQQELSQSFLLDALYCEEEEEKWGDLLDDETIITPLSSELTTTTKPNSLLPLLLLEQDLFWEDEELLSLFSKEKETHCWFNSFQDDPLLCSARVDAVEWILKVNGYYGFSALTAILAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLKNNVHWEFLRRCESLLLSIMADCRFVRYMPSVLATAIMLHVIHQVEPCNSVEYQNQLLGVLKISKEKVNNCFELISEVCSKPISHKRKYENPSSSPSGVIDPIYSSESSNDSWDLESTSSYFPVFKKSRVQEQQMKLASSISRVFVEAVGSPH

SEQ ID NO: 31946 - protein, 528 aa, Aspergillus nidulans FGSC A4
MTIDEDEKTAPVHLEYDGHEADDDSIENIATSWFVWLVSLTASIAGSLFGYDTGIISAVLVYLGSDLDGRPASENEKQLITSLCSGGSFVGAIIAGLTADKFGRKPAIYVGCVLFTVGAVLQGAAYSIAQMSVGRLIVGFGVGSASMVVPLYIAELSPTKVRGRLIGLNNMSITGGQVISYGIGAAFAHVPHGWRYMVGLGGVPSIILACLLPFCPESPRQLVYHGKTQEAETVIRKIYKGASDAQVAAKVRLIVRACDESRELNKDSTRWAKIKLLHSNPAYFRALVCACGFAVIAQMSGFNTLMYYSATLFDLVGFSDPVAVGIVVAGTNFVMTWVNMMLVDPLGRRRVVLLTAWGMSAGLIAVAIAFKFIPVDTSTLELETDTVSPPAIVVLIFIIWFVFFYGASMGNTAWMNTDFFPMEVRAIGTMFQTCCTWGSNIIVSSTFLSMMQGITPSGAFGFYAAICGFGYILIYFFYPEVSGLSIEEIREVFQHGFGVAYSRKLRKTRKAAARAASAAGEEVEAKTV

SEQ ID NO: 31947 - protein, 148 aa, Sulfolobus tokodaii str. 7
MMSIQRTFVMIKPDGVRRNLIGEIISRFEKRGLKIIGLKMVKIDRPTAERLYEEHKGKSFFEELISYITSGPVVCMVIEGDEAVSVVRKMIGNTDPKEAPPGTIRGDYALSKAENVIHASDSEEKAKREMSIFFKEEELVTPLAQVHM

SEQ ID NO: 31948 - protein, 373 aa, Nicotiana tabacum
MAIEHNEQQELSQSFLLDALYCEEEEEKWGDLVDDETIITPLSSEVTTTTTTTTKPNSLLPLLLLEQDLFWEDEELLSLFSKEKETHCWFNSFQDDSLHCSARVDSVEWILKVNGYYGFSALTAVLAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLRNNIHWEFLRRCENLLLSIMADCRFVRYMPSVLATAIMLHVIHQVEPCNSVDYQNQLLGVLKINKEKVNNCFELISEVCSKPISHKRKYENPSHSPSGVIDPIYSSESSNDSWDLESTSSYFPVFKKSRVQEQQMKLASSISRVFVEAVGSPH

SEQ ID NO: 31949 - protein, 320 aa, Pseudomonas fluorescens Pf-5
MPDIDILSFGETMAMFVAEHGGDLAQVQHFHKRIAGADSNVAIGLARLGFKVAWLSRVGNDSLGRFVLDTLRAEGLDCRFVRCDPIHPTGFQLKSREDGGDDPRVEYFRRGSAASHLAISDLDPALLRARHLHATGIPPALSDSARELSGHLMHTQRSAGHSVSFDPNLRPALWPSEALMIREINRLAALAHWVLPGLAEGRLLTGRDDPADIAAFYLDQGAEAVVIKLGAHGAYYRTQLDAGFVEGVPVAQVVDTVGAGDGFAVGLISALLESRGILEAVQRANWIGSRAVQSRGDMEGLPLRHELPEHTPSLKTASAL

SEQ ID NO: 31950 - protein, 472 aa, Triticum aestivum
MAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSNTAKFGRFHRGMLEEGVYLAPSQFEAGFTSLAHTTLDIEKTVEAAEKVLRRI

SEQ ID NO: 31951 - protein, 485 aa, Oryza sativa (indica cultivar-group)
MPPVGEVAAAEARSGMVLGGGAAAAAVGGGEDAVVMQVAGAEGQDSVITINCPDQAGLGCDLCRTILEFGLRITRGDVSTDGQWCFVVFWVVPRTPSIKVRWANLKNRLMSMCPSNYPMTFYPEITQPGPSQFYLLKLFSADRKGLLHDVTHILSELELIIHRVKVSTTPDGRVIDLFFITDGMELLHTKERQEETCSMLIATLGPSISCEILLAEGFQQGFSSLPPTISEELFRLELADGDNCSRSICAEMKRVQKATINFDNTLSPAHTLLQINCADQKGLLYDILRTMKDCSIQSWLTGDNSCLSKLSLVCSLMHHNSIPFQVTYGRFWSDKKGFREVDLFIKQADGKKIIDPEKQDVLSSRLRSEMLHPLRVMIVNRGPDVELLVANPVELSGKGRPRVFYDATFALKALGICIFSAEIGRQAASERQWEVYRFLLDDSSEFPLSNSLVNRNRIVDRKELAICVTKERMTYPEYVIWSYIL

SEQ ID NO: 31952 - protein, 336 aa, Glycine max
  misc_feature (123)..(123): Xaa can be any naturally occurring amino acid
MLGGNNGNCLLPVFLDETQFQHQTNVSNQLQLFGNLQAGCSVDPVNYFGNEHISSMIQPNKRSKEMEDISKQRLQISLNYNVHQDDAERLASIPNPNPVSTGLRLSYDDDERNSSVTSASGSXLATPSIILSLGDNIRTELDRQQEELDQYVKLQEQLSKGVRDMKQKHMAALLTSIEKGISTKLKEKDVEIENMNRKNRELAERIKQVAVEVQSWHYRAKYNESIVNTLRNNLQQAISQGAEQGKEGFGDSEVDDDASYIDPNNFLNILAAPINSTHKSYQDMENLTCRACKVKTVSMLLMPCRHLCLCKDCEGFINVCPICQLIKTASVEVHLS

SEQ ID NO: 31953 - protein, 498 aa, Asparagus officinalis
MPLILVILLLLPILLLVIRREKSTSSKLPPCPPKLPLIGNLHQLGSLPHQSLHALSVKYGPLMLLKLGEIPTLIVSSSDMAREIMRTHDHIFASRPSLLTSDILLNGATDVVFAPYGEHWRQMRKLCVNHLLSAKMVQSFRLMREEEVSSMLTRISGLVNMSEVLNLFTSKILFNAISGKFFVEEEGRINVFCKLIRENIAILAQLSVSDFFPSLGWLDLVFGVGARARATAKKWDDVLDEVIEDHVKRSNETGDADDQEERADFVSVLMALQEDDNTGFTLNRNIIKAILQDMIAAGTETSFLVLDWGMTELVRNPGTMKKLKDEVRSVAGSETVVREEDISKMFYLKAVIKEILRLHPPVPLLIPRESMDHCNVQQYEVPSKTRVLINAWSMGRDPKVWEDPEEFRPERFLDSDIDFRGQCFEFVPFGAGRRICPGMHFAAANLELALANLMYRFDWELPDGMKSEDLDMGDSPGLTTRRRQNLHLVARPFQRVKR

SEQ ID NO: 31954 - protein, 947 aa, Zea mays
MTASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKLATERGRKARPNLKVGICGEHGGEPSSVAFFAKAGLDYVSCSPFRVPIARLAAAQVLV

SEQ ID NO: 31955 - protein, 195 aa, Glycine max
AGYLHIINQMMELITGAGKKAYTLVMGRPNPAKLANFPECDVFLYVSCAQTALLDSKEYLAPVITPFEAMIAFNRGSQWTGAYVMEFRDLINLPQMGVGNQEEEEARFSFLKGGYVEDFENQACISSENVEEERETLALVNATEKALQLRNNSNVLMKGSARSGAEFLANRSYQGLNMSSENTSPEPYLIGRRGR

SEQ ID NO: 31956 - protein, 329 aa, Bacteroides fragilis YCH46
MDKIIGLGNALVDVLATLKDDTLLDEMGLPKGSMQLIDDAKLQQINERFSQMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 31957 - protein, 186 aa, Oryza sativa (japonica cultivar-group)
MSLAQYGALGWDIASISFGLSKPQLCCYILTAAIRFVMRTRDVFNVAVSVHKNIQQRDLEVGRNLGNMILRWLDRMKPSAQIRPHPPGPPNGSSEQFRHLSSTSKSTGAQKPTSKTLPCDGGKVLFSPLNIRPKSFPVLPTMMQPTRISASSQCRRISYSSFPSATAKRNDFMQGVFRKDIAQLMV

SEQ ID NO: 31958 - protein, 477 aa, Oryza sativa (indica cultivar-group)
MDPTAPNSGDANGGAAADATAPSNTTVTLPPLTLRDVPLLPSAAAATDTIPNPISRHPYFHPPATFYISPGDVSLRHAFFDLASASPSPLVAYRRAGPRAGVAVDPARARAAVVTCGGLCPGLNTVLRELVVGLRELYGVRDVFGVAAGYRGFYGPDADHARLDLAAVDDWHKKGGTVLKTTRGGFDLNKIVDGIVARGYTQVYAIGGDGTMRGAVAIFNEFKRRGLNISITGIPKTVDNDIGIIDRSFGFQTAVEIAQQAIDAAHVEAVSAVNGIGLVKLMGRSTGHIALHATLSSRDVDCCLIPEVDFYLEGKGGLFEFLYERIKQKGHAVVVVAEGAGQELIPRTDDQKREQDESGNIVFLDVGPWLKSELGKWWKREHPSELFTVKYIDPTYMIRAVPANATDNLYCTLLAHSAIHGIMAGYTGFVPGPINGNYSYIPLEDVAVAKNPVDVNDHKWAWVRSVTNQPDFMKPKY

SEQ ID NO: 31959 - protein, 287 aa, Burkholderia xenovorans LB400
MSAGDSLDRYAVIGNPVGHSKSPFIHGRFAEQTGEAIEYGRLLAPVDAFVPTVRAFIEAGGRGLNVTVPFKLEACTFADTLSPRAAAAGAVNTLRVDANGIYGDNTDGFGLVRDIEVNLGVSLKGARILLLGAGGAARGVVLPILERAPHTLTIINRTAQKAEALVDQFAQAARDAACRLGGGSARAIEAGAYDVIVNATAGSLDASLPECDDRAFGSGTLAYDMMYGAHPTVFMEHARKLGARGADGLGMLVEQAAESFYVWRGVRPDGAPVLAELRALLTAPSHA

SEQ ID NO: 31960 - protein, 192 aa, Aspergillus oryzae
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDSAVREKLSRQKMQPIRKEDGDRMAKELGAVKYVECSALTQYKLKDVFDEAIVAALEPAPKKSKKCVLL

SEQ ID NO: 31961 - protein, 608 aa, Legionella pneumophila subsp. pneumophila str. Philadelphia 1
MFVRICAMFGFVSDLLTAAVSSLDELLQDTPAHQIILGTAALYFLYNQYHNPSISRWYRSRNNASMKQRIIDSAYALAKNLPGVNQIIEKELNKELSSTREKLRIQRSGMTLREEIPEEGLSPQDILSAFDVDVEKCHFDFLSVTNDSPEREFLVERGDGKDSGALYAIHPKELTELLKEVYGATALTNPLHDKWPRINAMQAEVIRWCQNLFHGSKECYGLLTHGGTTSIIEAMAAYVIRARAKGIDYPEIVVPETAHAAFKKAAELTGAILITVPVDKKTGAVNPKVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIITLRNAIQKELTTLLEEGNGLTSEDIYVYGNPQWSILGFRSNTCNAHFIADELEKRGWKLNLLQNPDGFHLCLTHVHTLVKGFETQFIKDLREAVIDVKNYPPGKKPSGNVKVYGAVGMMPIELQREICKQYQKARLNYTSASPGSLRIFTNVPVEEDEGLRNRKTEKYKV

SEQ ID NO: 31962 - protein, 203 aa, Sinorhizobium meliloti 1021
MPSKNGPLRIGIGGPVGSGKTALTDKLCKAMREKYSVAVVTNDIYTKEDAEALVRMQALPSERIVGVETGGCPHTAIREDASINLQAIADLNRRIPDLDVVFIESGGDNLAATFSPDLADLTIYVISVCQGEEIPRKGGPGITRSDLLVINKKDLAPYVGADLGVMERDAARMRAEKPFVFSDMKRGDGVERIVEFLTVHGGL

SEQ ID NO: 31963 - protein, 402 aa, Triticum aestivum
MAKSGARKDAAQVRPSATSPPPQHSPGATASSFASRSPQLLFYPGAPTRSSASPSTPPHLYPPLMESSSANPTWRPMYTSAPEGLLSFGQLPPMNPYNFQPQPMHHHEQGYQNMENLHFVGASPHDPFSTPPPPPHSNVSSQSAPTKVDSKKKKRKVKSVDADESGARTAYRLPYTPEEHERLAGAWLECSLNPIDGNGKKSEQFWDDIAALYNTATPSNRKRDRNQLKTEWQRTKKRLAAFHGEWIAVMGVYHSGHNSHDLQKMALEKYERNYHQPFQHLTMWEKIKDDSKWLASYKNMMAKKGNMTETDLPSNMINLEAEERPKAGRDKAKAERAGKGKSGGISQELGERLDKFIEVNNQSKEERQKVIDSQVLLSNQQLETAKINSLKHIRNWLGQFVV

SEQ ID NO: 31964 - protein, 1091 aa, Oryza sativa
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVWSLFTDPGATALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 31965 - protein, 333 aa, Candidatus Kuenenia stuttgartiensis
MSVRIGINGFGRIGRNVFRVISKRNNIDVVAINDLADSKSLAMLLKYDSIHGRFDGSIQIKENALMVNDKEVRLLMEKDPAKLPWKSIGVDIVIESTGIFTSRSDCSKHLDAGAKKVLLSAPAKDKIDATIVVGVNNKDLRPEHKIVSNASCTTNCLAPLAKVLHDNFGIEKGLMTTIHAYTNDQRILDFMHKDIRRARAAAINIIPTTTGAAKAIGEVIPSLKGKLDGLAMRVPVPDGSVTDLVVMLAKEVDRDAINAAMKTAAEGDLKGILEYCGDPIVSSDIIGNPHSSIFDSALTYVIDKRMAKVISWYDNEWGFSNRMVDLIELMSRL

SEQ ID NO: 31966 - protein, 456 aa, Synechococcus sp. RS9916
MPQAFETGCDPLSPNRNLAPVTAGLDDQGRMTVGDCRLSDLAERYGTPLYVLDEAGIRAACRAYRTALECHYPGPSLAVYASKANSSLALSAIAASEGLGLDAVSAGELLTALKGGMPAERIVLHGNNKSDEELLLAYRNDVMIVADNQHDLDRLAVLVPAGERPARLMLRFTPGIECHTHEYIRTGHLDSKFGFDPDQLEPVLRHLATCGWAKVTGLHAHIGSQIFELNPHRDLAAVMADALKLARGLGHPVTDLNVGGGLGIRYVESDDPPSIDAWVQVVAEAVVAACRERSLDLPRLLCEPGRSLVASSGVTLYSIGSRKEVPGVRTYLSVDGGMSDNPRPITYQSLYTALLADRPQAEATESITLAGKHCESGDVLLNDLALPPSVSGDVLVVLATGAYNASMSSNYNRIPRPAAVLVHDGMAEVIQRRESSEDLLRYDTLPTRLAPGVPVG

SEQ ID NO: 31967 - protein, 146 aa, Brassica napus
MCIAVFLWQSHPLYPFLLFLNRDEYLNRATEALRWWQDGETLGGRDLVGGGTWLGCTRHGRIAFLTNFRETSSIPDAKSRGDLPLRFLQSHKSPAEFAQEIEKEASLYNGFNLVVAHVFSKSMFYVTNRPLSHGGQAAAAAAAAAR

SEQ ID NO: 31968 - protein, 398 aa, Salinibacter ruber DSM 13855
MHKLTLDDVDVRGQRVLIRVDFNVPLDTSEDGSPCVGDDTRIRAALPTIRHVLDHGGKAILVSHLGRPGGQPDPDLSLACVADHLGTLIEERVRFSSNTVGDTVEEVINGMSEGSVILLENTRFDAGEKANDEAFATALANLADVYVNDAFGAAHRAHASTAGVAEFMDVAALGRLMEDEIEALTRVRDDPAHPMVAILGGSKVSDKLGTIRALSETADHLLIGGAMSYTFLKVLGHEVGASRVEADRLDTAEDLYEQAEGTITLPTDHVVAEAPEADATASVVEGDIPAELMGLDIGPATIDAYRDRILGAATVVWNGPMGVFEVDPFADGTTAIAEAMADATDDGAFSVVGGGDSVSALTRSGCDDRISHVSTGGGALLTFLEGAPLPGVEALTDA

SEQ ID NO: 31969 - protein, 427 aa, Pseudomonas aeruginosa
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGSLTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHDELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 31970 - protein, 133 aa, Brassica napus
  misc_feature (2)..(3): Xaa can be any naturally occurring amino acid
  misc_feature (9)..(9): Xaa can be any naturally occurring amino acid
  misc_feature (12)..(12): Xaa can be any naturally occurring amino acid
  misc_feature (16)..(16): Xaa can be any naturally occurring amino acid
  misc_feature (21)..(21): Xaa can be any naturally occurring amino acid
  misc_feature (31)..(31): Xaa can be any naturally occurring amino acid
  misc_feature (35)..(35): Xaa can be any naturally occurring amino acid
  misc_feature (50)..(50): Xaa can be any naturally occurring amino acid
  misc_feature (53)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (62)..(62): Xaa can be any naturally occurring amino acid
  misc_feature (64)..(66): Xaa can be any naturally occurring amino acid
  misc_feature (69)..(69): Xaa can be any naturally occurring amino acid
  misc_feature (71)..(71): Xaa can be any naturally occurring amino acid
  misc_feature (73)..(73): Xaa can be any naturally occurring amino acid
  misc_feature (85)..(87): Xaa can be any naturally occurring amino acid
  misc_feature (90)..(90): Xaa can be any naturally occurring amino acid
MXXSMLSSXAAXTSPXQATMXVPFTGLKSSXAFPXTRKANNDITSIVSNXGRXSCMXVXPPXGXXXFEXLXYXPDLTKVELGKEXXXYFXRNKWISLNSQGKYVATPPPEWGNGEFPLLGPFSHVFRYPHPPS

SEQ ID NO: 31971 - protein, 414 aa, Zea mays
MVSDGARGLLGAYELGRTLGEGNFGKVKQARHRGSGGQFAVKIMERARVLSQRADEQICREIATLKLLAHPNVVRLHEVAASKTKIYMVLELVNGGELLDRIAASEGKLPEQEARRLFQQLVDGVSYCHEKGVCHRDLKLENVLVDRKGNIKISDFGLSALPQHLGNDGLLHTTCGSPNYIAPEVLQNRGYDGSLSDIWSCGVILYVMLVGHLPFDDRNIVVLYQKIFKGDAQIPEWLSPGARNLLRRILEPYPAERIAMAEIKAHPWFQEHYVPVLPPYDDDDDSVKQIGAGSKTTHHINAFQLIGMASSLDLSGFFEEEDVSQRKIRFTSAQPPEDLFAEIERSATDMGFHVHRGHSKLRLTRNCDRSKNQKNPMSSSSSSFLVCTEVFELSPSLYVVELNKSHGDPALYRQ

SEQ ID NO: 31972 - protein, 288 aa, Triticum aestivum
  misc_feature (84)..(84): Xaa can be any naturally occurring amino acid
  misc_feature (113)..(113): Xaa can be any naturally occurring amino acid
  misc_feature (131)..(131): Xaa can be any naturally occurring amino acid
MSDLRAPEHQVAGHRAAPDKLGPLVDGAGLFYKPLQALDRGEQELAFYTAFSAHPDVPPRIRDAFFPRFHGTRLLPTAASPGGXHPHLILDDLLKGLAAPSVTDIKIGACTWXPPRAPEPYVAKCLAKDPXSTSVLLGFRVSGVMVSDPSGAVWRPDRSELKGTDIPGVRRMLRRYVSSAGGDGGGEDCALAAAVYGGEGGVLAQLRELKAWFEVQTLFHFYSASILLSYDANAVTAPGGAPRVKLVDFAHVVESEGVIDHNFLGGLCSLIKFIDDIVSSDKAPPAQS

SEQ ID NO: 31973 - protein, 439 aa, Bacteroides fragilis YCH46
MKNTAKNFMFYVAFVASLGGLLFGFDTAVISGAEKSIQVVYDLSDFSHGFTIAIALIGTIIGAFVCSKPVEKHGRLKALKIIAFLYFVSAVGSAAIIDWYSFLFFRFAGGLAVGASSVVGPMYIAEISPSRWRGRFVAFFQFNIVLGIVLAYFSNYWIHGIAHDWQWMLGVEAIPAIAFALLLYTVPESPRWLVKQDREAEARHVIKKVSNADIEQEIHEIKESLVTIGASGEKLFQHKYRKPILYAFLIATFNQLSGINAILYYAPRIFEMSGVFTDSAMMQSIVIGLTNLTFTMIGMILIDQVGRKKLLYIGSIGMTLSLALVAKGFYQDAFSGYYMLICLMGFIAFFAISLGAVIWVLISEVFPNNVRSKGQVLGSMTHWVWSALLSWMFPVFIRTGGTFIFSFFAIMMFLSFFFALRLPETKNKSLEQIQKELTN

SEQ ID NO: 31974 - protein, 397 aa, Candidatus Kuenenia stuttgartiensis
MKKLFIKDLAVRKKKVMVRTDYNVPLDEDGNITDDTRIRATLPTINYLLDEEAKVIIASHLGRPVGANPKYSLKPVARRLQRFLTEKVKITLAEDCIGEEVKKQVEAMNYGDVLLLENLRFHPGEQKNDAGFAKELAGLCDLFVQDAFGNCHRNHASMVGIVRYVPAAAGFLIKKELDYFEKSVNDPIRPVIAILGGSKVSDKIKILENLAKKMDKIIIGGAMAFTFLKAQGIPVGKSLVEDSMIETANNLMDYTKKNGTKLYLPVDFVVAEKFDKTAETKVVPFQEIPERWIALDIGPATIKLFSAVLQDAKTILWNGPMGAFEIDAFSRGTYAMVDIVTSSHASTVVGGGDTDMAFHKAGKAHEVSFISTGGGAFLKLLEGGDLPGIASLTDKKI

SEQ ID NO: 31975 - protein, 430 aa, Zea mays
  misc_feature (265)..(265): Xaa can be any naturally occurring amino acid
WSPASSGPDSPLDPASGNKTKDIVRLNGVYQRILTSAGVTMIEGAGSLVDAHTVEVSQPDGSKQRYTAKHILIATGSRAQRVNIPGKDLAITSDEALSLEELPKRAVILGGGYIAVEFASIWRGMGAEVDLFYRKDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGPXVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNLSRNWYSGEMHPDNTLGSSRWVFLRHWDWTMY

SEQ ID NO: 31976 - protein, 679 aa, Schizosaccharomyces pombe 972h-
MSLLRIRKASLYGFSTVFILLQSYAVAYPLRAFRQNDGIGIAMNPSQDGGFVSAEKDSDFEYWMKLIISAVLILLGGVFAGLTIGLMGCDDLHLQVLEQSGDASERVHARKVLKLLRRGKHWVLVTLLLGNVIVNETLPIVFDSIIGGGWPAVLISTAMIVIFGEVIPQATCVRYGLSIGAKLEPIVLFMMYLLWPIAYPTALILDACLGESQSTMYKKSGLKTLVTLHRDLGIDKLNQDEVTIITAVLDLREKHAESIMTPIEDVFTLPMDRILDEDLIGEIICAGYSRIPVHKPGFPHDFIGMLLTKTLIGYDPDDKWPVGKFALATLPQTWPNTSCLDLLNYCQEGKSHMILISNSPGEPHGAIGVITLEDIIEELIGEEIIDETDVYIDVHKGLPRVGENNDFWNRMLHRSHLSTMAALHKSQRSHDLAANEHAPILNPKNSALNPRLVTNDRVKVKSPSLIQSSTGYGSMSQSPSRSDLPSKISRVNAELQAHGSQRSSIDVSKENKSSVADGPSSQAHNGPSTQPPEALPNGTDPSSSKTTENNGNQQSERTESADGKKDNSGSISSNSSKTFTGKRVRLGNVIESNVVSPDGTNRIVIEPFERSVDPNNADIVEMVERNGIVVPKVTVTSHEDDVDSVHNTPMSVSSTLSVKTSSSKVPRNKRKRRKGKSKK

SEQ ID NO: 31977 - protein, 175 aa, Glycine max
LEPRSHKKTDEDDEGHVSDKGEEDEEEESERKSRLGLNKRAGEDDEEGPRGGDHDLDDDDVEKGDDWEHEEIFTDDDEAVGNDPEEREDLAPEVPAPPEIKQDEEEEDEDNEEGEGLSKSGKELMKLLGKASGLNESYAQDDYDYDDDVDDDVGVPPVIATMHKDALKEEPIDNS

SEQ ID NO: 31978 - protein, 403 aa, Nostoc sp. PCC 7120
MSFDWITPADRIQQLPPYVFARLDELKAKAREQGIDLIDLGMGNPDGATPQPVVDAAIQALQDPKNHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALDRIKQAGIRYRPEALVSAPE

SEQ ID NO: 31979 - protein, 263 aa, Oryza sativa (japonica cultivar-group)
MPGRGARRRPDLTLPMPQRDAPTSLAVPLPLPPAATTTTSAPPAGGAMHPLASAGAAPPPAAGGAGTVNGRRVLDGRRIADERFLADVARQVLSGIAYLHRRHIVHRDIKPSNLLIDSARRVKIADFGVGRILNQTMDPCNSSVGTIAYMSPERINTDLNDGAYDGYAGDIWSFGLSILEFYMGKFPFGENLGKQGDWAALMCAICYSDPPEPPAAVSPEFRSFVGYCLQKNPAKRPSAAQLMQHPFVAGPQPQPLAAPPPSS

SEQ ID NO: 31980 - protein, 226 aa, Zea mays
GFGLIKRKRKDSFVRDRALVLRELHSAAQRESCIGQQEILERENLPRAETSIHGIVTNIDGCSFLFPERPDLKSVVLKEQPFSLQRETSMNKPFFMLLTLNFSDGCSCLSSSIGWPVDFQKRKDSFVRDRALVLRELYSAAQRESCIGQQEILERENLPRAETSIHGIVTNIVRYDTEDEKLAPPKNDLMNHSRSNPAKRHVEGTDCHSSLPKKLKYFLKDKKLNC

SEQ ID NO: 31981 - protein, 346 aa, Oryza sativa (indica cultivar-group)
MAAVVTNRRVILKRYVQTGLPSEDDMEVVTAKTTLAVPAGSEAVIVKNLYVSCDPYMRGRMTRHEMPSYVPDYVPGEVITNCGVMKVVSSGHPDFKDGDLVWGVTGWEEYTLVNNPKPYLHKINYPEFPLSYYTGVLGIAGLTAYGGFFEVSKPKKGDYVFVSAASGAVGQIVGQLAKITGCYVVGSAGSDEKVNLLKTKFGFHDAFNYKKELDLEGALKRCFPEGIDIYFDNVGGAMLDAVLPNMCKGGQITTCGMISQYNLELPDGVRNLFYLVANSLRMEGFLVSNYIAIYHRYEKEMAGYLREGKVVYVEDIVEGLEAAPSALIGLFTGRNVGKQLVAIARE

SEQ ID NO: 31982 - protein, 245 aa, Pseudomonas fluorescens
PGQAFLPMHWGDRFLKGGVNALTQPAFDPLSKQPELKHSGVRLEPVQLPWQLFALIEGNVQQHFDALRPLCEGFAYVSLSLTGRERPALLVRAAHTEAPDLQLLTRIDELLGLNDGPVMAYDDPRRSIGKRVKIEKGRITALRLAGETLARHWLQRLWLEGRADDQLRRWLLAPLSAPPGGAAASSKILCNCKNVSESAVCAGIGRGLDLDGLKQELDCGTQCGSCVPEIKRLLASTSLPIAISV

SEQ ID NO: 31983 - protein, 376 aa, Aspergillus oryzae
MGNEPSTLVDEDTPPSALEARTLEAVAKYIKAKDDCQIVVMVGAGISTSAGIPDFRSPETGIYANLAHLDLTDPEDVFDIGFFRENPRPFYALARELAPGRYRPTIAHSFVKLLYDKGLLMKHFTQNIDCLERLAGVPGDMIVEAHGSFANQHCIDCKAEYPEQLMKQSINEGEVPRCSQCNGLVKPDIVFFGEALPEEFFLNRTLPEQADLCIVMGTSLSVQPFASLPAFCRDGAPRVLINMERVGGLGSRPDDVLLLGDCDAGVRRFARALGWEQELESLWESTNPDKEGRDAEETPSQTRDERLRDEIERLTKEVDRTLGISDAYQQRVRQNLDRHSNGIEKKALTEERRRSYEGLAHVFPHLAREKKQPSVI

SEQ ID NO: 31984 - protein, 288 aa, Oryza sativa (indica cultivar-group)
MAMTTAVSNTRVILRRYMTWFPSEDEMEVTSYISDFVQGEEIFVWGMTGWQEYTVINNPESLFKINHPELPLSYYTGILGMPGLTAYAGFFEVPKPKKGEYVFISGASGAVGQVVGQLAKITGCYVVGSAGSDEKVNLLKSKFGFDDAFNYKKEQDLEAALRRCFPEGIDIYYENVGGKMLDAVLPNMRLGGRIVACGMISQYNLEQPEGVRNLYYIVTKRLRMEGFHVFDYYDRYYRFEEEMAGYLKEGKVSYVEDVVEGLDAAPAALIRLFTGCSVGKQLVAVARE

SEQ ID NO: 31985 - protein, 345 aa, Oryza sativa (indica cultivar-group)
MAATASNKRVILKRYVTGFLSEDDMEVVTTEAPPLAVPAGSEAVVVKNLYVSCDPYMRNRMTRHEMPSYVPDFVPGEVLANFGVMRVISSGHPDFKAGDLVWGITGWEEYTVINNPESLFRINHPKLPLSYYTGILGMPGLTAYAGFFEVSKPKKGDYVFISAASGAVGQIVGQLAKIIGCYVVGSAGSDEKVSLLKTKFGFNDAFNYRKEPDLKAALRRYFPEGIDIYFENVGGETLDAVLPNMRLGGRIAACGMISQYNLEWPEGVKNLFYIVTKRLRMEGFLVFDFYDKYYQFEEEMARYLKEGKVAYVEDVVEGLDAAPAALIKLFTGRNVGKQLVAIARE

SEQ ID NO: 31986 - protein, 252 aa, Oryza sativa (indica cultivar-group)
MEPLPLGFGDGLDATLLSSLWAFQDDLQPQESMEELKQSLMATTLELDAAKEELKKKEQSIAKLADLVRHVAKERDDARDQLQPVTDSDGGSLVSSPAADNPFFDPVTSSDKRCCAIASPPPAAKQQHAAAAGADAVLDMLAMKKPLPQRGRLLQSVMEAGPLLQNLLVAGLLPRWRNPPPVALDTLPVGVRAGGAVYPGASLSPGITSSAAVIGYGGGANACGKRPMAAAAAAVAASCSPAAFSAKRHRLH

SEQ ID NO: 31987 - protein, 261 aa, Oryza sativa (indica cultivar-group)
MKVISSGHQDFNAGDLVWGITGWEEYTVIDNPETLFKINHPELPLSYYTGILGMPGLTAYGGFFEVAKPKKGEYVFISSAFGAVGQIVGQLAKITGCYVVGSAGSDEKVNLLKTKFGFDDAFNYKKELDLEATLKRCFPDGIDIYFENVGGAMLDAVLPNMRVAGRIAACGMISQYNLEQPEGVYNTICIVTKRLRMQGFLVFDFYDKYYQIEEQIARYLKEGKVAYTEDVVEGLDAAPAALVKLFTSSSIGKQLVAVARE

SEQ ID NO: 31988 - protein, 582 aa, Oryza sativa
  misc_feature (566)..(566): Xaa can be any naturally occurring amino acid
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRRQNSPRLDSDSPADMNGFTRRQSLPSSTNSKXNPHSPHTQGPIYFKFD

SEQ ID NO: 31989 - protein, 707 aa, Salinibacter ruber DSM 13855
MQALDGGRIGTSTVSIALLDAETESARAYATRLTDLVELEREEEMRRHEREIETLSGREREDRGRALLRMRGRDEGEGLGGHHVKLMREQKGQPLPDHEIRVGDLVMISKTDPLRDDNPTGTVTQVTNYSITASFDPKPDGWVFGKGLRPDRREEVVSGLRVDLYVNDIPYQRMQDALAKLPTADGALKQLRDVSTGVASPAATEPAPIDDWHNSALNDAQRRAVRKAVATDDVHLIHGPPGTGKTTTATEVLQQCVDRGESVLATAASNTAVDNVVAFLAEQGTDVVRLGHPARVNDRLRTHTLDAQIEDTDTHRRSQQKREKAFAVLDRQEDLTAPSGRWRRGMSDRKIKERAEQGRGSRGVPPERIEEMAAWLALQERADALFDEAEALEQEAIDEVLGAADVVCSTNSTAGSDLLDGHTFDTLVIDEATQATAPSCWIPMTHARRAVLVGDHKQLPPTIQNQEAARRGLRHTLFERLAHHHETAPEAPGSIRSLLRRQYRMHETIMGFPNRTFYDGRLEADDTARHRTLADLGVPEHALPADERRAILDPEASLVFVDTSGIDAPEHQRSGSHSRENPREADLIAQLTTALLEAGVAPSAIAVISPYDDQVDRIDRALAPDGPETDTVDGFQGREKEIVLLSLVHSNDRGAIGFLDEPRRFNVAVTRAERKAVVVGDASTVAAADVLGAFVRYAETTGRAVPL

SEQ ID NO: 31990 - protein, 259 aa, Picea glauca
MVESSREENVYMAKLAEQAERYEEMVEFMEKVTKGVEVEELTVEERNLLSVAYKNVIGARRASWRIISSIEQKEESRGNDEHVVTIREYRSKVESELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFGEAIAELDTLGEDSYKDSTLIMQLLRDNLTLWTSDMQEDAGDEIKETSKRDEGEEQ

SEQ ID NO: 31991 - protein, 721 aa, Shewanella oneidensis MR-1
MSSLESSSESIAVNILGQTNRRVARAQAQAFIDTLKPLQHPNSQKLYLQGSRADLRVGMRQILQTDTRIGGRAAAPNVEKNPPIPVYDCAGPYSDPAAQINVRQGLAKLRLPWIIERQDTEVLDCTTSDFTQQRLKDDGLDHLRFEAGSSAIIRPRRALPGKRVSQLHYARQGIITPEMEYVAIRENMALADVQDEILNRRGQGESFGAVIGKPITPEFVRDEIARGRAIIPLNINHPEAEPMTIGRNFLVKVNANIGNSAVTSSIEEEVEKLVWSTRWGADTVMDLSTGRYIHETREWIIRNSPVPIGTVPIYQALEKVNGVAEHLTWEVFRDTLIEQAEQGVDYFTIHAGVLLRYVPMTAKRVTGIVSRGGSIMAKWCLSHHQENFLYTHFREICELCVAYDVSLSLGDGMRPGSIADANDEAQFAELETLGELVNIAWEYDVQTIIEGPGHIPMQLIKENMDKQLIHCAEAPFYTLGPQITDIAPGYDHFTSGIGAAMIAWYGCAMLCYVTPKEHLGLPNKQDVKQGLIAYKIAAHAADIAKGHPGAQIRDNALSKARFEFRWEDQYNLGLDPDTARAYHDESLPQESAKVAHFCSMCGPKFCSMKITQDVRDYAASLEADAKAQSLAAETDGALAPLGSVQQVKSGHSELSHIDAELNYIAVKTQDELTAAMAQKSAEFAALGAKLYLPLDNANAANELAKHKDGAKLQSKTQVAKV

SEQ ID NO: 31992 - protein, 663 aa, Escherichia coli K12
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKELL

SEQ ID NO: 31993 - protein, 532 aa, Coprinopsis cinerea okayama7#130
MTEFRNPIPLPHIPDDLTIPQFMLREITGRPRRPRNVPFFIEDATGRAIGYEEAHHRTYSIANALSLKWKIGRGDVVCVFSPNHIDYAPVVPSNPSYTVEELKYQLDATKAKLIVAHPLCFSTALSAADATHLSGTNSIVLFDPLPGESLPTLNELVEFGARRPENYCAVRFKPGEARSTVALLLVYSNFELFQAVAISHYSVIANVIQMATHYNVNDPNNPSKTLSPGDVAIAVLPFFHIYGLVVTMHFLLFASLTLVVVPKFNLDDYLRSIVQHSVTHLFVVPPQVVLLCKHPEVRKYDLSRVKFCFSGAAPLGGELMQQLTKILPNAVIGQGYGLTETCTTISMVPPNVKLGRIGSAGQILPGITARVVKEDGSLASEGEVGELVVTGPSMSLGYLNNPKATAETYVDGWVRTGDEVVIKDNEEIMKVRGFQVAPAELEAHLLLHPDVADACVVPKADEYSGEVPLAYVVLSRPATERIGNNPRKAEDLKKAIAKHVADVKVPYKRLAGGVEFIDAIPKNPSGKIVRVL

SEQ ID NO: 31994 - protein, 529 aa, Picrophilus torridus DSM 9790
MIVLGLEGTAHTISAGIVDEKSILSNVSSTYVPEHGGIHPREAAVHHADKIYDVIKRSFDNAGLKPEDLDLIAFSMGPGLGPCLRVVSTAARALSIKYSKPLLGVNHPLGHVEIGRKLSGARDPIMLYISGGNTQVIAHLNGRYRVLGETMDIGLGNMLDKFARDLGIPFPGGPVIERMALDGKDLLELPYSVKGMDTSFSGIYTAAKRYLSLGKNKNDICYSLQETSFSMVVEVLERAMYYTNKNEILLAGGVARNDRLRSMVNDMARDSGYKAYLTDKEYCMDNGAMIAQAGMLMYMHGARQDIMETRINQRFRIDEVPAPWIKDENSISFKDKGAESIITNGEFYGRSVVFKKRPEKSYRDKRLDLKIRLERMKNEFYIMYYLHKTGNAPIVYDFDRFDMVLTIERINGLTMNDYFKSKYDENVIRMIADAVAKMHGLRISHGDLTPNNIIISDKIYFIDTSMGHLRCSDEDIADDLFLLYESMKSLYVNGHEMIKHFENEYSKNVEDYNYYKELIKKIESRRRYV

SEQ ID NO: 31995 - protein, 1466 aa, Aspergillus nidulans FGSC A4
MGVPDELPPGSSETDTIVSSSQPTNRSPMDLISEAESLNLRRIATNQSKAQCRPGSAAVPSHDNPPNDDLEDATLDPNSASFSLEKWLRAAVSDASQHGLSTPSGGILFRNLTVSGSGSALQLQPTVGSVLTAPLRFASLLRHRRIEPRRILHGFDGVMKTGELLLVLGRPGAGCSTFLKTVCGETNGLHIDADSVLHYNGVSQQRMMKEFKGEVVYNQEVDKHFPHLTVRQTLEFAAAARTPAHRFQNMSRDEFASYAASVVMAIFGLSHTHNTKVGNDFVRGVSGGERKRVSIAEMALAMTPFAAWDNSSRGLDSATALKFVQALRLSADLAGAAHAVAIYQASQSIYEVFDKVTVLYEGRMIFFGPTGTAKEYFERMGWVCPARQTTGDFLTSITNPLERKARAGMEDVVPKTPKDFEIYWRQSPEYKTLLGEMTEFETQHPTGNDEQASAELRARKENSQSRNSRAASPYILSIPMQIKLNTKRAYQRIWNDMSSTMSTVVGQIVIALITGSVFYDSPNTTAGFQSKGGTLFYAVLLNALTAMSEITSLYSQRPIVEKQASYAFYHPATEAIAGVVSDVPVKFLLAVAFNVIMYFLANLRREPAQFFIYFLMSFTVMFVMSAVFRTMAAVTKNAAQAMGLAGVLMLALVVYTGYVLPVPSMHPWFEWIHYLNPIYYAFEAMIANEFHGRDFDCIAFVPSYADLDGDSFSCSSLGSVAGERMVSGDSYINFNYTYTYSHVWRNFGVLLAFLIGFMAIYFLASELNSSTTSTAEALVFRRGHVPEYMRPGYTRPTDEEKAVTQSDIKPSSPSPTNTDLPLPPQRDIFTWKDISYDIEIKGEPRRLLDDVSGWVKPGTLTALMGVSGAGKTTLLDVLAHRTTMGVITGDMFVNGKGLDASFQRKTGYVQQQDLHLETATVRESLRFSALLRQPASVSIREKHDYVESVIEMLGMGDFAEAVVGTPGEGLNVEQRKLLTIGVELAAKPKLLLFLDEPTSGLDSQSSWAICTFLRKLADSGQAVLCTIHQPSAILFQEFDQLLFLAKGGKTVYFGPIGPNSRTLLDYFESNGARKCDEAENPAEYMIEVVNAEVNDRGTDWFDVWKGSKECQAVKEEIERIHEKKRGTAGAIEETDDGSTKSEFAMPFWFQLYVVTVRVFQQYWRMPEYIISKGALAIVAGLFIGFSFYDAKTSLAGLQTLVFSLFMVCALFAPLVNQIMPLFITQRSLYEVRERPSKAYSWKAFLIANILVEIPYQVLMGILTFVCYYYPVVGSSQGPDREGLVLLFCIQFYVYASTFAHMCIAAMPNAETASPIVILLFSMCLTFCGVMQPPDALPGFWIFMYRVSPFTYWVAGMATTQVHGREVVCGENELSIFDPPTNQTCGQYMERYISVAGGQVLNPSATAGCEYCSLTVADEYLAASQIYWSDRWRNFGLIWVYIGFNIFVATAVYYLFRVKKWNGRRKK

SEQ ID NO: 31996 - protein, 583 aa, Aspergillus oryzae
MNPLDLYKANKSIFLRSIDDPAIARQYTEHKAHTTVARFSPSGFYVASGDVTGLVRVWDCVGEGHTKGEYSIVNGRINDLAWDGDSQRIIAVGDGKQRYGHCITWDSGNTVGEIYGHTQQINSVSIRQQRPLRAAAAGDDKNLVFYHGAPFKFNTGIRDKHTNYIYGVGFSPDGSTLVSVGADRRIWLYDGKTGEPRGQIGEGEHKGSIFSVSWSKDSRKFVTASADKTVKVWDVEAGKVSQTWYIGGEGSTDVNDQQVGVVWPPGRSDNLLISLSLGGNLNYLAEGTPEPRQVIQGHQKNITSLTQSHHGSDNGTLWAGSFDGRVCSWDVPTGTAAEVDGESHSAYIAGLAPMQEGNGRIYSVAWDDTIRSMDVGTKTYTGSSSKLSGQPKGIAAAAAVLVGTSESVEIYKDGQKIGDFKSKFPITTVAAHGNTAAIGGDDSTVQICEISGATLIPKTDIKASRNPVSALAFSPNGSLLAVGDSRGRVLVYNVADATLVTDRWTAHTSRITSIAWNENGTHVVSGALDTNIFVWNLANPGEWLQATNAHKEGVNGVAWVSGSKIASAGADAAVKLWKVEGLE

SEQ ID NO: 31997 - protein, 614 aa, uncultured archaeon GZfos18F2
MAHARLSIIDLAGGDQPIHNEDRSIWIVFNGEIFNYPELRKELKSRGHRFYTRSDTEVLVHLYEDHGPEFIHELNGQFAIALWDVRKKQLLLARDRMGIRPLFYFEKAGRLVFASEIKGLLADDRVPRTLDLKALSDIFTCWSPFGALTPFESVRQLLPGHYAMFSSNGMQIRSYWQPVFSAPPSKERSLDDWTEELNGLLYDAARIRLRADVPVGAYLSGGLDSTYISSLVKRSFNNRLCTFSVGFTDERFDETSFQEKAVQSLETDHRIVRCSERDIGKVFPQVIWHTETPILRTAPAPLFMLSGLVRENNFKVVLTGEGADEVFAGYNIFKEDRVRRFWARQPDSKLRPLLLERLYPYIFSRKNSRTRVFLENFFRKSLIQVDSPCYSHLIRWNNTALLKAFFSDELQAMAGKPPDFEERFISTLPSDFMSWDPLSRSQYTEMTIFLANYLLSSQGDRMAMGHSVEGRFPFLDHRVVEFACSMPPEYRLNGLKEKYILKHASRDLIPPELRRRPKQPYRAPISRCFFGKGSPDYVGELLSENAIRRAGYFHPKKVGRLVDKCQKQEGHLASERENMAVAGILSTQLLDHLFLRNFPPHPIQEPENVRVFGL

SEQ ID NO: 31998 - protein, 485 aa, Oryza sativa
MAAAAAAASATAAISGALLPHAVACHRLPPRPQLLAVSSSFRRLSLTASPRRASHLVPRADASAEAGEPEPAAEAEAEAVAASTDAEVEEGEAEAAVAVAEEEQEEEDEPPPPSKPPVKFGEIIGILNKQFIEEAEKVKTLPDLRPGDIIELRMQRPNKRRLSLFKGIIIAKHKSGVHTTIRVRRIIAGVGVEITFPILRYSPRIKEIKVIRHKKVIPCLIVGKMIGTSSASSWKERPDFTLNEDNEGKGVAMGGGGTLISIYPEDLTFLFELDKPCYCNLKVVNNSEHHVAFKVKTTSPRKYFVRPNANIVQPWDSCTITITLQAQKDYPQDMQCKDKFLIQSTRVAASTDMDEIPPDTFNKEVDKVIEEIKLKVVYTVPSGSSDDSGITSLGSRSFKSLSDDFTMLKNASIEEIQTIQRLKDERDNMLQQNQQMQRELVMIRRRRSRKSDTGFSLTFAAFVGLIGLLVGLLMSLIFSSPQPAA

SEQ ID NO: 31999 - protein, 389 aa, Escherichia coli K12
MSDTTILQNSTHVIKPKKSVALSGVPAGNTALCTVGKSGNDLHYRGYDILDLAKHCEFEEVAHLLIHGKLPTRDELAAYKTKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPSQSWEKAMHISLVLYAEHEFNASTFTSRVIAGTGSDMYSAIIGAIGALRGPKHGGANEVSLEIQQRYETPDEAEADIRKRVENKEVVIGFGHPVYTIADPRHQVIKRVAKQLSQEGGSLKMYNIADRLETVMWESKKMFPNLDWFSAVSYNMMGVPTEMFTPLFVIARVTGWAAHIIEQRQDNKIIRPSANYVGPEDRPFVALDKRQ

SEQ ID NO: 32000 - protein, 499 aa, Oryza sativa
DFSSARFPLHHCNLLITHTPSKHSLSLASSLHHKKKLASQETEDRSRFRIEIITSSWSSIMGDHQMMHAAPAAMYNGGGGGGTTSSHGVWWSNAVGVPAAATCSTTTELAGYTAWSSALAAGYDGMVADNGGKQAKSTTTASSESPGNNSSVTFQEPASIPDPAAVAAVPQPGLAGFTDWTQPFMNNGAGLHEFLQDGHHDMSASSLMNHSSNNLALQQAGHHHELLSSFGSDLLLSPTSPYGGFQSSLLRSLMEPTAKQQQQQPALAGLQQYHQYQQQMGHAPAAAAKFAQAVGARDSLQFTNDAPFWNPSAGFGMPAAVAVAAAAAQDQASVRSAKRSSPAPPRAAATLALKTAMEGVGDSSSVITKKETAFKKPRLETPSPLPTFKVRKEKLGDRITALQQLVSPFGKTDTASVLHETIEYIKFLHDQVGALSAPYLKNGAHQVPHLKNSSPDKSKHGEISLKGRGLCLVPISSTFAVASEVPVELWTPFGANFIR

SEQ ID NO: 32001 - protein, 415 aa, Oryza sativa
MNRGEFQSSLVQQMIWSGSSTGTATGVGGGGGAGSLMGSLKPCHEDQEASPNMPSLSSPSLIFSQQFQHSSPGLVPMNGAAGAAASLPSLHDGGGGGHESSMPESWSQLLLGGLAGDQERYSATAALLSKGLENWGDHAAAAAASACMVGGMKEEGSMAQAAATAAAAAYSFYGSHLAGDHQHEIQAAAAGGGASNKSQLSQMLMASSPRSCITTSLGSNMLDFSNTAAPPELRSHHHNSDNSSECNSTATGSALKKARVQASSSAQSTLKVRKERLGDRITALHQIVSPFGKTDTASVLQETIGYIRFLLSQIEALSYPYMGDANGTGPMQNGPVGERNPGLFPEYPGQLLNHNGNTGAQQPAAQPEQQGANDDGKKDLRSRGLCLVPVSCTSHFGGDNAADYWAPAPLGGILR

SEQ ID NO: 32002 - protein, 564 aa, Oryza sativa (japonica cultivar-group)
MEGTGEMREVGRETLHGGVVQSVSETDEYKEKTIDSEKDGQFRVQPRWRKFLAHVGPGALVAIGFLDPSNLETDMQAGADFKYELLWVILVGMVFALLIQTLAANLGVKTGRHLAELCREEYPHYVNIFLWIIAELAVISDDIPEVLGTAFAFNILLKIPVWAGVILTVFSTLLLLGVQRFGARKLEFIIAAFMFTMAACFFGELSYLRPSAGEVVKGMFVPSLQGKGAAANAIALFGAIITPYNLFLHSALVLSRKTPRSDKSIRAACRYFLIECSLAFIVAFLINVSVVVVAGSICNANNLSPADANTCGDLTLQSTPLLLRNVLGRSSSVVYAVALLASGQSTTISCTFAGQVIMQGFLDMKMKNWVRNLITRVIAIAPSLIVSIVSGPSGAGKLIILSSEFALLLQKQQYPEFLIWIQMILSFELPFALIPLLKFCNSSKKVGPLKESIYTVVIAWILSFALIVVNTYFLVWTYVDWLVHNNLPKYANGLISVVVFALMAAYLVAVVYLTFRKDTVATYVPVPERAQAQVEAGGTPVVDASAADEDQPAPYRKDLADASM

SEQ ID NO: 32003 - protein, 445 aa, Aspergillus oryzae
MFIGGLNWETTDQSLKDYFSQFGEVQECTVMRDSATGRSRGFGFLTFRDPKTVNTVMVKEHYLDGKIIDPKRAIPRDEQEKTSKIFVGGVSQEANEQDFKQFFMQFGRVVDATLMIDKDTGRPRGFGFVTFDSEAAVEAALSRPLEILGKPIEVKKAQPRGNLRDEEDRRNRRGRDGFREGAQIGSDGSQQQGSQGPAGMPGGLTPQMMAQYWQRMQQYFALMQQQMAVAAQGQGMGAMGMGGMNPAMMQQMQMKQMQQMQMGNSQQQGSMSPPSQSQTPQMQNMMNSTMMQQMQQMQNQGQGGQMGNAINIGSSSPGNVSMSGNYSGPRGGPGYNAHEQIAFEQQKYEQQQARRAMENRAFSPYQQGGPTSWEGMYDEVPQPNIPTGPQAMNRAGSMGRGPTPQPQSAAPANAPTGPKNAGKPGANYRGGGRGGHRGFHPYARG

SEQ ID NO: 32004 - protein, 330 aa, Burkholderia xenovorans LB400
MSSTATPSSNAASLLAPIAEDMQQVNRVIRHRLASDVMLINQISEYIISAGGKRLRPALLLLVAGALGETTGHRHELAAVVEFIHTATLLHDDVVDESDLRRGRQTANALFGNAASVLVGDFLYSRSFQMMVGVGKMRVMEILSEATNIISEGEVLQLLNMHDADVDEARYMQVIRYKTAKLFEAAAQLGAVLAGSDAKTEAAAAEFGRRIGTAFQIMDDWLDYTGTAESMGKNAGDDLREGKPTLPLIYLIERGTPEQSALAREAIEQGGTDRFDTIFEAITRSGALDHTLECAKQEAQAAAAAISSFPDSIFKDSLLELCSYSTARQS

SEQ ID NO: 32005 - protein, 621 aa, Listeria monocytogenes str. 1/2a F6854
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSLLNNVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 32006 - protein, 719 aa, Aspergillus nidulans FGSC A4
MAPGLELLPKTTALPTKAANAINNAVYGRDSDVKFESAEKHQRVLNVFRAFIADLVQQYGDGHPGAPMGMAAIGIALWKYVMKYSPTNCNYFNRDRFVLSNGHACLWQYLFMHLVGVKSMTLEQLKSYHSTDSSSLCPGHPEIENEGVEVTTGPLGQGVANAVGLAMATKNLAATYNKPGYEVVNNMTWCMVGDACLQEGVGLEALSLAGHWRLNNLCVIFDNNNVTCDGTADVANTEDINTKMRATGFKVIDVYDGDSDVVAITNALLAARSSTKPTFINIRTTIGVGSKQAGTADAHGAALGVDEVAKIKRAFGLNPEEHFHIPQDVYDFFSDLPSRGKTHEAEWHAAVAAYREAEPVLASEFDLRVAGKMPADWTKYKLGQNVKNFLVGTADLTPSVNVAYKNKVDFQSPDLKTACGMSGNYAGRYIHYGIREHAMCAISNGLAAFNKGTFIPITSTYLVFHLYAAAAVRMAALQGLHQIHIATHDSIGVGENGPTHQPIAVPALYRAMPNILFIRPCDAEETVGAYIAAIQHDTTPSVLALSRQNLTQYPAHSSREGVQKGAYVFVEEENFDVTLLSVGSEMAYTMAAREILAAEHGIKARVVSFPCARLFELQSREYKHSVLKPRAGKPAVAIEAYPSVGWERYADAAIAQNQFGKSLPCKEVYEHFGFSGKIIADKVKGLVDEVRRDGVEVLRGDFRDLNGGPSVGVEHPNVP

SEQ ID NO: 32007 - protein, 356 aa, Escherichia coli O157:H7 EDL933
MMSQKYLFIDRDGTLISEPPSDFQVDRFDKLAFEPGVIPQLLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 32008 - protein, 203 aa, Escherichia coli O157:H7 EDL933
MLTEQQRRELDWEKTDGLMPVIVQHAVSGEVLMLGYMNPEALDKTIESGKVTFFSRTKQRLWTKGETSGNFLNVVNIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQDLDLTTVIENLRKRHQ

SEQ ID NO: 32009 - protein, 710 aa, Arabidopsis thaliana
MVGGGGGSSGRGGGSGSGSSKQQRGFSMNPKDYKLMEEIGHGASAVVYRAIYLPTNEVVAIKCLDLDRCNSNLDDIRRESQTMSLIDHPNVIKSFCSFSVDHSLWVVMPFMAQGSCLHLMKTAYSDGFEESAICCVLKETLKALDYLHRQGHIHRDVKAGNILLDDNGEIKLGDFGVSACLFDNGDRQRARNTFVGTPCWMAPEVLQPGNGYNSKADIWSFGITALELAHGHAPFSKYPPMKVLLMTIQNAPPGLDYDRDKKFSKRTFSCAQSFKEMVAMCLVKDQTKRPTAEKLLKHSCFKHTKPPEQTVKILFSDLPPLWTRVKSLQDKDAQQLALKRMATADEEAISQSEYQRGVSAWNFDVRDLKTQASLVNDREQVFDSLQLYENMNGKEKVSNTEVEEPTCKEKFTFVTTTSSLERMSPNSEHDIPEAKVKPLRRQSQSGPLTSRTVLSHSASEKSHIFERSESEPQTAPTVRRAPSFSGPLNLSTRASSNSLSAPIKYSGGFRDSLDDKSKANLVQKGRFSVTSGNVDLAKPTAQPQTIKEHSSHPTSSSPIMPQLQHLFQQNSIQQDLIMNLLNSLQPVEATEGSQSGKLPPLPRSDSNGNVEPVASERERLLLSSISDLRASFNCQNLQAGRLNGGTRYREIKIQPTATEIESIHGSRTLSVTRGKATLETLNCTEPVGERVKSLLVITVITRQELRDSEA

SEQ ID NO: 32010 - protein, 197 aa, Synechococcus elongatus PCC 7942
MTHATDVLTLARWLAADFSNQAQAFENPPFFAHIRVCMRPLALEVLDGLSLYVEQAYDLDVNQPYRARVLKLVPAGDHIEIENFRVIDGEDLFGASRDRDRLAKLTRDRLEKLPGCTFITHWTGNGFKGVVEPGKGCIVERKGQATYLESEFEIDDEKMISLDRGRHPETDEQVWGSVAGPFHFLRWHSFADEVPTP

SEQ ID NO: 32011 - protein, 461 aa, Solibacter usitatus Ellin6076
MRTDWVAKRKNDPIRTQMHYARKGIITEEMHYIAKRESISPELIRSEVARGRMIIPANVNHANLEPMCIGVASKCKINSNIGNSSVVSDIAGELEKLEYSVKYGADTVMDLSTGGDIPAIRKAIIGASPIPIGTVPIYEALSRVRRVEDLSAQVMLEVIEEQAEQGVDYMTIHAGILVQHIPLTTKRVTGIVSRGGSILAEWMVKNHKQNFLYECFEDICKILQKHDVSFSLGDGLRPGSIADASDAAQFAELKTLGELTQVAWKHDVQTMIEGPGHIPMDQIEMQVIKEKELCFEAPFYTLGPLVTDIAPGYDHITSAIGAAMIGWYGASMLCYVTPKEHLGLPNREDVKAGIIAYKIAAHAADIARHRPGVRDRDDALSRARYRFDWKEQFALSLDPETARSMHDETLPEDGFKDAHFCSMCGPKFCSMNISAKVESFTADDAAAVLSGAAPESLVNIE

SEQ ID NO: 32012 - protein, 513 aa, Coprinopsis cinerea okayama7#130
MSKRPADPSTSTQNADGQPFAKAPLSANRREVAANDEMGEFEDAWEDEVESDEEVVDAEAHDEDGMDVDGVMPAIEESEEPAPPPKVFVPGLHTLGKDEVLEADESVYIMRHAMRVNWPCLSFDVLRDNLGDERRRLPATAYIVAGTQADEMKKNEIVIYKMSSLHRTQRDGDGSDVEDDEDDEDDLDEDPIIEFRSIPHFGGVNRIRAQPLPPTTPLPPVSQPYYVASWAETGKVHIWDVRPLIESIDVPGYSYEKSRVQTPAFTINSHGRAEGFAMDWAASGPSSLRLLTGDIHSKIYLTTVTPTGFNALSQPFTSHTSSVEDIQWSPTEPTVFASCSADRTVQIWDVRTKGRKSVAGIDPAHEADVNVISWNKLTSYLLLSGGDEGGIKVWDLRNVKQKGSTGPTPSPVASFNWHSAPITSIEWHPSEDSVFAASGADDQVTLWDLAVEKDADEAGMDDVPEGGKDIPPQLLFQHLGQKDIKELHWHPQIPGTVISTAFDGFNIFKTFNM

SEQ ID NO: 32013 - protein, 174 aa, Synechococcus sp. RS9916
MLTMHAVLFSSLSPAAQLLDNGVLAWGLVACGLAQLSKLLIELVLHRRWRPAVLIETGGMPSSHSALVTGTAAGVGWQCGFNDPLFALAATVAFVVMYDASGIRRAAGFTAARVNALPDSAWEETPAKPLKETLGHSRLEVLVGSLLGPAIALPGLAWAGSPLELAHRIGQAIG

SEQ ID NO: 32014 - protein, 739 aa, Oryza sativa
  misc_feature (126)..(126): Xaa can be any naturally occurring amino acid
MEVADLENPTSRSSSQKSSRRSGSRRSQKSAGQQSSPTVFPEKKGKSKSSRQKHLVFDNKDSKKAKNNEQKNDVVDEKSNFSGYEIYSGKLFFDKKNRITGDQISANGKADISDVRLTSKALIWGXVLLSLEDVISVSYSSGVQHFIVHAYPSKKYLFGKTHRVRKDLRFIAPTVEEAISWVTCFAEQNIYVNMLPLPPTSSTEQDLDGPLSGALFDHPPIKCRTPPRILVILNPRSGHGRSCKVFHDKAEPIFKVPSDTLIMQASTYCSALAGFHMEVVKTTHAGHAKSLASTFDFSAFPDGIVCVGGDGIVNEVFNGLLSRSDRAEAVSIPVGIIPAGSDNSLVWTVLGVKDPISASLLIVKGGFTALDILSVEWIQSGLIHFGTTVSYYGFISDVLELSEKYQKKFGPLRYFVAGILKFFCLPSYFYELEYLPSSKEMTGHGKGIGQENFVSDVYTNVMRSRSKREGIPRASSLSSIDSIMTPSRMSLADVDTSGSTAASTEPSEYVRGLDPKAKRLSLGRSNIVSEPEEVLHPQPHHSSFWPRTRSKTRTERNSVGVTTNDTRLSWAAPSIHDKEDISSTISDPGPIWDSEPKWDNGPKWDTELTWESDHPIELPGPPEDNEIGPSVELVPNLDDKWVVRKGHFLGVLVCNHSCKTVQSLSSQVIAPKANHDDNTLDLLLVGGKGRWKLLKFFILLQFGRHLSLPYVEYVKTRDFSFEYQWQIFRIPVYYLGPLK

SEQ ID NO: 32015 - protein, 477 aa, Sinorhizobium meliloti 1021
MLDKRKFYIDGKWVEPATQNDLLVLNPATEKPIAVISLGTAVDVDRAVAAAKKAFASYSRTSVEERLALLEKLLAIYKRRYDEMADTITAELGAPRTMSHEQQADVGVGHLQGFIDALKRLKLREKLPNGDTLLREPIGVCGLITPWNWPVNQIALKVVPALATGCTCVLKPSEFTPLNAMLYAEMIEEAGFPAGVFNLVNGDGIHAGAALSKHKDIDMMSFTGSTRAGIAVSKDAADTVKRVTLELGGKSPNIVFADADIEERVTASILECFNNSGQSCDAPTRMLVERSAYDEVVEIARRVGMEARVGDPTKVGSHIGPLVSHIQFERVQALIEAGVAEGATLLAGGPGKPEGFETGYFVQPTIFADVDNSMRIAREEVFGPVLSIIPFDTEEEAIAIANDTNYGLAAYVQTRDRERAERVASRLRAGMVHINGGPHRYGSPFGGYKQSGNGREGGMFGLEDFLEVKTVHLPDAA

SEQ ID NO: 32016 - protein, 376 aa, Photobacterium sp. SKA34
MTDKFIKSKAAIAWGPKQPLSIEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPDISLAKISKEAPLEEVCLLGCGVTTGMGAVLNTAKVEEGSTVAVFGLGGIGLAAIIGATMAKASRIIAIDINEDKFELARKLGATECINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 32017 - protein, 408 aa, Photobacterium sp. SKA34
MSRIVIVGGGAAGLELSTLLAKTVRKEDEIILVEPETHHFWKPRLHEIAAGTFDSDLDTVCYFTHGARHGYQHYQAAMTNIDRDNKMLSVRRPDGTEAALKYDYLVIAIGAVSNDFNTTGAKDHCLFLDSASQARQAWHQVSLILRASEDRTVNIVGAGATGVELAAELARVSQKLQRYNGAPLHINLIEAAGRVLPNSPEKMSEKVQKELERNDVNVLLDTRIREVTEKGMLTVDNRELNADVQFWAAGVKAPDWLNGIGSLSYNRMNQIQVNANLTTTVDDSIFSLGDCASIPQADGSFVPPKAQAANRAAVHLAKSLGGMLRGKPLTDFEFKDGGMVVAVGHHFAVGSFAPGSKLEGKMVLQGRLIRRLYDTIFRLHQRTVTGMFTVSRLMIAKRLKAVFKPNGI

SEQ ID NO: 32018 - protein, 107 aa, Zea mays
MGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDK

SEQ ID NO: 32019 - protein, 937 aa, Oryza sativa (japonica cultivar-group)
MPSASAAAAALVLLFLAFSLSNAQPGFISLDCGGDDDYTDGIGIQWTSDAKFVSAGQEANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLAPNQTRKFKLVIPGKPEFSKPTVDVEENAQGKYCLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKEFFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKITSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSVQDLEQNASFDELLMRPGLRLNGTGRAAQAASEILNETAILVEQFQGKRNRDFVMN

SEQ ID NO: 32020 - protein, 144 aa, Triticum aestivum
  misc_feature (19)..(19): Xaa can be any naturally occurring amino acid
  misc_feature (37)..(37): Xaa can be any naturally occurring amino acid
  misc_feature (42)..(42): Xaa can be any naturally occurring amino acid
  misc_feature (47)..(47): Xaa can be any naturally occurring amino acid
  misc_feature (60)..(60): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(72): Xaa can be any naturally occurring amino acid
  misc_feature (75)..(75): Xaa can be any naturally occurring amino acid
  misc_feature (90)..(90): Xaa can be any naturally occurring amino acid
  misc_feature (92)..(92): Xaa can be any naturally occurring amino acid
  misc_feature (114)..(114): Xaa can be any naturally occurring amino acid
  misc_feature (122)..(122): Xaa can be any naturally occurring amino acid
  misc_feature (127)..(127): Xaa can be any naturally occurring amino acid
  misc_feature (132)..(132): Xaa can be any naturally occurring amino acid
  misc_feature (140)..(140): Xaa can be any naturally occurring amino acid
MAPTVMGSSATSVAPFQGXKSTAGLPVSRRSNGASLXSVSNXGRIMXMQVWPIEGIKKFXTLSYLXPLXTEXLLXQVDYLIRSKWVPCLXFXKGGFIFREHNASPGYYDGRYWXNVETAYVXGATTXTQVIXKVGEVNKXYPDA

SEQ ID NO: 32021 - protein, 257 aa, Shigella flexneri 2a str. 2457T
MSVPLILTILAGAATFIGAFLGVLGQKPSNRLLAFSLGFAAGIMLLISLMEMLPAALAAEGMSPVLGYGMFIFGLLGYFGLDRMLPHAHPQDLMQKSVQLLPKSIKRTAILLTLGISLHNFPEGIATFVTASSNLELGFGIALAVALHNIPEGLAVAGPVYAATGSKRTAILWAGISGLAEILGGVLAWLILGSMISPVVMAAIMAAVAGIMVALSVDELMPLAKEIDPNNNPSYGVLCGMSVMGFSLVLLQTAGIG

SEQ ID NO: 32022 - protein, 205 aa, Zea mays
NPSVAIHFKFPKSPTPQRAQAEARFAVDEKQERSMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIPRGARLDQASALATSIAGLLQCSVAVRSSPLVSDRVSNRQ

SEQ ID NO: 32023 - protein, 244 aa, Triticum aestivum
MSGTGYTVEVTNLSSSASENDLHEFFSFSGPIEHIDLIRSGGYGSTAYVTFKEPYALETAVLLSGATIVDQPVCISRWGQPDEPCNFWDRPTWQVEEEIEYRDYQSCQFNATPQEALTVAQDVVKTMLSRGYILSKDALSRARAFDESHQLSGSAAAKAAELSRSLGLTDRVSAGVGAIRSVDETYRVTETTKTVTTATGRTAVKVMNTIVTSSYFSAGAMMVSEALTRAAKAAENLAAHGRQH

SEQ ID NO: 32024 - protein, 303 aa, Glycine max
MAIISDFNEEEQKPTHSSPPQPQSSSSSSSSSSSFSAAFDRSNPIAFLERVFQFVSEHSDFLATESAEKEIALLVRAAGKKKREFLKSEREKAEKKKREDLKASEEREKSDKRLKEEKEPKAEDTSKDESTSKVPNKGNGLDLDKYSWTQSLQEVNVNVPVPNGTKSRFVTVEIKKNHLKVGLKGQPPIIEGEFYKSVKPDDCYWSIEDQNAISILLTKHDQMEWWKCLVKGDPEIDTQKVEPENSKLGDLDPETRQTVEKMMFDQRQKSMGLPTSEELQKQEMLKKFMSEHPEMDFSRAKIS

SEQ ID NO: 32025 - protein, 365 aa, Yersinia pestis KIM
MRLAMKKTYRIAAIPGDGIGHEVMPEGINVLQAAALRWDLDISFENIEWASCEYYQHHGQMMPNDWQRQLQCFDAIYFGAVGWPATVPNHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 32026 - protein, 390 aa, Sinorhizobium meliloti 1021
MNNGLDPFERASLIVAHDESNAFDAVVPPIVQTSLFTFKDYDEMVASYRGERVRPIYTRGLNPTVRHFEEMLAKLEGAEDAIGFASGMSAISSTVLSFVEPGDRIVAVKHVYPDAFRLFGTHLKRMRVEVTYVDGRDEEAVAKALPGAKLFYMESPTSWVMDTHDVAALAALARRQGIVTVIDNSWASPVFQQPVSLGVDLVIHSASKYLGGHSDVVAGVVAGSGELIGRIRSEAYPYLGGKLSPFDAWLLIRGMRTLPVRMKAHERSALAVARRLAEHPLVETVCHPGLGNHLPPGLSGTSGLFSFIFREGVDVRRFADHLKLFKLGVSWGGHESLIVPGEVVLAQKAEPNSAAAFGISPRSVRLHVGLEGTEALWSDLEAAMTAASSG

SEQ ID NO: 32027 - protein, 244 aa, Streptococcus suis
DRLGVSKNASPDEIKKAYRKLSKKYHPDINKDPGAEDKYKEVQEAYETLSDPQKRSAYDQYGPAGANGGFGGGAGGFGGFDGAGFGGFEDIFSSFFGGGGATRNPNAPRQGDDLQYAVNLKFEEAIFGVEREVSYNREATCRTCTGSGAKPGTSPVTCGRCHGSGVINVDTQTPLGTMRRQMTCDVCHGRGKQIKDPCTTCHGTGHEKQAHTVTVKVPAGVETGQRIRLAGQGEAGFNGGPYGD

SEQ ID NO: 32028 - protein, 1258 aa, Nostoc sp. PCC 7120
MILQSTSLFCKYINNCRYINREIVATLKASPQGLARIKQARSDRGWSVDDFRWLELASEILGVCWQENGVLAAGISEGTWKRFLAGKQAINAEAFKAYCQVLGLNWEEVQEGGRTKERKDTGTSRQEKFLSSSHPHTDWGEAPDVSIFYGRSEELDTVKRWVTQENCRLITLLGMGGIGKTTLSVKLAQEIINSEKIYLSQSPEYIIWRSLRNAPPVEDILAELIQFLSGQQETNLSNHLQGRISLLLKNLRSSRCLIILDNAESILQAGDRNGRYRAGCEGYGQFLQCIAETSHQSCLILTSREKPQGLAKYEGDSLPVRSLPLTGLQEQEGRELFNVKGKFAASCDQWQVLISRYGGNPLALKIVASSIRDFFDGDVSQFLEVSQQGTFIFDDIRDLLDQQFQRLTTLEREIMYWLAINREPVTLAELQADFVANIPPRELLESLSSLQRRSLIEKSAGGFTQQPVVMEYVSNHLIEQVCEEMREWGLVRSRGAEEQRSRGEKIHTQYKLNAALPLTALSTPLFTTHALIKAQAKDYVRESQISLILQPLINQLITEFGSLENISNCLVHILSRLRGKSPQETGYAGGNVLNLLHHAQVDLSGYDFSGLTVWQAYLQGVNLHDVDFANSDLSCCVFTETLGNILSAAFSPEGQLLATCDTDCHVRVWEVKSGKLLLICRGHSNWVRFVVFSPDGEILASCGADENVKLWSVRDGVCIKTLTGHEHEVFSVAFHPDGETLASASGDKTIKLWDIQDGTCLQTLTGHTDWVRCVAFSPDGNTLASSAADHTIKLWDVSQGKCLRTLKSHTGWVRSVAFSADGQTLASGSGDRTIKIWNYHTGECLKTYIGHTNSVYSIAYSPDSKILVSGSGDRTIKLWDCQTHICIKTLHGHTNEVCSVAFSPDGQTLACVSLDQSVRLWNCRTGQCLKAWYGNTDWALPVAFSPDRQILASGSNDKTVKLWDWQTGKYISSLEGHTDFIYGIAFSPDSQTLASASTDSSVRLWNISTGQCFQILLEHTDWVYAVVFHPQGKIIATGSADCTVKLWNISTGQCLKTLSEHSDKILGMAWSPDGQLLASASADQSVRLWDCCTGRCVGILRGHSNRVYSAIFSPNGEIIATCSTDQTVKIWDWQQGKCLKTLTGHTNWVFDIAFSPDGKILASASHDQTVRIWDVNTGKCHHICIGHTHLVSSVAFSPDGEVVASGSQDQTVRIWNVKTGECLQILRAKRLYEGMNITGVTGLTKATIFTLQALGALR

SEQ ID NO: 32029 - protein, 344 aa, Candidatus Kuenenia stuttgartiensis
MKAVVKANRASGLELVKMPEPKLGPKDVLIKVQVASICGTDVHIDDWTYWAQQRFTPPRIIGHEFAGYVQEVGKEVTFVKAGERVSAETHISCGYCYQCKNGYREVCRKSKLLGIDYDGTFAEYLSLPEHVLWKDDPRIPDEWATIQEPFGNAVDTVMSEDISSKTVLILGAGPIGLFAVGIARACGASLIIVSDPNDYRLDIGKKMGADIVANPKNTDILNCVLEATEGNGVDVVLEFSGNKLALDQGLKSLTPGGRISILGIYETPVDIDLNREVIFKKIRIYGITGRKIFSTWYKTSRFLSSGLVDPGPVITHTFLLEDYEKGMQLMRDGMCGKVVLQVMP

SEQ ID NO: 32030 - protein, 712 aa, Mesorhizobium sp. BNC1
MTMLYVVIACGLLSVLYAIWATQSVLAADQGNARMQEIAGAIREGAQAYLTRQYTTIAIVGVVVFLLAWWLLNAAAAIGFLIGAVLSGAAGFIGMHVSVRANVRTAQAASNSLSAGLEIAFKSGAITGMLVAGLALLGVSVYYWVLIGPMGYGPADRGVIDALVALGFGASLISIFARLGGGIFTKGADVGGDLVGKVEAGIPEDDPRNPATIADNVGDNVGDCAGMAADLFETYAVTVVATMVLGAIFFGGSEILGSVMLYPLAICGACIITSIIGTFFVKLGTNNSIMGALYRGLIVTGLLTILGIGAATSLTVGWGDLGTVNGITVNGTSLFVCGLIGLVVTGLIVVITEYYTGTNKRPVNSIAQASVTGHGTNVIQGLAVSLEATALPAIVIVGGIIATYQLGGLYGTAIAVTTMLGLAGMIVALDAFGPVTDNAGGIAEMSGLPPEVRQSTDALDAVGNTTKAVTKGYAIGSAGLGALVLFAAYSYDLQYFAANATEFPYFADIGDISFSLSNPYVVAGLIFGGLIPYLFGGIAMTAVGRAAGSIVEEVRKQFRDDPGIMQGTSKPNYARAVDMLTKAAIREMIIPSLLPVLAPLVVYFGVLLISGSKASAFAALGASLLGVIVNGLFVAISMTSGGGAWDNAKKSFEDGFVDKDGVKHMKGSDAHKASVTGDTVGDPYKDTAGPAVNPAIKITNIMALLLLAVLAH

SEQ ID NO: 32031 - protein, 177 aa, Glycine max
MNALAATNRNFRLASRLLGLDSKLEKSLLIPFREIKVECTIPKDDGSLATFVGFRIQHDNARGPMKGGIRYHPEVEPDEVNALAQLMTWKTAVANIPYGGAKGGIGCDPADLTVAELERLTIVLTQKIHDLIRVQTDLPTPMKGTGPQTMAWILDEYSKLHGHSGVGKLDIYGFCFQ

SEQ ID NO: 32032 - protein, 168 aa, Avena clauda
VMASSATSVAPFQGLKSTAGLPVSRRSASSLGSVSNGGRIRCMQVWPTEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32033 - protein, 168 aa, Avena clauda
VMASSATSVAPFQGLKSTAGLPVSRRSASSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32034 - protein, 369 aa, Escherichia coli K12; identical to SEQ ID NO: 1182

SEQ ID NO: 32035 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32036 - protein, 148 aa, Arabidopsis thaliana
  misc_feature (47)..(47): Xaa can be any naturally occurring amino acid
MASKALILLGLFSVLLVVSEVSAARQSGMVKPESEETVQPEGYGGGXHGGHGGHGGGGGHGHGGHNGGGGHGLDGYGGGGGHYGGGGGHYGGGGGHYGGGGGHYGGGGGGHGGGGHYGGGGGGYGGGGGHHGGGGHGLNEPVQTKPGV

SEQ ID NO: 32037 - protein, 543 aa, Oryza sativa (japonica cultivar-group)
MGAEVHDSDVTKEELGLLPPAEGMRCTFPLLEVEYSESTTRDETKAFAAMASKPSSRAESNQAAAAVPSLYGRALPSPPAVEFASAEGRRLFAEALQGGTMQGFFSLVSVFQTQSEPAFCGLATLAVVLNALRIDPGRRWKGPWRWFDESMLDCCEHLDTVRAEGITFGKVACLAHCSGADVRTFRAAQATLADLRRHLLRCASSQDCHLVASYHRKLLGQTGTGHFSPIGGYHAGQDMALILDVARFKYPPHWIPLPLLWEAMNTIDEATGLLRGVHRLSGIRNQETLLCNYQFITVNEENLDNAVGCMLSPFSVNEENLDNAVGLNHLPPNAGNFIKWVIEVRRQEEGGSSPSKEANEMPFLKEKVLQQIRDTKLFQLVHKLQCSKQPCCSCSSLTDEDSISQIAASVCCEATALLSGNLSSRDGLFFSETCSGCTQVNDEGLKNVITGKVVSEGNGHVDKLSPISSTETCFCNSTLSNETVNYPSNTDILTVLLLSLHPSTWLCIEDEKLKAEFQSLVSTDDLPDPLKLEVCCLTPRTLH

SEQ ID NO: 32038 - protein, 200 aa, Triticum aestivum
MVDPRFRTQPMGASSVAFHLLSSNTMAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGSEESGKA

SEQ ID NO: 32039 - protein, 325 aa, Yarrowia lipolytica CLIB122
MKLKLRTPTLNKVVELDNDATVEDLAAMVLSLGVVDFAIKGGFPPKPIDLSQGSKSLASAGIRNGDQLIVSTSGGEITKGNDIVSANRGHKDPVMGGFNKGSGTSSGSGGSGPSDLVTAPCGTRKLVLRVMEDDNSCMFRAVGYNMMKDADTMFELRMMVKDKIASDPETYSDAILGRPRAEYMSWITRQDSWGGAIELQILAENLGLTIISADVSTGRLDHFNPGKPTFCIVVYSGIHYDSVALAEVSDLYTNSSDVTVFSQDAQGAAVLESLKVLMAELKKKHYYTDTASFAVKCNDCGSTFTGEKGALEHAKKTGHTNFGEK

SEQ ID NO: 32040 - protein, 409 aa, Sinorhizobium meliloti 1021
MMPERIVIVGGGQAGGRVAQILAGSPANLDIALIGLEPHPPYNRPPLSKGVLLGKSELKDCVIWPQGDATAGRVRFYPGRRAESLDIHARHVITDDGARLDYDKLVLATGSRVRRLSVPGAECDGVFTLRTFDDAVAIARRFHRSKRLLVVGGGFVGLEIAAAARSRGLETVVVEATNRLLSRIVPQEIGAALARYHEAAGVSFRVGSMVEKLVANRSGKLKSAVLSNGETVPCDLAVIGVGVTANTELAKEAGLEVQVGIRTDSALRASADGVYACGDAVSFWHPLFERYVRVEAWQNAEDHARVVASQLLGQDMVCDTVPFFWSDQYEWSMQIAGIPYFGSQLVTNTVEEAKILYHLDARGRLVAATGLGHDRLIGRKIAEARRLIKRRARPNPQMLKTGQIQLEDG

SEQ ID NO: 32041 - protein, 346 aa, Sinorhizobium meliloti 1021
MAKALVLEKKGQLSLRDIPVRRDLSPTDVLIGIRTVGVCGSDVHYYTHGKIGPFVVNEPMILGHEAAGVVLEVGSQVRHLKKGDRVCMEPGIPDLSSRSSKLGIYNVDPSVRFWATPPVHGCLTPEVVHPAAFTYRLPDHVSFAEGAMVEPFAIGVQAALRAGIRPGDVGAVMGAGPIGMMTALAALAGGCSKVYVADLAQPKLDVIGAYEGIETINVRQQAVSEALAGATGGWGADVVFECSGAAPAILALPSLARPGGTVVLVGMPVEPVPFDIVGMQAKELRIETVFRYANVYDRAIELIASGKVDLKPLISATIPFDESIAAFDRAVEARPTDVKIQIEMPA

SEQ ID NO: 32042 - protein, 398 aa, Oryza sativa (japonica cultivar-group)
MAAVEQDQEEEVIIVGAGPSGLAAAACLSVRGVTGCLVLERDDCVASLWRHRTYDRVRLHLAKRYCALPHAPHGEASPTYLPRDDFLRYLDAYASRFGVRARLRREVRSARYDAARARWLVDAVDLATGRAERYAARHLVAAAGENDERVVPEVPGMETFPGKVVHAADYRSAEGFKGKSVLVVGGGNSGMEIAYDLAVGGAATSIVIRSELHLVSKEIWNLAMTLYRYLPVWVIDKVVLLMCAAVFGDTARYGLRRPAVGPFTMKATTTMYPVVDVGTFAKIRSGEIRVLPAAIKGVRGRDVEFADGQRHAFDAVVFATGYRSTTKHWLKSDDGLIGDDGMAGRSYPDHWKGENGLYCAGMVRRGIYGSYEDAEHIADDISKQLRSSSKPTHNNGSA

SEQ ID NO: 32043 - protein, 305 aa, Arabidopsis thaliana
LPIIDLSSPGKISTAKLIRQACLEHGFFYVKNHGISEELMEGVFKESKGFFNLPLEEKMALLRRDLLGYTPLYAEKLDPSLSSIGDSKESFYFGSLEGVLAQRYPNQWPSEGILPSWRQTMETYYKNVLSVGRKLLGLIALALDLDEDFFEKVGALNDPTAVVRLLRYPGEVISSDVETYGASAHSDYGMVTLLLTDGVPGLQVCRDKSKQPHIWEDVPGIKGAFIVNIGDMMERWTNGLFRSTLHRVMPVGKERYSVVFFLDPNPDCNVKCLESCCSETCPPRFPPILAGDYIKERFRLTYATS

SEQ ID NO: 32044 - protein, 469 aa, Brassica napus
MSSRSDLTIMRVCFIIFLLGVLVELCDGGITSEYVRGSDLPDDMPLDSDVFKVSPGPNTPQQVHITQGNHEGNGVIISWVTPSAPGSNTVRYWSENGKSKKLAEATMNTYRFFNYTSGYIHHCLIDDLEFDMKYYYEIGSGKWQRRFWFFTPPKPGPDVPYTFGLIGDLGQTYDSNRTLSHYEMNPGKGQAVLFLGDLSYADRYPLHDNNRWDTWGRFVERSVAYQPWIWTAGNHEIDFVPDIGETEPFKPFTNRYHTPYKASGSISPLWYSIKRASAYIIVMSCYSSYGVYTPQYKWLQKEFQRVNRTETPWLMVLVHCPFYHSYVHHYMEGETMRVLYEQWFVKSKVDVVFAGHVHAYERSKRVSNIAYNLVNGLCEPISDESAPVYITIGDGGNAEGLLTDMMQPQPSYSAFREPSFGHGLLDIKNRTHAYFNWNRNQDGSSVEADSVWLLNRFWRAPKKTMVVAS

SEQ ID NO: 32045 - protein, 443 aa, Oryza sativa (japonica cultivar-group)
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQNLVKKIKL

SEQ ID NO: 32046 - protein, 300 aa, Rickettsia sibirica
KSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQ

SEQ ID NO: 32047 - protein, 969 aa, Photobacterium sp. SKA34
MSTLFNFGDTDLSTTVPVVNGLYDLTLDELLLSQEHYESDVRSYPRRLPLAIAKAAGVLVEDTRGQLFIDCLAGAGTLALGYNHPEINKSIVEQLESGLPYQTLDITTVAKDKFIKQLLSFLPESFANNACVQFCGPTGADAVEAAIKLAKQTTGRNTMAAFHGAYHGMTNGTMAMMGNLNTKSRRQGLMADVHFLPFPYSLRCPYGLSGDDGAKQSLRYIERMLSDDESGVQKPAAIIVEPVQGEGGVIPAPAFWLRELRRITQEHGILLIFDEIQCGIGKTGHNFAFEESGITPDILCLSKAVGGGLPMSVLVFNKEIDNWNPGEHTGTFRGNQLAMATGAKTLEIIERDGLVEHAQKAGMYLRRGLEKVAAQTSCIAEVRGKGLMLGIEIVQSDGSKNKFDEPIAAPELTAAIQRSALERGLIIEKGGRQGSVLRFLPPLIISFEQLDFVINTIKEAIEVHVEPIEQGLVLESDHKVNWKDYFIQTGKGGSESFETALNQTTQVLKKVFEQTNQPYSGMDPQLLKTLINGIDLNRPQSSLDAVIEQTGDLIAKHSIMVQHPHCIAHLHTPPLVPAIAAEAFIAALNQSMDSWDQASAATFVEQKIIDWLCDVYQLGQQADGVFTSGGTQSNLMGLLLARDWAADTISGHNIQQQGLPSYADKLRILCSKKSHFTVQKSASLMGLGEQSVVCVDTNPDGTIQLASLITTIEALKADDLIPFAVVGTAGTTDHGAIDDLTGLADISARHNLWFHVDGAYGGALILSRHQSRLHGIEKADSLSVDFHKLFFQPISCGAVLVKDKAHFKYLLHHADYLNREDDLLPNLVDKSIATTKRFDALKVLMTMQSVGADALGEMYDHLINQTQHVADLVNQQSQYELLADPALSTVLFRFVGEGANLTEQQLNQLNKQLRIDALVQGQAVLGETVVDEKVALKFTILNPCLTIHDFKTLLNKVSQLGQSLLSSTQ

SEQ ID NO: 32048 - protein, 392 aa, Oryza sativa (japonica cultivar-group)
MIVTLMNLLRACWRPSSNQHARAGSDVAGRQDGLLWYKDTGQHVNGEFSMAVVQANNLLEDQCQIESGPLSFLDSGPYGTFVGVYDGHGGPETACYINDHLFHHLKRFASEQNSISADVLKKAYEATEDGFFSVVTKQWPVKPQIAAVGSCCLVGVICGGILYVANVGDSRVVLGRHVKATGEVLAVQLSAEHNVSIESVRKELQSMHPEDRHIVVLKHNVWRVKGLIQVCRSIGDAYLKRSEFNREPLYAKFRLREPFHKPILSSEPSISVQPLQPHDQFLIFASDGLWEHLTNQEAVDIVHSSPRNGSARRLIKAALQEAAKKREMRYSDLKKIDRGVRRHFHDDITVIVVFLDSSLVSRASTYRGPSVSLRGGGVNLRSNTLAPYASQM

SEQ ID NO: 32049 - protein, 333 aa, Ajuga reptans
MGPVVPVEAFRSAGKISALGAKKGYVTFLAGNGDYVKGVVGLAKGLRKVKSAYPLVVAILPDVPEEHRELLRSQGCIVKEIEPIYPPANQIQFAMAYYVINYSKLRIWNFEEYSKMVYLDADIQVYENIDHLLDTPDGYFYAVMDCFCEKTWSHSRQFSIGYCQQCPNKVTWPAQMGSPPPLYFNAGMFVFEPSKTTYQTLLHTLRITPPTPFAEQDFLNMFFEPIYKPIPLVYNLVLAMLWRHPENVELEKVQVVHYCAAGSKPWRYTGQEANMDREDIKMLVKKWWDVYNDESLDFKAEDSIAGEETFSMPSFIASLPEPAVSYIPAPSAA

SEQ ID NO: 32050 - protein, 292 aa, Ajuga reptans
VGLAKGLRKVGTIYPLVVAVLPDVPPEHRRILVEQGCVVREIEPVYPPENHTEFAMAYYVINYSKLRIWEFVEYSKMIYLDGDIQVFENIDHLFDLENGYFYAVMDCFCEKTWSHTPQYQIGYCQQSPKRVHWPKQLGPKPPLYFNAGMFVYEPSLPTYHDLLHTLKITPPTPFAEQDFLNMFLRDVYRPIPNVYNLVLAMLWRHPENVNLEAVKVVHYCAAGSKPWRYTGEEENMDRNDIKMLVNKWRDIYDDEMLDYNAVADPAADGLQLTAVLTEAAGVVRFIPAPSAA

SEQ ID NO: 32051 - protein, 601 aa, Coprinopsis cinerea okayama7#130
MSLDWLSPARRSFVWFWITICLHLRLVLAYEVAITDKDYSRQACSGMWGGETAYINVTFDKSSQGQVAMVIYEWTDEDYLGKRREGPLNEPLPNIYICTTTALTGGYCNESQLGRFILNLPTGKSINDTSFWSARVQLPASQSSLKPSSISESGFWNNPPNGSFPTPPASEWDSPWKRRNAGDHILSLTRRGEEHEGLYAYSEPIHYPVRKTGYYCVAIVPLNEENQSPAAATGDATATHPPYRANILFKNVFEGQLPATDYPKVTFYFAMFLAYSVIALLWGFLCYRHMQELLPIQYYLSGLVALLVVEMLANWVYYRYLNAHGKGATSTAFLIVVAILDAGRNSMSFFMLLVVSLGLSVVRESLGSTMRKCQALAVAHFIFGILYAIGIVELEMESTSALLLLLFIIPLAFTLSGFLLWIMYSLNATIQQLRARKQRYKLRMFTRLHYILIFAVVVIGAFFVVSSMSFSGRLAEGKTMLRTRGEAAGGCLMAATLAMSDEIAQDEEEAEDYDLQAIQDRSRHREEEDDDAATLVGGRRGPGDSVSGDVVFEIGDEDDDDDDAHKKHKAQRLSGENPDYQPVDGRGGDREEREGLMRRDD

SEQ ID NO: 32052 - protein, 159 aa, Staphylococcus epidermidis ATCC 12228
MKHMHRGTHEVERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 32053 - protein, 339 aa, Staphylococcus epidermidis ATCC 12228
MALLQCTLAIKKTVLAKVINVAKLNINNEIKKVEKRLEEAIISSDQTLQEASFHLLSSGGKRVRPAFVILSGQFGSNNKPSEDTYRVAVALELIHMATLVHDDVIDKSDKRRGRLTISKKWDQSTAILTGNFLLAMGLKHLSEISDTRVHSTISKSIVDVCRGELFQFQDQFNSNQTITNYLRRINRKTALLIQLSTQVGAITSNASNDVIRKLKMIGHYIGMSFQIIDDVLDFTSSEKKLGKPVGSDLMNGHITLPVLLEMRKNKTFKDKISQLNPDSPQHAFETCITIIRQSESIEQSKQISEKYLNKAINLIDELEDGPNKELFRKLIKKMGSRNK

SEQ ID NO: 32054 - protein, 401 aa, Solanum demissum
MPAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNAKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPLQAYQKSPRGR

SEQ ID NO: 32055 - protein, 272 aa, Synechococcus elongatus PCC 6301
MMEDTFTPLQLQVEGASLRFCRYGGQVLSWQPADGQERLFLSDRSLYQSGQAIRGGVPIIFPQFSGRGSLPKHGFARDRAWALLQWDEDSGQAELELRESLETLQIWPFAFRLVLKLQLRPQQLQLQLTVENCDRQPWSFTAALHSYLAVPDLATVHLQGLQGRWGTEQTTGDRWQEMECDRHFPQAIDALYEAPAQPLTLLAPPWSALQICQTGFTETVIWNPGSAGVSQIGDLASGSEQQFLCVEAAVVQSPPRLEPGEIWQGQQVFQVG

SEQ ID NO: 32056 - protein, 420 aa, Sinorhizobium meliloti 1021
MRPRRGPVHQENMVIVGCGHAGARAAQALRTNGWHGGITLVDGEGRTPYERPPLSKAVLKGESEAEDAPLFPADFLAKNDIHVLKGVAAAAIDRPTRQLRLSDGGSIAYHRLLLATGAEPRNLIVPGADLPGSHTLRSADDAARIFPYLRPGAEIVIVGGGLIGLEAAASATVRGCKVTVVEAGPRPMMRAVPAELSHEVRLFHESKDVRFVLGRQVSELEGDGRVRCVRLDDGTVLPCTAVVISVGVSPRTALAEAAGLEIDNGIAVDRFLRTSDPFIYAAGDACAFEQVSGPRMRLECWKNAEDQGTLAGRNMLGSDEAYVPLPWMWSDQFDRTMQIAGQAGGSAEDVRRRCPDSTLLIYHLDKDQMILGISGFGSIREVSRGVRMGQLLMERGIRPGRKALADPEFDLRSLAKAAVA

SEQ ID NO: 32057 - protein, 840 aa, Oryza sativa
SWRKRREARGDRGRDARIGAGEAARGRRAMFGRMRCLVGGGVEDSPRGAVRRVSPALRRVHNANASAAAAAGAEGKSGLPFRSPDVMETVHEVAIYIHRFHNLDLFQQGWYQMKITATWEEGGSKTPASPARVVQYEASDVGGDDALGIWKIDDADNSFYTQPFRIKYARQDIYLSVMVSFNIFNSEEEGPAASSVILKFELIYAPTLENGSDIQASSATSSAAVHEFRVPRRALLGSHSYCPVHFDAFHSVLVDLTLHIVYLKAGATKSSLKIPDQGLGPTSHHIVKALLTSREMLLEELKKISDAIGKTVEDLDVADLSLGKYEAVQPAKSGLPNSNKVFPATTKGVGHLAGILHDFLEKPNSAVDGANDAMLYTLPKEELLELFLTVSSQLSLLWNAFLKFHRINKTKILDYLRDIWALDRKSEWSIWTVHSKIEIPHRYLRSTDDESSHRHSLLRVSGSRKFHDDPVQNSASRAELHRKSIAQMKINTLSVQDMQIYADPSRVPVVLIEQHVMVVPQHGSSKDLATNSSEQKDTIVLPKLQGDSLALKSSAGKKGRILRAVIFVHGFQGHHLDLRLVRNQWLLLDPGAECLMSEANEDKTSGDFKEMGGRLAGEVVAFLKKKVDKLAKYGGCKELKLSFVGHSIGNVIIRTALAEPALQPYLKNLYTYMSISGPHLGYWYSSNSLFNSGLWLLKKLKGAQCIHQLTFSDDQDPQNTFFYKLCKLKTLENFKNIILLSSPQDGYVPYHSARIELCPAASSDNSRKGQVFTEMLNNCLDQMRAPTSETRIFMRCDVNFDQSAQGRNLNTMIGRAAHIEFLETDIYAKFIMWSFPELFR

SEQ ID NO: 32058 - protein, 162 aa, Brassica napus
MSIPIPYDDPLTTTGEQSPYPAPPKGGNTTNLPTKILSKILVGFIMIPVALTALLFILMSLGFSVFFFALYWFLHRNYRRRLRRHLRHESSDGLSPRCGKSLPQFKFCEPTKYGSEGGVGIDGFRQGQGGRRLPGCGHVFHRRGVDFGLVKVGTCPIGRDRV

SEQ ID NO: 32059 - protein, 446 aa, Synechococcus elongatus PCC 6301
MSFDYDLLVIGAGSGGLAASKRAASYGAKVAIAETDLVGGTCVIRGCVPKKLMVYASSFASQYHYAEAYGWSAIQPQFSWPKLIAAIDAEVNRLSRLHISLLEKAGVDLILGHAQFVDEHRLQVGDRQVTAAKILIAAGGRPIKLPIPGGELAITSREMFHLPEQPQRFAVIGGGYIGCEFAGILRSLGSEVTQIIRRDRILQGFDQELREAVQTGMSQLGVQFRTGVTVERIDQTETGLQLSYSDGSQQIVDQVLMATGREPWLEGLDLDAAGVAIEGRRIAVDAWSRTNQPHIFAVGDCTDRVNLTPVAIAEGRAFADTEFGQKPRQISYENIASAVFSQPEACSVGLSEEAAKAEYGEERIRVYRSRFRPMFYTLPQAEERVLMKLVVETESDRVLGAHMVGKDAAEIIQSVAIAVTMGATKADFDATMALHPTSAEEFVTMP

SEQ ID NO: 32060 - protein, 323 aa, Anabaena variabilis ATCC 29413
MTPATSLFTPVEADLRILADNLKQLVGNRHPILFAAAEHLFGAGGKRIRPAIVLLISRATMLEQDITPRHRRLAEITEMIHTASLVHDDVVDESEVRRGVPTVHSLFGNRIAILAGDFLFAQSSWYLANLDNLQVVKLLSEVIMDLATGEIQQGLNRFDASISIENYIEKSYYKTASLIANSSKAAGLLSEVSPETAEHLYAYGRHLGIAFQIVDDILDFTSTTDTLGKPAGSDLKSGNLTAPVLFALAEKPYLEVLIEREFAQEGDLEQALELIQNSQGIQKARDLAAHHTKLAIEHLTTLPTSESHQALINIAEYTLSRLY

SEQ ID NO: 32061 - protein, 796 aa, Oryza sativa (japonica cultivar-group)
MGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 32062 - protein, 198 aa, Triticum aestivum
  misc_feature (153)..(153): Xaa can be any naturally occurring amino acid
NGTKESISKLVSDLNAATLESDVDVVVAPPFIYIDQVKSSLTGRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPXGAIGTGKVASPEQAQEVHAAVRDWLKTNVSADVASTVRIIYGGPV

SEQ ID NO: 32063 - protein, 255 aa, Prochlorococcus marinus str. MIT 9303
MDSSCSPKHGWFDSVAASYAQQRPHYPESLFAWISSKASSHQRCWDVACGSGQASLGLARHFDRVDATDLSPAQVAAAPAHSNIHYQVAAAEDSGLPNACMDAIVVAAAIHWLDVPRFNEEAFKVARPGGLMVWVGYDPPQGAPPALQLWLDQLYGERLRNWWPPQRQHVDNHYQNLPFPAISTSLPQELCISLQWSCDQLIGYIGTWSALRKAKQEGHDLLPQLSMELQKLWPSDQTTIPLIFPLMGRWGYLTR

SEQ ID NO: 32064 - protein, 496 aa, Triticum aestivum
MGSNEMVVVVPEIKHTKLFINGEFVDAASGKTFETRDPRTGDVLAHIAEADKADVDLAVGAAREAFEHGKWPRMSGYERGRAMHKLADLMEQHTEELAALDGADAGKLLLLGKIIDIPAAVQMLRYYAGAADKIHGESLRVSGKYQGYTLKEPIGVVGIIIPWNFPSLMFFLKISPALAAGCTVVVKPAEQTPLSALYYAHLAKLAGIPDGVINVVPGFGPTAGAAIASHMDVDSVAFTGSGEVGRLIMEASARSNLKTVSLELGGKSPLIIFDDADVDMAVELSRLAIFFNKGEVCVAGSRVYVQEGIYDEFVKRAVVAAQNWKVGDPFDVATNMGPQVDKEQFERVLRYIEHGKSEGATLLTGGKPASDKGYYIEPTIFADVKEDMKIAQDEIFGPVMSLMKFKTVDEAIEKANCTKYGLAAGIITKNLDIANRVSRSVRAGTVWVNCYFAFDPEAPFGGYKMSGFGRDQGMMAIDKYMQVKSVITAVPDSPWY

SEQ ID NO: 32065 - protein, 331 aa, Photorhabdus luminescens subsp. laumondii TTO1
MTIKVGINGFGRIGRIVFRAAQERSDIEIVAINDLLDAKYMAYMLKYDSTHGRFNGTVEVKDGHLIVNGKAIRVTAERDPANLKWNEVGVDVVAEATGIFLTDETARKHIAAGAKKVVLTGPSKDDTPMFVMGVNHKAYAGQEIVSNASCTTNCLAPLAKVINDKFGIVEGLMTTVHATTATQKTVDGPSAKDWRGGRGAAQNIIPSSTGAAKAVGKVIPELNGKLTGMAFRVPTPNVSVVDLTVRLEKPATYQQICDAIKDAAEGELKGVLGYTEDDVVSNDFNGEKLTSVFDAKAGIALNDNFVKLVSWYDNETGYSNKVLDLIAHISK

SEQ ID NO: 32066 - protein, 217 aa, Photobacterium sp. SKA34
MQTIFFDFDGTLVDSERFHAVNWSQYLASHGVELSTDTFMSQFAGVTWPQIAEHFISQYNILITETVMIEEVEALTEMMIIEKGIPPMPGVDELLKILSGKVPMAVVTGAPKDYVEGVLAQHGWLSLFEHVFSGYEVAKNKPAPDVYLKACKTMDVLPEKAVAVEDSRTGLMSAMSANIHVVFVNSHNMKLPAHAQHSFTSMKEATPALLSLLKVNS

SEQ ID NO: 32067 - protein, 455 aa, Xanthomonas axonopodis pv. citri str. 306
MLSPSVVPPSSTAAGAPPRTLGFWSALSANLLNMIGIGPFITIPLALSALAGPSVLIGWVAGALLCLCDGLVWAELGAAIPRSGGPYHYLREAYGRERWGRLFGFLYLWQTLLTAPLSVGSAAVGCVQYLAFLLPGLGHARLTAMAMALCAFNTLLLYRKVRSVQVLSLLVSAAVIGACVWIICSGVLHFDLGIAEDFLHARPASPHGFWLGLGAVALIAVYDYGGYNNVCMLGGEIRKPRRTIPRAVLVSIPIVALLYLGLNVTLLGVLPWQQAAQSKAVMADFMQAIYGPAGSTVAVALIVLASWGSALVVLLGYSRVPYAAAAAGQFFGVFARLHPRGGFPTVSLLFVGATSVLACLLSLDDLIATLMIIQILFQFLAQCLAVVLLRRKRRRRAFSMPLYPWPLLISVAGWLYLLAASPGHRVLAAVLALCVGSALYLIQARRERAWPFQLQ

SEQ ID NO: 32068 - protein, 172 aa, Populus trichocarpa
MANPKVYLDMTIGGVPAGRIVIELFADTTPRTAENFRALCTGEKGKGRSGKPLHYKGSTFHRVIPGFMCQGGDFTAGNGTGGESIYGAKFADENFIKKHTGPGILSMANSGPGTNGSQFFICTDKTEWLDGKHVVFGRVVEGMNVVKAIEKVGSSGGRTSRPVVVADCGQLS

SEQ ID NO: 32069 - protein, 446 aa, Synechococcus elongatus PCC 7942
MSFDYDLLVIGAGSGGLAASKRAASYGAKVAIAETDLVGGTCVIRGCVPKKLMVYASSFASQYHYAEAYGWSAVQPQFSWPKLIAAIDAEVNRLSRLHISLLEKAGVDLILGHAQFVDEHRLQVGDRQVTAAKILIAAGGRPIKLPIPGGELAITSREMFHLPEQPQRFAVIGGGYIGCEFAGILRSLGSEVTQIIRRDRILQGFDQELREAVQTGMSQHGVQFRTGVTVERIDQTETGLQLSYSDGSQQIVDQVLMATGREPWLEGLNLDAAGVAIEGRRIAVDAWSRTNQPHIFAVGDCTDRVNLTPVAIAEGRAFADTEFGQKPRQISYENIASAVFSQPEACSVGLSEEAAKAEYGEERIRVYRSRFRPMFYTLPQAEERVLMKLVVETESDRVLGAHMVGKDAAEIIQSVAIAVTMGATKADFDATMALHPTSAEEFVTMP

SEQ ID NO: 32070 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSRKPFYAILHRIDVGLVIDLEPVNPVDVPATAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 32071 - protein, 432 aa, Pseudomonas fluorescens
MTHRIVIVGGGAGGLELATRLGKTLGKRGTASVMLVDANLTHIWKPLLHEVAAGSLNSSEDELNYVAQAKWNHFEFQLGRMSGLDRERKRIQLAATYDETGVELLPARELGYDTLVIAVGSTTNDFGTEGAAQHCLFLDTRKQAERFHQQLLHHYLRAHAGQTDIVERISVAIVGAGATGVELAAELHNAAHELHAYGLDRIKPENMHITLIEAGPRVLPALPERIGGPVHKTLEKLGVNVMTNAAVSQVTADSLITADGKVIDASLKVWAAGIRAPDFLKDIDGLETNRINQLHVLPTLQTTRDENIFAFGDCAACPQPGSERNVPPRAQAAHQQASLLAKSLKLRIEGKALPEYKYTDYGSLISLSRFSAVGNLMGNLTGSVMLEGWLARMFYVSLYRMHQMALYGMFRTAMLMLGSKIGRGTEPRLKLH

SEQ ID NO: 32072 - protein, 1135 aa, Sorghum arundinaceum
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVICHHTSPRFVPFPLRYACEFLLQVFGIQLNKEVELAAQAKERHILRTQTLLCDMLLRDAPVGIFTQSPNVTDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 32073 - protein, 434 aa, Solanum demissum
MATELEELIGFLSSPSHPVKKIAVDIVRDYTGSEDGLESLGKYSDVVLPSLSRLLGEKKVVSEPAAQALVNLSQKPELAGKMVEMHMVRTSMETLYKQDCEITNLLIMLLVNLTQLDAGIDSLLQSADEKMHGLYVMKLVRSFCSSSCEGKVDPFEHVASVLVNISKKEDGRKLLLDQKRCLLKQIVRNDSKSLLRKRGVAGTIRNCCFEAENQLQNLLLISEFLWPALLLPVAGNKESSHLCSRTVYKDFFQQVYSEEDTRKMPLELASALSIEREPVTDPEIRVQALEAIYLLILQEAGRRAFWSVNGPRILQVGYADEDDPKAMEAYERAGSLRGVGYDPLKVCYVKDSGDVSEISLYCLNDLAVLLIVSCHPTKGSSIQTCSQLEGLSETISLPPQGRGKSVLFVCTDNKSSVILQVRSGEVEMYAVSLL

SEQ ID NO: 32074 - protein, 125 aa, Solanum demissum
MSMDACQILTNSGCCKPPTECGYVYQNETVWIPGGGLVGADPDCVKWSNDQEQLCYNCDSCKAGVLASLKKSWRKVSVINIVILILLVIMYMVAIAAFRHNKRIDNDEPYGETRMEKTQPSRIHF

SEQ ID NO: 32075 - protein, 482 aa, Triticum aestivum
MGRTVKKAGKSKSKKGKGAKKADASSSATAAVASGPAKVWQPGVDALEEGEELQFDPEAYNYLRGFSIGWPCLSFDVVQDQLGLVRSEFPHTLYGVAGTQAEKAPWNYIGVFKLSNINGKKREPIPSSKVDADSDMDSDSSSDEEEEEETNEDIKPILHLKKVAHAGCVNRIRSMTQQPHICATWGDTGHVQVWDFKSFLNSVADSGPVAHKEDDIIHNHVPLKIFNGHKDEGYAIDWSPLVTGRLVSGDCNSCIHLWEPSSSTWDVDTKPFVGHSASVEDLQWSPTEGDVFASCSVDGKICIWDVRTEKKPCMSIKAHNADVNVISWNRLASCMIASGCDDGSFSIRDLRFIKDDGAVVAHFEYHKHPITSVEWSPHEASTLAVSSADHQLTIWDLSLEKDAEEEAEFRAKMKEQANAPEDLPPQLLFVHQGQKDLKELHWHPQIPGMIVSTAADGFNVLMPSNIDTTIAGADKPTLAPLG

SEQ ID NO: 32076 - protein, 339 aa, Sorghum bicolor
MITVAAPEAQRRWRRPAREETVFRSKLPDIDIASHLPLHEYCFARAAEVPDAPCLIAAATGRTYAVHETRLLCRKAAASLHGLGVGHGDRVMILLQNSVEFVLTFLGASFLGAVATAANPFCTPLEIHKQFRASGAKLIVTQSAYVDKLRHEAFPRIGGEDKDNALTVLTIDDVADTPEGCLAFWELVTPADDAALPEVSISPDDPVALPFSSGTTGLPKGVVLTHGGQVSNVAQQVDGANPNLYMREGDVALCVLPLFHIFSLNSVLLCALRAGAAVMLMPKFEMGAMLEGIQRRVTRGRRQRPPLALALAKNPAPEKYDLSSIRIALSGAAPIGKEL

SEQ ID NO: 32077 - protein, 135 aa, Glycine max
  misc_feature (33)..(33): Xaa can be any naturally occurring amino acid
  misc_feature (39)..(39): Xaa can be any naturally occurring amino acid
  misc_feature (68)..(68): Xaa can be any naturally occurring amino acid
  misc_feature (112)..(112): Xaa can be any naturally occurring amino acid
CIVADKIALKLVGPGGFFFTEAGFGADIGAEGXVNIKCXYSGLTPQCAIIVATIRALKMLGGWPAVCXLGKPLDHAYLTENVVSDEACCINFFRHISNTKSYGVNVVVAINXFLTDTEAYLNATYSAVLSALAYY

SEQ ID NO: 32078 - protein, 386 aa, Xanthomonas axonopodis pv. citri str. 306
MHPPRLLSRLVASLAASLGAVVAQAQSPASPPSPIMLSEFIADPAPTPQAHASTLLETRDGHLLAAWFGGEHEGAADVGIWLAQRGPQQWQTPRRIADGAHAGVDGTAVPAWNPVLFQSATGPVQLYYKLGPNPRQWWGLRLLSTDDGAHWSPPQRLADGILGPIKNKPVQLPNGRILAPSSSEDRGWRAHLEWSDDDGVHWQRGMPLNDAKAIGAIQPSLLMYPDGRLQALGRSQQNKLFSTFSLDGGLHWQPMYLLEVENPNSGTDAVVLHDGRALLVYNPAIAGKDWWDGRGTLAVAVSNDGVHWQRVLTLEDSAGDEFSYPAVIQTRDGLVHVSYTWKRRRIKHVVLDPTRFGECSPCQAPVPTMLPERCTTACAHAADPSS

SEQ ID NO: 32079 - protein, 774 aa, Brucella melitensis 16M
MTKKPSSPSTRSDFDEAALFFHRYPKPGKLEIQATKPLGNQRDLALAYSPGVAAPCLAIHDDPATAAEYTARGNLVAVVSNGTAVLGLGNIGALASKPVMEGKAVLFKKFADIDVFDIEIDAHEINRIVDVVSALEPTFGGINLEDIKAPECFEVEEQLRERMNIPVFHDDQHGTAIIVASAVLNGLELAGKKIEEAKIVTSGAGAAALACLNLLVNLGAKRENIWVCDIEGVVYDGRNTLMDRWKEVYAQKTDARTLADVIGGADVFLGLSAAGVLKPELLKQMAEKPLIMALANPKPEIMPEEARAARADAMICTGRSDFPNQVNNVLCFPYIFRGALDVGATVINEEMKLAAVRAIASLAREEPSDVAARAYSGDTPTFGPDYIIPSPFDQRLILRIAPAVAKAAMETGVATRPIEDMEAYLDRLNRFVFRSGLIMKPVFAAARTQGAPMRVIYADGEDERVLRAAQVVIEERIAAPILVGRPQVVETRLRRYGLKIRPGTDFELINPEDDPRYRDYVDLYLSYTGRQGVTPEAARTIVRTNSTAIAALAVMRDEADAMICGLEGRFERHLRVVRQIIGKVPGIRDYSALSLLISQRGALFLTDTYVNAEPDANEIAEMAVLAAREISRFGIEPKAALVSHSNFGSKESASAEKMRQAAAILAEKAPDLESDGEMHGDAALSQTLRDRVFPNSRLKGEANLLVFPNLDAANITLNVVKAVTDALHVGPILLGATRPAHILTPSVTSRGVVNMTALAVVEALQKNASNRRQN

SEQ ID NO: 32080 - protein, 947 aa, Oryza sativa (japonica cultivar-group)
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIALDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 32081 - protein, 419 aa, Thermococcus profundus
MVEIDPFEMAVKQLERAAQYMDISEEALEWLKKPMRIVEVSVPIEMDDGSVKVFTGFRVQHNWARGPTKGGIRWHPAETLSTVKALATWMTWKVAVVDLPYGGGKGGIIVNPKELSEREQERLARAYIRAVYDVIGPWTDIPAPDVYTNPKIMGWMMDEYETIMRRKGPAFGVITGKPLSIGGSLGRGTATAQGAIFTIREAAKALGIDLKGKKIAVQGYGNAGYYTAKLAKEQLGMTVVAVSDSRGGIYNPDGLDPDEVLKWKREHGSVKDFPGATNITNEELLELEVDVLAPAAIEEVITEKNADNIKAKIVAEVANGPVTPEADDILREKGILQIPDFLCNAGGVTVSYFEWVQNINGYYWTEEEVREKLDKKMTKAFWEVYNTHKDKNIHMRDAAYVVAVSRVYQAMKDRGWVKK

SEQ ID NO: 32082 - protein, 261 aa, Arabidopsis thaliana
MAGLFDKQADLYLDARPNYPSEWFSKLADLTDHHGLAWDAATGNGQAALAVAEHYESVVATDVSESQLKLATPHPKINYRHTPTSMTDDELVELIGGENSVDLITVAQGVHWFDLPRFYSVATRLLRKPGGIIAVWGYNDVIVSPEFDAVQYRLHATTLPFWKYPYIQHIFDSYEALPFPFENVGMGSEGEPLKLEMPKTTSFEGIIRMFKSWSAIVTAREKGVELLPESLVRELETAWGGSDLVRSVVYKAFMIAGKVRV

SEQ ID NO: 32083 - protein, 483 aa, Brucella melitensis 16M
MAPPLQNRNLSITLEAGISMTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVNGKKIEG

SEQ ID NO: 32084 - protein, 437 aa, Desulfitobacterium hafniense Y51
MEGFKIKSVKARQVFDSRANPTVEVDITLKDGTVGRGIVPSGASTGLFEAVELRDGEETFDGKGVSKAIHHVNEQLAPLLLDMDVRDQKAIDSRLIEIDGTPNKSRLGANAILGCSMAACWAGANYYKVPLYRYLGGSAANKLPVPMVQIIGGGAHADNVIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEKKTLTKEEMVGMLSDWVDNYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 32085 - protein, 244 aa, Brucella melitensis 16M
MRIRGGRNGNSGMDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIELARAAIIAGTDGIRTMNRS

SEQ ID NO: 32086 - protein, 410 aa, Glycine max
MPNLCTVSSNASSNFIFGVQPHNFYNVFGSRRTRPRCRVSMSSSDPQNAVVVGCGSVTMDFLATVAAYPKPDDKIRSTSLKVQGGGNVGNALTCLARLGLNPRLISKIADDSQGRSILDELRDDGVDTSFIVVSKEGTSPFTYIIVDNQTKTRTCIHTAGYPPMIPDELSKSSLLSALDGAKFAYFDGRLPDTALVVAQEAVRKNIPILIDAERPREGLDDLLKLADYVVCSAKFPASWTKASTVPQALVSMLLRLPNIKFVIVTLGKDGCIMLERSVDAGPSTEEVDVDSLLESLEIKRDKSVSIPTCISSSVAKLKAEGIVTVSGKLYVGTAESIPPSELVDTTGAGDAFIGAVIYAICAKFTPETMLSFAANVAGAKCRDLGARSGLPYRADPRIASFVLEKLSSSA

SEQ ID NO: 32087 - protein, 1135 aa, Sorghum arundinaceum
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSSSKF

SEQ ID NO: 32088 - protein, 150 aa, Rickettsia conorii str. Malish 7
MRQSGNPYYSHPIEIKIMLAEFVAEEAPKLYNIIMLQVQAALLHDTIEDTELTAEAITEIFGPEVAKHVEGLTRIKSYGKISRGESLNLLIKEKRYNTALIKLFDRIHNVQTLGVKSPEKARKIIEATLINFLLVAANINYKLEQELSYA

SEQ ID NO: 32089 - protein, 227 aa, Zea mays
MKLEVMPKQRVLEAEQREEAMEMSGLDLWKHEKPPRICSLPPPLPAPPACDEAALVPPLNFAMVDDGIFRSGFPETANFRFLKSLNLRSIVYLCPEPYPETNTEFLEKNGIRLHQFGIEGRKMNGTSGMGLFLPAGEPFVNIPDDKIREALKVVLDPRNQPLLIHCKRGKHRTGCLVGCLRKLQKWCLSSVFDEYHRFAAAKARITDQRFMELFDVSSLKHLTPSHC

SEQ ID NO: 32090 - protein, 517 aa, Sorghum bicolor
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 32091 - protein, 525 aa, Vibrio angustum S14
MTTNIHEQRILILDFGSQYTQLIARRIREIGVYCELWSWDVDEADIREFAPNGIILSGGPESVTEAGSPRAPQYVFEAGVPVFGVCYGMQTMAEQLGGKVAGSNEREFGYAQVKIVEPTHFLEGIQDATAEDGTPLMDVWMSHGDKVVEIPSDFIKVAETETCPFAAMANEEKRFYGVQFHPEVTHTRQGMKLIENFVMNICGCEKLWTSANIIEDAVARIKEQVGDDEVILGLSGGVDSSVVAMLIHRAIGDKLTCVFVDNGLLRLNEGQQVMDMFGDKFGLNIVHVQAEDRFLSALAGIDEPEAKRKKIGHVFVDVFDEESKKLKNAKWLAQGTIYPDVIESAASKTGKAHVIKSHHNVGGLPDDMEMGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 32092 - protein, 1135 aa, Sorghum arundinaceum
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEIDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 32093 - protein, 173 aa, Vibrio vulnificus CMCP6
MAGSSVIVMGVCASGKTTIGELLAEKLGRKFIDGDDLHPRANIQKMASGQPLNDDDRKPWLERIRDAAYSLESKNEHGIIVCSALKKSYRDQIRDGNNNVTFLFLDGDKSLILERMRQRQGHFMKENMVNSQFETLERPDGEPRTLLVSIDTTIEEVVTNAAELILEQDEAQA

SEQ ID NO: 32094 - protein, 123 aa, Narcissus pseudonarcissus
QPMSVFWLVPQFFLVGAGEAFCYIGQLDFFLRECPKGMKTMSTGMFLSTLSLGFFLSSALVTIVHKVTGESGQGAWLPDDLNRGKLYDFYWLLAVLSAVNLVAFLVSARWYVYKENRMATDDG

SEQ ID NO: 32095 - protein, 223 aa, Yarrowia lipolytica CLIB122
MDPLEEQQQELEVLQSIYPEEITVLDPSTYTIDIGLDVQPKGQCVELHVKYPKDYPEVVPVIRIVRGQAAEEDYDSDEEEVEETLDYEGEPVFLDAEDYAELTSKMQEVAEENVGMASVFAIASSLKDEAEELHASKVRSNEQKLEQARKAVEDEEQKKFVGTPVTPESFAEWRKGFRAEMGLDNIEAEKVKARGGKMTGKEIFEKGLGGEEEEEDMAGLALE

SEQ ID NO: 32096 - protein, 451 aa, Vibrio vulnificus CMCP6
MATHFDYICIGGGSGGIASANRAAMYGAKVALIEAKDLGGTCVNVGCVPKKVMWHGAQIAEAMSLYAPDYGFDVEVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLNALGTETHLFCRKESPLRSFDPMIIDTLVEVMAAEGPTLHTHSVPKEVVKEADGSLTLHLENGESQNVDQLIWAIGRHPATDAINLSATGVATNERGYIKVDEFQATNVAGIYCVGDIMEGGIELTPVAVKAGRQLSERLFNNKPNAKMDYDLVPTVVFSHPPIGTIGLSEPEAIAQYGEENVKVYTSGFTAMYTAVTQHRQPCKMKLVCAGEDEKVVGLHGIGFAVDEMIQGFGVAMKMGATKADFDSVVAIHPTGSEEFVTMR

SEQ ID NO: 32097 - protein, 396 aa, Magnaporthe grisea 70-15
MSFTSIPVLDLSLASSPTTKPAFLADLRSALMEVGFLYLKNVGIPDSLFASAISHGRAFFELPLDEKLKIEMKNAPSFLGYSRLSAEVTAGAIDHREQIDLSTEHVVPTAPDTPRYYNLLGPNQWPDEAALPGFRDTFTAYMTAMGAVSMRFTALVAEAIGLPASAFERYFERSIQDQQHKLKIVKYPDVGELGADGAARQGVGPHKDSMYTSYLLQASGHRGLQVQNLRGDWVDCPPVDGTLVVAIGQGLEALTGGVCASTTHRVLSPAAGEGARFSIPFFQGVRLDTEFEELETAGLGRAVPEEVREQRRRVLLEGSGQRLDDVEFTFRTGGVAKTLGEATLRNRVKSHPDVGERWYPDILASIREEQRIAGRQGAGTSTAPGVEKLRGDAQAV

SEQ ID NO: 32098 - protein, 744 aa, Capsicum annuum
MASSSLPLSQAILSRSIPRHGSSSSTNSQFSPSSLSLPTFSGLKSTTSTTFRRRTLPSPVAVRSPEIRASAAVETLEKTDNALVEKSVNTIRFLAIDAVEKANSGHPGLPMGCAPIGHILYDEIMRYNPKNPYWFNRDRFVLSAGHGCMLQYALLHLAGYDAVREEDLKSFRQWGSKTPGHPENFETPGVEVTTGPLGQGIANAVGLALSEKHLAARFNKPGAEIVDHYTYCILGDGCQMEGISQEAASLAGHWGLGKLIAFYDDNHISIDGDTEIAFTEDVGARFEALGWHVIWVKNGNTGYDEIRAAIKEAKAVTDKPTMIKVTTTIGFGSPNKANSYSVHGSALGAKEVEATRQNLGWPYEPFHVPEDVKSHWSRHVPEGAALEAGWNTKFAEYEKKYPEEAADLKSIITGELPAGWEKALPTYTPESPADATRNLSQQNLNALAKVLPGFLGGSADLASSNMTLMKMFGDFQKNTPEERNLRFGVREHGMGAICNGIALHSPGLIPYCATFFVFTDYMRAAIRISALSESRVIYVMTHDSIGLGEDGPTHQPIEHLASFRAMPNVLMLRPADGNETAGAYKVAILKSKTPSILALSRQKLPQLAGTSIEGTAKGGYVTSDNSSGNNPDVILIGTGSELEIAVKAADELRKEGKAVRVVSLVSWELFDEQSAEYKESVLPAAVTARVSIEAGSTFGWEKIVGSKGKAIGIDRFGASAPAGKIYKEYGITAEAVIAAAKQVS

SEQ ID NO: 32099 - protein, 522 aa, Brucella melitensis 16M
MHKVRQRVINHRQKAAGERYVMFELLTPEEMARADRLTMEGGIKDGFALMLAAGRAVADIAQHMFPQKQPVAVLCGPGNNGGDGYVAAQYLLEAGYEAVCFAAAPPRQGTDAMRASIFYKGQVRDLNEFSPVSFGGIIDALYGAGLARAVEGAQATVIDAVNASGLPVVAVDLPSGISGATGMALGAAMRAKATVTFFRKKPGHLLQPGRAHCGIIHIADIGIPDRILGEINPRVFENSPELWADSLPSPAVDAHKYSRGHAAVFSGAMHSTGAARLSAMAAARSGAGAVTLLSPPDALAVNAAHLTSIMVRETRSQQDAAQFITDRKVTAAVLGPGYGNPAFARDYTKMLLSAASGKAGQFRGLVLDADGITAFENKPDELFDTHRSSATALVLTPHEGEFKRLFPDIAEDNTSKIDKARKAAMRANAVVIYKGPDTVIAEPGGLAVINSNGTPFLATAGSGDVLTGIVCGLLAQGMAPFAAACASVWVHADAARRFGHGLIAEDLPAQLPAVWSSLSRFG

SEQ ID NO: 32100 - protein, 633 aa, Gibberella zeae PH-1
MDAKPFRPRGAENAPHLQQQHKSTGNLANMAKSTTAAGFRGPAKRAAFGDVTNVSKQIGHTRDDGKSIKVYATNGVSHGLTGVPVSKENGAYGKEAFSRPAQRIANQASTRTALENKNFDANKKPYVRKDGHVATKPPAPSSVQNAPSLQPRHHKSQPQLKPQQQPNSLRRTQSKQLDKVVPKPDADTGHKATNPAGFQLQETEYPYDHAAYLDSMYLPIEAGAPLDVLQKEEYPELPAKLPEISEDDAAIHSFEEAHMPAMSEPEECWEEDEDEDYDDQDQAYTTAHSVRSRDMTAGGATEIDPLPRVTARVQRELEDAREEVERTRTTDEIEEEMWDVSMVAEYGDEIFEYMRELEIKMLPNAHYMDDQTEIQWSMRSVLMDWLVQVHNRFGLLPETLFLTVNYIDRFLSQKIVSIGKLQLVGATAILVASKYEEINCPSLGEIVYMVDNGYTAEEVLKAERFMLSMLSFELGWPGPMSFLRRVSKADDYDLDTRTLAKYFLELTIMDERFVASPPSFLAAGAHCLSRLILKKGDWTKQHVYYSGYTWGQLKSLVTMMIECCDRPHLHHAAVFDKYTDRRYKEASLLVQSALDAGFTLPHQVAPVRQELDAYREDSAELPIAQPQLIPIEG

SEQ ID NO: 32101 - protein, 469 aa, Brucella melitensis 16M
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEFRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 32102 - protein, 376 aa, Vibrio angustum S14
MTDKFIKSKAAIAWGPNQPLSVEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPEISLAKINKEAPLEEVCLLGCGVTTGMGAVLNTAKVEEGSTVAVFGLGGIGLAAIIGATMAKASRIIAVDINEEKFELARKLGATDCINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 32103 - protein, 854 aa, Silicibacter sp. TM1040
MDTTPKSTLITATAPIANQTHGGRAKCLQRLVRLELPVPQTVALSFDAVHEIAEGYMVDVNAILADLRPGALLCVRPSSEDPDWGGPGAVLNIGMNDARYVELSDTLGPAAAAALYLRFVQSYAVHVARLDPDVFEDVEDGGPDALSEMLQAYEAEAEEPFPQDPGEQLAAVLRSMARAWEGTSARLLRAAKGAPEDAGLGLIVQEMVPGLGQGECGSGVLQLVNSQTGLPQITGRYLSQSQGRDALGVDAEAIYLEQDERGPSLEELAPEAFAELKAHAALMRRKLRAEMQVEFVIENGRVHILDGVRVPRSSRAAVRIAVRLAEDGIIPAEEALMRVDAYSLNELLHRQVDPNAKRDVIGSGIAASPGAATGRLVFTATEAQASKSRGEPCILARRETSPEDVRGMHAAAGVLTEKGGMTSHAAVIGRGLGLPCIVGASRLRFDSRRKQLTAPDGRVFKAGEIITVDGTSGEVLAGEPAMVEAAEDDALVTLMAWADAARDIAIRANADTPADAQTARNFNAEGIGLCRTEHMFFDPGRLTVMREMIFAETSSGRAAVLARLLPMQRKDFRELFRIMEGLPVCIRLFDPPLHEFLPTTTAGQRELSEALGLPVSDVTRRVAEMGEYNPMLGLRGVRLGVTVPEIYDMQARAIFEATLEASRDGAPVVPEIMIPLVSAKREVELVKARIDAVAAAVKSERGADFTYRLGVMVETPRAALRADEIAAHTAFMSFGTNDLTQMTYGLSRDDAGRFMSAYVQQGVFPEDPFHVLDVDGVGELLQLGVQRGRMAKPEITLSICGEHGGNPESIAFCREAGFDYVSCSPFRVPVARLAAAQLAIADKTGQIAPTYIKN

SEQ ID NO: 32104 - protein, 1135 aa, Sorghum arundinaceum
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVTDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 32105 - protein, 145 aa, Glycine max
MDRKKKITAMEYLVTMVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 32106 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 32107 - protein, 380 aa, Pisum sativum
MAIECITSSAKLMTQKSDKNENEESSKLVFDASFLKNQLNLPKRFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNPSHIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 32108 - protein, 1135 aa, Sorghum propinquum
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDGDPGSDQQPKGRKLWGLVVCHHTSPRFVPFPLRYACEFLLQVFGIQLNKEVELVAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPLDDTKKIQGLLELRTVTNEMVRLIETATAPVLAVDIAGNINGWNNKAAELTGLPVMEAIGRPLVDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMISDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 32109 - protein, 220 aa, Pseudomonas syringae pv. tomato str. DC3000
MSLPLNTPALHANTQPHPGAARVGIGGPVGSGKTRLLEQLIPRFIARGIELAIITNDLATREDAERVQRSGLIDPQRVRAVETGACPHTAIREDPTLNLQMADELEARFGNLDLILIESGGDNLASTFSLDLVDYWIFVIDVAGGDDIPRKRGPGVLNCDLLVVNKYDLAPYVGVDLPRMRRESAEARNGRPVLFTNCATGEGVDEVVEAISRAVLFDRP

SEQ ID NO: 32110 - protein, 513 aa, Solanum demissum
MAGLSLAAGGWTSNLIVFLINEFNMKSIAAAKVFNVVNGLTTIFPIVGGIIADSYLGCFSVIWISSLISALGILLLLLTVVIDALRPLACGDGSSLCTSPSTNQYVFLYVSLALASIGVGGTRFTVAPMGAYQFDKPKHQTMFFDWYIFIFYLCWALSTAFIVYVEDNISWAWGFGISMACNILGLAIFLAGKRFYRHVKEQGGSPFVNLARVVVAATQKWRAPLSDQTQHYYHDPSDKTTLVPTKFFKFLNCAAIITEGDTKPDGSICNPWRLCTVQQVEDLKSLIKLFPLWASGLLISTQLVMQLSLLTLQALKMDRHMGPHFEIPAAISIIDRILNPFLAKYTTFSLTPLQRVGIGHALTISCMAVSALVESRRLRVARSHHLQGQKDAIVPMSVFWLLPQLALNGIGEGFHFPGHIAFYYQEFPTSLKNTSTAMVSLFIGIAFYLGNVLIDVVQRETGWLPDNINDGRMDNVFWLCCTLGSVNFIYFLLVASFYKYKNMESKPNNVPSK

SEQ ID NO: 32111 - protein, 531 aa, Solanum demissum
MAGLSLASGGWTSNLIVYLIDEFNMKSIKTAKVYNVINGCTTLFPIVGGILADSYLGSFSVIWFSSLISALGILLLLFTSAIDVLRPPPCDDGSSLCTSPSTHQYAVLYVALALASLGVAGTRFIIAPMGANQFDKPKHQAIFFNWYIFAFYMSFAISTTVIVYVEDNVSWSWGYGISMAFNILGLAMFLIGKRFYCDVKEQGGSPFVNLARVIVVAIQKWRVPLSEQTQHYYHDPSDTTTTLTITQIPTKSFKFLNCAAFITEGDTKPDGSISNPWRLCTVQQVEDLKSLIKLFPLWASGFLISTQLVIQASLLILQALKMDRHMGPHFEIPAGSMLVFILLFTCIAIFIIDRFLYPFLAKYTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAHYLGNTLIDLVQRLSGWLPDNINKGRTDNVFWLCCILGSANFMYYVVCASLYKYKNVDNKSNIAPSK

SEQ ID NO: 32112 - protein, 531 aa, Solanum demissum
MAGLSLASGGWTSNLIVYLIDEFNMKSIKAAKVYNVINGCTTLFPIVGGILADSYLGSFSVIWFSSLISALGILLLLLTSAIDVLRPPPCDDGSSLCTSPSTHQYAVLYVALALASLGVAGTRFTIAPMGANQFDKPKHQAIFFDWYIFAFYTSFAISTTAIVYVEDNVSWSWGYGISMAFNILGLAMFLIGKRFYRDVKEQGGSPFVNLARVIVIAIQKWRVPLSEQTQHYYHDPSDTTTTLTKTQIPTKSFKFLNCAAFITEGDTKPDGSISNPWRLCTVQQVEDLKSLIKLFPLWASGFLISTQLVIQTSLLILQALKMDRHMGPHFEIPAGSMSVFILLFTCIAIFIIDRFLYPFLAKHTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAYYLGNTLIDLVQRLSGWLPDNINKGRTDNVFWLCCILGSANFMYYVVCASLYKYKNVDNKSNIAPSK

SEQ ID NO: 32113 - protein, 473 aa, Oryza sativa (indica cultivar-group)
MEPKPSTPTAAATPRFKLGKQSSMAPDRGGAGESSEEGSSEAVGVMGFQLMYMAHEGDVEGIRSSSTPAPTPTSATPTAARRCTSPPARGKPRSSSCSSSVGRMPSPRTSGAARCKFYPPLADALHYQNHDVIKILEKHGSKLKIAPMHVKNVREVPEYEISPNELDFTNGNGISKGTFRKATWRGILVAVKKLDDDLIMDENKVQAFRDELDVLQLIRHPNVVQFLGAVTQSSPMMIVMEFMPKGDLRKHLSRKGALEPSYAVKLALDIARGMNYLHEHKPQAIIHRDLEPSNILRDDTGHLKVADFDLCKMLKWRRKVREEKAVTSPGNACRYVAPEVLRNEEYDTKVDVFSFALILQEMIEGCLPFYDKKNNEIEKAHNSKERPPFRAPPKHYAYGLRELIEQCWSENPASRPDFRTIIEQLSYIQNEISQRNRWKVKPLKCFLSFEGMWKKDRNEGSTTRSSRSSRSYF

SEQ ID NO: 32114 - protein, 1217 aa, Oryza sativa (indica cultivar-group)
MSLAGSALEAALQAVGRGLDAAGDHRLLYCKGTGRLLMLDESRARDLTINGGVLRGVPPDVVVEEGHGILERIRQVPGPPTDEPVVCSFPKMAECFNRKAGLLETTVPLGSFNSLFSFTGSWKNDEAATKSLAIDGYSVPLFKVKITSGELFLHESVKRAIPHSWDPSALASFIENYGTHIITSVTVGGKDEVYIKQHSSSQLSELEFRNYVKEIGSERFSDGDSKLNATPINYSEKDMTVIFRRRGGCDLVQNFNDWIKTVQSAPDVIGMTFLPIVSLVGDMPGKKHLARAIELYLKYKPQIEELQYFLDFQVQLVWAPVPPGIAGQHRKEPVCPSLQFSLMGPKLFVSTEQISVGRRPVTGLKLCLEGAKQNRLAIHLQHLGSLPKIFVPHWDSHITIGPPKWQGPEEQDSRWFEPIKWRNFAHVSTAPIEYTETSITDLSGVYIVTGAQLGVWDFGAKSVLHLKLLFSRVPGCTIRRSVWDHSPSSSLVHRTDEASSSSSDNAKLVKIVDMTETLKGPQDAPGHWLMFGKVEAQQLLWSIDLQICSAIYSVDREMHHYLFGKLPKIRQSSEDPFNKQDALYGQANAPSICHSIHLEFLAKMENEEMSKVTQANGIDSREHKGQSIAVEANSKGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQNYKGWDKGFGAATGVMGLALLVFIAGLPGYRISVVQGSTALLEILQVYVAAIRNRNMKLPENPDELYEISKSKAPPDTDFMAHRDKPFRFLDKAAVVQAPTDEAPSPWRQCRVTQVEHAKTVLAMVPIFCSAIIMSTCLAQLQTFSIQQGVTMDRTIGTFEMPPASLPIIPLIVLVFAVPIYERGFVPFARRITGHPNGIPHLKRVGVGLVLSIVSMAIAAVVEVRRKRVAARHGMLDANPMLGKQLPISCFWLAPQFTVFGVADMFTFIGLLEFFYSQAPPALKSMSSSFLWCPMSLGYFLSTIIVKAVNAATKGATASGGWLAGNNINRNHLDLFFWLLAVLSFLNFLNYLFWASWYKYKPQQSAHVPAEHKV

SEQ ID NO: 32115 - protein, 257 aa, Bacillus licheniformis ATCC 14580
MPLPYEKTSYLFYSHVMMQKSCQLSEANISRFSGGHPFRTRDKTRQMSQFVYFVSCGNVVAAVRMNGRDEGGFFMKKAYVFLIDGFEEIEAIATIDVLRRAEVETVTVSLDPSRSVKGGHDIVVEADVMFDDADWQEADMLILPGGNVGSKKMLEHQALHKMLTEAANAGKYVAAICAATMTLGKTGLVSGKKATCYPGVEEHLTGADVTAHENVVVDGNIITSRGPATTIPFALKLAELLNGKEKAGAVAKGMLVC

SEQ ID NO: 32116 - protein, 307 aa, Glycine max
MAPPRGGGGFRGGRGDRGRGRGGGGGRGGDRGTPFKARGGGRGGGRGGGGRGGGRGGGRGGMKGGSKVVVQPHRHDGIFIAKGKEDALVTKNLVPGEAVYNEKRITVQNEDSSKDEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKAGGHFVISIKANCIDSTVPAEAVFESEVNKLKADQFKPFEQVTLEPFERDHACVVGGYRMPKKKKDAAE

SEQ ID NO: 32117 - protein, 639 aa, Vibrio angustum S14
MSNRKQARLEAKQFIESLTAQPYPNSQKVYVQGSRPDVLVPMREITLANSLVGGSKENPIFEPNEPIRVYDTSGFYTDPEKNIDIYNGLPLVREQWIAERGDTELLEGLSSEYANERLDDKTLDDLRFAERARIRCAKAGHCVTQLHYARQGIITPEMEYIAIRENMGRAKYRDEVLNQQHPGVSFGANLPKEITPEFVRKEVAEGRAIIPANINHPETEPMIIGRNFLVKVNANIGNSAVSSSIEEEVEKLVWSTRWGGDTVMDLSTGRNIHETREWIIRNSPVPIGTVPMYQALEKVNGVAENLNWEVFRDTLLEQAEQGVDYFTIHAGVLLRYVPMTAKRVTGIVSRGGSIMAKWCLAHHKESFLYQHFREICEICAQYDISLSLGDGLRPGSVADANDEAQFSELRTLGELTKIAWEYDVQVMIEGPGHVPMHMIKENMEEQLEHCHEAPFYTLGPLTTDIAPGYDHITSGIGAAMIGWYGCAMLCYVTPKEHLGLPNKDDVKVGLITYKLCAHAADLAKGHPGAQVRDNALSKARFEFRWEDQFNLGLDPETARAYHDETLPQESGKVAHFCSMCGPKFCSMKISQEVRDYAKGLEDSEIAIKLLDDPLEGMQQKAQEFRSKGSELYHLAKEES

SEQ ID NO: 32118 - protein, 391 aa, Nostoc punctiforme PCC 73102
MAMKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAQYARVPFADTGLFKIPDGLTDEQVVFLTDIFPTGYMAADNCNIQPGDIVAVWGCGPVAQFTIKSAYLLGAERVIAIDRIPERLQMAKDQGKAEILNYEEVDVGEALKEMTGGRGPDACIDAVGLEAHGTGLEGVYDEVKQAVRLETDRPHVLRQVMIDCRKGGHVSIPGVYVGVVDKIPMGAAMNKALVFKMGQTHVHKYLNTLLDHIQNGRIDPSFVITHRLPLDEAPRGYEIFRDKKENCIKVVLKP

SEQ ID NO: 32119 - protein, 77 aa, Oryza sativa (japonica cultivar-group)
KAVFKELELKKEPYVVELDQREDGWEIQDALSDMVGRRTVPQVFVHGKHLGGSDDTVEAYESGKLAKLLNIDVKEDL

SEQ ID NO: 32120 - protein, 774 aa, Rhodopseudomonas palustris CGA009
MAGERMASYSEDLQAAALGYHRRPKPGKLEIQASKPLANQRDLALAYSPGVAAACNAIAADPAQAAELTVRANLVAVVTNGTAVLGLGNIGPLAAKPVMEGKAVLFKKFAGIDVFDIEIAAETVERVVETVAALEPTFGGINLEDIKGPECFEIEAMLKDRMKIPVFHDDQHGTAIIVGAAVKNALALTGKDISKVKIVAAGAGAAALACLNLLVSLGAQRKNIFVCDLEGLVYEGRNVLMDRWKEVYAQKTDKRTLAEVIPGADIFLGLSGPNVLSQDMVKQMAERPLVMALANPTPEIMPEDVRKVRPDAMICTGRSDFPNQVNNVLCFPYIFRGALDVGATAINEAMKHAAVDAIAQLAREAPADPVSVGLDNDEAFGFGPGSLIPSPFDPRLILRIAPAVAMAAMDSGVATRPITSFDDYYAQLERFAFRSGLVMKLVFAKAKGQPVRVIYAEGEDEKVLHAVQTILEEKLARPILVGRPSVVEARIKRSGLSIRPGEDFDLVNPQDDPRYRSYVQSYIDIAGRAGVTPAAARTVVRTNSTVIAALAVARGEADAMICGLDGRYMNHLRHVRDVIGRRPGVSDYAALALLITKKGPIFIADTQVRPNPTAEELAELAALAAVHVQRFNIKPKIAFLSHSDFGSFPTDSSLKMRRATAILAEKHPEIEADGEMQGDSALSETSRQMILPHSRLTGVANVLIMPNLDTANVAYQMIKVVGEALPVGPILIGPALPAHILTPSATARGILNMTAVAVVEAQERAGRHQGTLFA

SEQ ID NO: 32121 - protein, 420 aa, Medicago truncatula
MGVLLPLFFYVIAFFCTVGAIALAILHIYRHLLNYTEPTYQRFIVRIVFMVPVYALMSFLSLVLPRLSIYFNSIREVYEAWVIYNFLSLCLAWVGGPGSVVISLSGRVLKPSVCLMTCCFPPIPLDGRFIRKCKQGCLQFVILKPILVVVTLILYAKGKYKDGNFNPKQSYLYLTIIYTFSYTMALYALALFYVACKDLLQPFNPVPKFIIIKSVVFLTYWQGVLFFLAAKSGFIQDADEAALLQNFIICVEMLIAAVGHFYAFPYKEYAGANIGGSRGLTASLGHALKLNDFYHDTVHQFAPTYHDYVLYNHSEGEEGTRKYRSRTFVPIGPEMDNVRKNKHITGNKVDDIQLTSFSSDSSTPSNSGSLPDASNSDAIKSSLLVDVSTSASIPYDLTLIDLDVSSYPEEVPAADKAGLR

SEQ ID NO: 32122 - protein, 544 aa, Brucella melitensis 16M
MSPLTNFFSRAYHALLRARASKNRKTGSIMSREKYYITTAIAYPNGKPHIGHAYELIATDAMARFQRLNGMDVYFLTGTDEHGIKMLQSARKEGITPRELADRNTSAFRRMAEVLNSSNDDYIRTSEERHYKASQVIWQAMVANGDIYKGGYAGWYSVRDEAYYGEEETEVRADGVRYGPQGTPVEWVEEESYFFRLSAYQDKLLDLYENNPGFIMPAERRNEIVSFVKSGLKDLSISRTTFDWGIPVPGDEKHVMYVWVDALTNYITALGYPDTTDERWAYWPANAHIIGKDISRFHAVYWPAFLMSAQLPLPKRVFAHGFLFNRGEKMSKSVGNVIDPFELVERYGLDQLRYFLMREVPFGQDGSYSHEAIVNRTNADLANDLGNLAQRSLSMIAKNCEGKVPQPGAFSEADKAILDQADAALETARKAMDDQALHLALGAIFAVVAEANRYFAGQEPWALRKTDPARMGTVLYVTAEVLRRVGIMVQPFIPQSAEKLLDILAAPADKRQFADVLASPLAGGTDLPAPQPVFPRYVEADEQN

SEQ ID NO: 32123 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKRTFFGNFKPRTDLPNVVEMYMKKELEVEKFITHSVPFSEINKAFDLMAKG

SEQ ID NO: 32124 - protein, 361 aa, Triticum aestivum
  misc_feature (113)..(113): Xaa can be any naturally occurring amino acid
  misc_feature (170)..(170): Xaa can be any naturally occurring amino acid
MGYLPSLGGKAAHLVSDLATVILNPVSGHERERSSHLPEATEGQENLYGDEESEIPNGPDTSSFRAFLMSFMSASSSSNDSMEIIPEKDLDMEYPTLTPVGRGIKERKGLLSXGKPSIGKIITKAGRLGGSKQKSGQIIDNEIRNPIESMSSGFPLKVSKGSASNHKFPXMSEPSMLLSNESGNVLYPSLPVLVQGKNWMLVYSTWRHGVSLSTLYRRSMLCSGDSLLIIGDKKGAVFGGLVEAPLRPIMQRKYQGNKNCFVFTNVAGRPVVYRQTGANNYFTFCSPEYLAMGGGGHFALYLGEDLLNGSSSTSETFNNPCLALSQDFEVKHVELWGFVNASKYDEMLTVCRTEKPGIWNL

SEQ ID NO: 32125 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKASDLMAKG

SEQ ID NO: 32126 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 32127 - protein, 100 aa, Glycine max
  misc_feature (13)..(13): Xaa can be any naturally occurring amino acid
  misc_feature (81)..(81): Xaa can be any naturally occurring amino acid
MASSTISDPAVTXVNHAQADIVTTFTDLKSKTALPTRNTNNDITSIGSNTGRVHFMQAYPAHNKNNTDTVSYLAHLYDAQXSKDEEYLIMNGWMNCLQFK

SEQ ID NO: 32128 - protein, 368 aa, Oryza sativa (japonica cultivar-group)
MSRPHLPKDDHAFANGFLFDGVARRPGEIEEAAAFAAAADVAITIAAEQSGSPSSSTAPPMSSCGQYMLHRVGKLDTLAGIAIKYGVEVADIKRLNGLSTDLQMFAHKTLRIPLPGRHPPSTYQQNGSYEGDDRECTPPRRLHDDILDSVLRTPKHKASPAMSLLQGYYGLTPPPKKDTTHEGTEMAVYRKGKSVFLDDDPWFGEPPDSDPFPFQHRKTRSLAIGSSLLNGETEENGDSEKLIRRRQKADGELLPREENGSSAVLARAGKGLALRPKSGSRQDLNKSQQNLIALAEPSFGDGLHAVRKSSSTPEFQEPESNSSSTSSSIWSTSKWTLKPDAFTLPLPLPLFDNIPKPIAAWRNKAARD

SEQ ID NO: 32129 - protein, 197 aa, Synechococcus elongatus PCC 6301
MTHATDVLTLARWLAADFSNQAQAFENPPFFAHIRVCMRPLALEVLDGLSLYVEQAYDLDVNQPYRARVLKLVPAGDHIEIENFRVIDGEDLFGASRDRDRLAKLTRDRLEKLPGCTLITHWTGNGFKGVVEPGKGCIVERKGQATYLESEFEIDDEKMISLDRGRHPETDEQVWGSVAGPFHFLRWHSFADEVPTP

SEQ ID NO: 32130 - protein, 205 aa, Zea mays
MQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGY

SEQ ID NO: 32131 - protein, 474 aa, Streptomyces ghanaensis
MTSTAQQPAAGGLAARPNQLRHVVFIAASAAMGGFLFGYDSAVINGAVEGIRGRFDVGAATLGAVIAIALLGAAAGAMLAGRLADRVGRLRVMQLAALLFLASSIGSMLPFTAWDLSFWRIVGGVAIGMASVIGPTYIAEVAPTEYRGRLVSFQQAAVVLGIAVSQLVNWMVLSLADGDQRGSLLGLEAWQVMLGIAAVPALVYGLLALRIPESPRYLVSVGRTGEAKEVLRTLEGAQVDLDARVAEIEHAARSDKAPRFKDLRGRFGLLPIVWVGVGLSVFQQFVGINVIFYYSSSLWQSVGIDPSSSFFYSFTTSVINIVGTVIAMVLIDRVGRKPLAATGSAGMAVSLAAVAWAFSYKTGTGDDISLPDTQATVALVAAHAFVLFFAMSLGVAAWVLLGEMFPSRIRAAALGVAACAQWVANWLVTATFPSMAEWNLSGSYVIYAIFATLAVPFILKWVPETKGRTLEEMG

SEQ ID NO: 32132 - protein, 200 aa, Brassica napus
MSGRDRISELPESLLTQILSYLPTEQSVQTSVLSKRWENVYLSVPGLDLNCSVIRDEVILSFLSFIDKLLEFSPESSLFKVKVQCRGMLIDGFSDRIGTVIDRGTQHLDVVSSTDYYEDSFGHALPGVDFMPMNLYTSKALVYLKLSSSGLGDPGFVFMPCLRFLHLEEIKWRVHLEKVLSGCPVLEKLNLVRDLDDDDY

SEQ ID NO: 32133 - protein, 197 aa, Methanosarcina mazei Go1
MVLGSKLLDNVKMHLCTCSAGLRPTPDMEAFLKMPMRELYVSLPIHMDDGSIKVFKGFRVQYNEALGPAKGGIRFHPDETMETIRALAALMTWKCALHRLPLGGAKGGIVCSPKELSHRELERLSRAYIRAVYQIIGPDRDIPAPDMYTNPQIMAWMMDEYSKLAGKMSSAQLQANPQVWEVLLAGLMQRLKVACMR

SEQ ID NO: 32134 - protein, 417 aa, Vibrio vulnificus CMCP6
MDYFNYQDDGQLWAEEVSLTSLAEQYGTPLYVYSRATLERHWHAFDRSVEGHPHLVCYAVKANSNLGVLNTLARLGSGFDIVSGGELERVLAAGGDPRKVVFSGVGKTEAEMRRALELNIKCFNVESEPELERLNRVAGELGVKAPISLRINPDVDAQTHPYISTGLRDNKFGIAFDRAPAVYQFAQSLANLNVQGIDCHIGSQLTAIEPFIDATDRLLALIDDLKEQGINIRHLDVGGGLGVVYRNELPPQPSEYAKALLGRLENHQDLELIFEPGRAIAANAGVLLTKVEFLKHTEHKNFAIIDAAMNDLMRPALYQAWQDIVPVQPRQGEAVTYDLVGPICETGDFLGKDRSLVLAENDLLAVRSAGAYGFVMSSNYNTRVRAAEVMVDGKQHYLVRQREELRSLWELEHILPE

SEQ ID NO: 32135 - protein, 301 aa, Bacillus clausii KSM-K16
MDFGYLMTAMVTPFTNENALDVNGIRTLIHHLANNGTDTVVIHGTTGEAPTLTLEEKQTLLSVAVEEAANANIKVIAGIGANSTQQAVQMAQLAEQTGADGLMVVVPYYNKPSQEGIYQHIAQVAQSTPLPVLLYNVPGRTGADMSAETALRLAEIDQVFAIKEASGNIDKVTEILRLAPEGFSVYSGDDSLTLPMMAVGAKGVVSVASHIVGREMKQMIDAFASGELQLAASIHHKLFPVMKAMFMAPSPAPVKEALARYRLPGGGVRLPLIGLNEAENMELAAVLEPFLPIASRSVASS

SEQ ID NO: 32136 - protein, 216 aa, Vibrio vulnificus
MSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLLEDEEGSNSAE

SEQ ID NO: 32137 - protein, 324 aa, Haloferax volcanii
MTEEIVVIPGDGIGAEVIPAAVDVLKAVGDFEFVEADAGDHVKEETGEALPQETYDLAAEADATLFGAAGETAADVILPLRTAVDSFVNVRPAKAYPGVDALRPETDLVFLRENTEGVYSGHEDRLSEDLSTLTRVVTTSASERLAEYACDYVGGEGGSFQVAHKANVMRETDGRFRDAAVAVADERGVETEEVLMDAFATRVCLDPTQFDTIVCPNLAGDVLSDLAAGLVGGLGLLPSANIGPDAALFEPVHGSAPDIAGEGIANPAATILSAAMLLDYLDHEAEADRVRSAVEGVLADGPRTPDLGGDASTEDVTAAILDRL

SEQ ID NO: 32138 - protein, 170 aa, Prochlorococcus marinus str. MIT 9303
MIVSDSSPSAWLGLLDNAVLAWGLAACGLAQLSKLIVELILYRRWRPAVLLETGGMPSSHSALVTGTAAGVGWEMGFDHSGFALAATVAFVVMYDASGIRRAAGFTAARVNLLPVETWPTPPEKQLKESLGHTRFEVLVGSLIGPAVALPGLVFVGSPLHLSQLLGMTLG

SEQ ID NO: 32139 - protein, 216 aa, Vibrio vulnificus YJ016
MSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLQEDEEGSNSAE

SEQ ID NO: 32140 - protein, 1010 aa, Yarrowia lipolytica CLIB122
MGVPGLYRHLSQKCPKIVSDVIEDETTIVDGEEIPGSDYSAPNPNGELDNLYLDMNGIVHPCTHPEGEEAPPSEDEMLLAVFKYTERVLNVCRPRKVLMMAIDGVAPRAKMNQQRARRFRSAKDAAIEAESTLESELKAKTIELQSSGEKGKSLETILDEFKQGLVNKPGKWDSNAITPGTPFMEKLAAALRYWVGYKLNTEPGWRDLKVVISDATVPGEGEHKIMEFIRSQRGDPTYNANTSHCIYGLDADLIFLGLATHEPKFKLLREDVFRQNKTAGHQKKPFIWLNIDILREYLREDLRFTHPQTKIPFDLERAIDDWVFLCFFVGNDFLPHLPACDVRDGSINVLVNQWKNGMTRWKDYITCDGHVNLAQAQDLLKNFATQEQRILVHQEQDRVEYEKSQANKAAKQQAHRDSKKLRQQGEQAALESMPLYDTKGESVGDVQLTNRELVGQRNDITLANLANQDAADKLRFMLKRGSDTGAEEPAKRAKIEEEPKEAESNSSEATPPTANPSIANDADLSNPNVTVHETTGYADHVQFHKSGYTERYYMNKFHAKEDEVDNLRRQVAEEYMKGVCWVLMYYYHGCQSWSWFYPYHYAPLAGDFDQISNMKVEFGESAPFRPYEQLMSVLPAASGHNLPAVFRPLMSEENSPIIDYYPENFQLDLNGKKQEWKAVVLLPFINADHLLEHVQAKYTELTPEEKDRNTLREEIVIFHRLGKYAKTLEKRGLMEKGVIVSKKPLVLNSHETSGLAGTVERQNEADRTSSKPHLTFPLNVSTDQTMPSFEADKNMAMTLEYKIPKLEYENKSMLLQGYIPPKYTLSDEEREAIRNRERQRRGGQQDSRLFSNTDHRQQQELLMNGSYLAFKKLSLRDQPPPAKEDWMLNDPKLAGDRGNGGYNNRGGFNNHRGGRGGFNNRGRGGFNHGGGGFNNSRGGYGGGGGGYGGGGGQGYGGGQGYGGGQGYGGGQGYGGGGYGGGQGYGGGGYGGGYGGGHRGGHRGGRGGHRY

SEQ ID NO: 32141 - protein, 474 aa, Bacillus cereus G9241
MKKHLYINGDWKSVNTYKPLYAPYSEETLAEIAQGTEEDVKEAVTAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPKGALNIISGPGSTVGEAIVTNDDVASITFTGSPKVGIGIKAKAGLKRVTLELGSNAAVIIDKDVELTDELIERVKWGAFVNNGQVCISVQRVFVHEERMDEFLSKLQKAMETLVVGDPLIEETDVSALISKKDVDRIDNWVQEAVKEGANVLYGGNKRDERIFEPTVLTNVPKHVSVQCQEVFGPLMTVNTFKEFDEAIEQANHSRYGLQAGVFTNNLFKAMRAIDELEVGGVMINDIPTFRVDHMPYGGVKESGTGREGIKYAIEEMTEMKLVCIKK

SEQ ID NO: 32142 - protein, 140 aa, Rhodopseudomonas palustris CGA009
MAIERTFSILKPDATERNITGAINALIEKAGLRIVAQKRIRMTRDQAETFYAVHKERPFFGELVDFMISGPVVVQVLEGEGAIAKYRDVMGATDPSKAADGTIRKLHAKSIGENSVHGSDAAETAKIEIAQFFSGNEIVG

SEQ ID NO: 32143 - protein, 303 aa, Physcomitrella patens
MDQYEKVEKIGEGTYGVVYKARDRLTNETIALKKIRLEQEDEGVPSTAIREISLLKEMHHGNIVRLQDVVHSEKRLYLVFEYLDLDLKKHMDTCPDLAKDPRLIKTFLYQILRGIAYCHAHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRTLGTPNEEVWPGVTSLPDFKTAFPKWPPKPLSSVVPSLEPAGIDLLEVCDLSTPASEFCVVLFFFIISTFSLIVRLKQCMQSYAS

SEQ ID NO: 32144 - protein, 228 aa, Methanococcus voltae
MAKIKEKFDNVFELDLGDGIKRIGTKSLVPNKRVYGEKLVNVKNTEYRVWNPNKSKLGASIINGLKEMPIKKGSKVLYLGASAGTTPSHVADVAEDSPVYAVEFAPRIMREFIESCEGRKNLFPILGDANKPEEYANIVEKVDVIFEDVAQPNQAEILIKNAKWFLKKGGYGMISIKARSVDVTENPRVIFEAQKEIMEQNGFKIVDAINIEPFEKDHMLFVGIWNGQ

SEQ ID NO: 32145 - protein, 428 aa, Zea mays
MITCSFPLMVLHTHQLLKECPPMWNPQYWQPNPYDFPSGSNIQFSSSHLTIPSLSQQQNEVGGFANRGPWNHFVGMMNPSYPCPPPPLAAGQMQPPSHFVTLPNNSSNPMDPIFLESEAEHSAQEVNSPSKEGGTPGKGKKMKEQNFTPEEDLLLCTTWLEISCDPVISTGQRKEGLWARIDKQYNEMRGEYPKRVIRALTSRWDKIKADCGKYASLYARVLRENQSGLTDYDKTSMATTLFTTENKRGFPFMHCWTKLKNEPKWQAIVQGTSLRGAAGMSPVGSATPTASVNDLDSDSLGLTGKRPLGRDSTKASRKKAMSTSSQSMKYLTRIHDLQMARLKQSEDKVEKKEAHYEVFKDLEYKKLQVQQEQIEVEKTKLKFQERKEKNDELKEAMAVDLEDIAEDLRPAFIAKRKALVDWFVNNPN

SEQ ID NO: 32146 - protein, 344 aa, Xanthomonas axonopodis pv. citri str. 306
MAATSRSAYASASPDVPVAISFIAADVGGTHVRVGHMLQARDAAIELSHYRTYRCAEYASLQAILEDFLQQRRGVDAVVIASAGVALDDGSFISNNLPWTISPSRIGAALAVRNVHLVNDFEAVAYAAPQMEQRAVLQLSGPTPRHARANGPILVVGPGTGLGAALWIDAKPRAIVLATEAGQVALASTHPREYAVLQCLLRDRHYLPLEHVLSGPGLRHLYDAVCELHGATPRHRLPAAVTHAALHEDDALARECLEIFCGLLGSAVGDMALAYGAAGGIYLAGGFLPTIGQFLAGSAFAERFLDKGNMRAVLERIPVKLVEHGQLGVLGAANWYLQHHTDLS

SEQ ID NO: 32147 - protein, 179 aa, Silicibacter sp. TM1040
MSTSKTVKDYIRTIVDFPHEGIMFRDVTTLFADPRGFRMAVDQMLHPYAGQRIDKVVGLEARGFILGGAIAHQLGTGFVPVRKKGKLPGATISQEYKLEYGEAVVELHKDAIQPGEKILVVDDLLATGGTAGAGIKLIEKLGGEIISCSFIIDLPELGGRKHLQSLGMDVHVLCEFEGL

SEQ ID NO: 32148 - protein, 116 aa, Photorhabdus luminescens subsp. laumondii TTO1
MTTTIEKIERQIKENPILLYMKGSPKLPNCGFSAQAVQALSACGERFAYVDILQNPDIRAELPKYANWPTFPQLWVEGELIGGCDIIIEMYQRGELQTLIKETADKCRSQGENATE

SEQ ID NO: 32149 - protein, 156 aa, Haemophilus influenzae
NRANTPVLVDGKDVMPEVNAVLAKMKDFCQRIISGEWKGYTGKAISDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 32150 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMEKG

SEQ ID NO: 32151 - protein, 165 aa, Aloe vera
SGYSLLRDPHHNKGLAFTDKERDAHYLRGLLPPVCISQELQEKKLMRSLRQYQVPLQRYMAMMDLQERNERLFYKLLIDNVEELLPVVYTPTVGEACQKYGCIFKRPQGLYISLKEKGKILEVLKNWPERSIQAIVVTDGERILGLGDLGSQGMGIPVGKLSLYT

SEQ ID NO: 32152 - protein, 99 aa, Triticum aestivum
  misc_feature (40)..(40): Xaa can be any naturally occurring amino acid
MHCRRVITKFAVSYMVMWMRSVAIMYGFIYQIFPGVGQLXIWALIMHSGFFGVIWVNVVMGFYIYMCMKEARHQEPAALSTLSVKCQSKHQPASLLASE

SEQ ID NO: 32153 - protein, 532 aa, Petunia integrifolia subsp. inflata
MGNCCSRGQPNESNDHTESISTAKNGDGKVMQGGSVTPPKTPPPASPDPSSKPSKTSPIGPVLGRPMEDVRKTYSIGKELGRGQFGVTHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIGHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHIDFSCDPWPAISHGAKDLVRKMLTIDPKQRLTAIQVLNHPWIKEDGDAPDTPLDNAVLSRLKQFRAMNNFKKVALRVIAGCLSEEEIMGLKQMFKSMDTDNSGAITLEELKTGLAKQGTKLSDYEIQQLMEAADADGNGTIDYEEFITATMHMNRMDKEEHLYTAFQYFDKDNSGYITVEELEQALREFGITDGKDIKDIVAEVDSNNDGRINYDEFVAMMKKGTPDTAANLKKRRESFDAK

SEQ ID NO: 32154 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERNLKGTFFGNFKPRTDLPNVVEMYMKKELEVEKFITHSVPFSEINKAFDLMAKG

SEQ ID NO: 32155 - protein, 645 aa, Streptomyces ghanaensis
MCGFVGFSDAGAGQEDARVTAERMLAAVAHRGPDGSDWCHHRGVTLAHCALTFTDPDHGAQPFVSASGATAVVFNGELYNHAVLGDGALPCAPGGDTEVPGGTLRVAGHADARPAAGHVRLRAAGRPHRHHGAGRDRWGRAPLLTPACETDIAFASELTSLLRHPAAPRTPEVRALADYLVLQAFCAPASAVSGVCKVRPGSYVTHRHGALDETEFWRPRLTPDRGAGRGPGRREAARRFEELFRAAVARRMTSTDRRLGVLLSGGLDSSAVAAVAQQLLPGRPVPTFSAGFADPDFDESDHARAVARHLGTEHHVVRIGGADLAGVVESELAVADEPLADPSLLPTRLVCRAAREHVRGVLTGDGADELLLGYRYFQAERAIELLLRVLPAPRLEALVRLLVRRLPARSGNLPVTHALGLLAKGLRAAPEHRFYLSTAPFGPGELPRLLTPEAGAELTGHDPFTEVSRLLRGQPGLTGVQRSQLAVVTHFLRDVILTKTDRGGMRSSLELRSPFLDLDLVEYGNSLPTGLKLHRFTGKYLLRQVAAGWLPPSVVQRTKLGFRAPVAALLRGELRPLLLDTLSPSSLRRGGLFDTGAVRLLIDDHLGGRRDTSRKLWALLVYQLWFESLTAGPRALESPAYPALS

SEQ ID NO: 32156 - protein, 248 aa, Borrelia burgdorferi
MYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 32157 - protein, 386 aa, Solanum demissum
MASDSIIPLLLLPDELITEILLKLPVKSLSKFMCVSKSWLQLISSPTFVKNHIKLTADDKGYIHHRLIFRNIDGNFKFCSLPPLFTKQQHTEELFHIDSPIERSTLSTHIVGSVNGLICVVHGQKEAYIWNPTITKSKELPKFTSNMCSSSIKYGFGYDESRDDYKVVFIHYPYNHSSSSNMTTVVHIYSLRNNSWTTFRDQLQCFLVNHYGRFVNGKLYWTSSTCINKYKVCNITSFDLADGTWGSLDLPICGKDNFDINLGVVGSDLSLLYTCQRGAATSDVWIMKHSAVNVSWTKLFTIKYPQNIKTHRCFAPVFTFSIHFRHSEILLLLRSAIMIYDGSTRQLKHTSDVMQCEEIYVESLVNPLTISDQGRRNQESPQSSHS

SEQ ID NO: 32158 - protein, 335 aa, Arabidopsis thaliana
MALLRPHLHRFHSNTLRHSAYPSADAGGGLVVYPTYGRHRCSAIAIDAPSSLTGVTPIRWGYTSVQGFRDEMEDDIVIRSDAVDSFSYAAVFDGHAGSSSVKFLREELYKECVGALQAGSLLNGGDFAAIKEALIKAFESVDRNLLKWLEANGDEEDESGSTATVMIIRNDVSFIAHIGDSCAVLSRSGQIEELTDYHRPYGSSRAAIQEVKRVKEAGGWIVNGRICGDIAVSRAFGDIRFKTKKNDMLKKGVDEGRWSEKFVSRIEFKGDMVVATPDIFQVPLTSDVEFIILASDGLWDYMKSSDVVSYVRDQLRKHGNVQLACESLAQVALVK

SEQ ID NO: 32159 - protein, 332 aa, Vibrio vulnificus CMCP6
MVNNSSPLSYTQEALFEQAIGGPIAALWQQRQEGFLKTRDKMQLYWCKLTNPQHKKAVLVVNGRIESAWKYQELLFDLYRQGYDVYSYDHRGQGLSDRLVKDSDIGHVYEFDDYILDMEAVIAHFDFSPYQQRHIVSHSMGGAVATRYLQTHPQHGFDKLVLSAPMFGIDLPWYLSPVAMAVSQILTAVYPTPTYAPGHKSYYEKPFEDNPLSQSQARYQWFRQLYRDKPELQVGGPSTRWVWQGLMAAKQCILLTRQLTIPVLLLQAGGDRIVSNQAQSQFFKKLHKTNKRSEMVTIEGAQHELLFEKDHYRNQALSAMFRFLQKEESNQA

SEQ ID NO: 32160 - protein, 205 aa, Vibrio angustum S14
MLEPITTAPRVAVCLAPGSEEMEAINTIAILKRAGFKVTIASTAEDGALILEGSRGIKLVADVPLINVADEPFDCVVLPGGLQGAEHFRDSPLVVEFVKQHHYDGKLIAAICATPAVMFISHQLFTHSIMTCHPAFQNHIPAHQLRVKRVVYDKNTRLLTSQGPGTAQEFALEIVTQLENKAKAAEVAEPMVVWPNMHYDVLPRT

SEQ ID NO: 32161 - protein, 461 aa, Oryza sativa (indica cultivar-group)
MATCSWAATTAAAAPPRPPARCRSRVAALRRTAAASAAAATCVLAEAPKGLKVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVAFVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 32162 - protein, 506 aa, Coprinopsis cinerea okayama7#130
MATNAARKLPQRRGIGQRVKADENAMSRHSRHGSIGASRFSAKENASKGGVVRQALGEVTAVAVNRNKQDPVHKAGVGKELKEEIGMKRGRSDSTTLAQRVPLGPSRNPPMANVPQATVNMRVPSVRPKIPAAISNNRISRSSTLETVVYQDPVPAETHVRMEVEHAEDDVGHEQEVEAMVGVDVDDVPETPGAALASEEDKPERVWPEYSTQRAKRFQREVDHVRERFEDEVDMYDTTMVSEYADEIFKYMEEMEDEIMPNPDYMDGQNEITWSMRQTLVDWLLQVHLRYHMLPETLWIAINIVDRFLTKRVVSLVKLQLVGVTAMFVAAKYEEILAPSVDEFVFMTESGYTKEEILKGERIMLQTLDFRISHYCSPYSWMRKISKADDYDVQTRTLSKFLTEITLLDYRFLRVKPSMIAAIGMYCSRRMLGGDWNEAFVFYSGYTEEQLIPGFDLIISKLVEENFSKLYVCKKYANKKFLKASIFAIEWAHAHLERKHETMTLE

SEQ ID NO: 32163 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFLEINKAFDLMAKG

SEQ ID NO: 32164 - protein, 886 aa, Aspergillus nidulans FGSC A4
MLTSKAYAGPLGLPSSQTPTASYHTTTQKSSTFSESQTGTVYTSPTKSEFSEADDGLDAVRSWDENQVISWLHSINCQQYEPLFRANNFNGNNLIECDQKILQEMGIKKIGDRVRIFVAIKQLRNKSVVNKKQKNLRQLAALEAAHQQASPDSARSYSARQQTSSAGHASRTGDYSYGRPTSRPGSPLRPHRYVANSPMDSGRKDYLSAGSGAGRNPGTPVERIGTHSRQNPSLDGMTMGSLLSNAPVIRVIYSGGQTKVLDIKHCKTPDEIILCVLKKLQLPEHQYRNYCFYVLDGLDPDPSNCRRLSDHELMEICEGFHRSERGRLILRKIHAGEPDAEEVHRAAQLALDESQQAHMNALSSSNARNQMKIQQLTGESWHNIRQPMSPVSSRHNTTPSDHEIRPPQVSERVSKLRSFFGARPPSEMIIHEISSYFPGHQREDIEKTMRMSVRRSQRLSRAASRLSVVSNTSYASSLRDAPPIPSIADTWLNNGTPPTRAARPLSVLSTRPGLPSTSYRDSIASSSLHPLQEESPVEPNRKSYVSFDSGSDDPNNSRHSLLDENASVAATDGGSFNERLSVLVAEDGEEEDDGLAEFLAGNNFVNWMKGSLIGEGSFGSVFLALHSITGELMAVKQVEIPSATKGTEFDKRKNSMVEALKHEIDLLQGLHHPNIVQYLGTTADDQYLNIFLEYVPGGSIATMLKQYNTFQEPLIKNFVRQILAGLSYLHSKDIIHRDIKGANVLVDNKGGIKISDFGISKRVEASTVLGSRASNGGGHIHRPSLQGSVYWMAPEVVRQTAHTKKADIWSLGCLVIEMFIGSHPFPDCSQLQAIFAIGSNKARPPAPEHASKDAVAFLDMTFQLDHEKRPDADELLKSPFLATTLT

SEQ ID NO: 32165 - protein, 120 aa, Glycine max
  misc_feature (87)..(87): Xaa can be any naturally occurring amino acid
MGLDLFFWFVLCLPLNFAFLASTFYQVLMLSDLEADFINPYDAASRINYFIVPEFIGQGLLCAFCLLTGHWIMFLITVPVTCYHVMXRYMKQTHLIDVTEVFRLLSAEKKFRIAKILLIT

SEQ ID NO: 32166 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPQGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 32167 - protein, 664 aa, Oryza sativa (indica cultivar-group)
MATGMLLRGLRSAASRTSPVFPTSASSPAPYVSPLLRRLYSAAAASAAASPALGPGGALDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLEFTKSPPDNAKNMSALLDSILQHVPSPKADLEAPFQMLVSMMERDFYLGRILTGRVRSGVVRVGDKVHGLRSTDDGVQKIEDGKVVKLMKKKGTSMVIVEAAGAGDIISMAGLAAPAIGHTVSNSDVLTALPTIELDPPTISMTFGVNDSPLAGRDGTHLTGAKIGNRLMAEAETNLAINVLPGPLSESYEVQGRGELQLGILIENMRREGFELSVSPPKVMYKTDRGERLEPIEEVTVEVDEEHVGFVMETLTHRKGEVMDMGPVPGTTGRTRIFLTCPSRGLVGFKGIFSSFTRGTGFMHRAFQAYAKYRGQLGNVRKGVLVSVGKGLITSHALMSLEARGILFVSPGMEAYEGMIVGEHSRDSDLDINPVRTKELTNIRAPGKDENVRLSPPRLMSLEEAIGYVAADELIEASFLYLLLMILLVYLCED

SEQ ID NO: 32168 - protein, 854 aa, Synechococcus elongatus PCC 6301
MTLTRFQPTAGNESRDQRFVLWFEEVGIDDIPLVGGKNASLGEMIRELLSKGVNVPLGFATTAAAFRFFLAGAGLEPQLRQLFADLDVEDVVNLRERGRQARNLILNTPFPAELETAIATAYQQLCDRYEPTPAVCDRLSGLDRDRCQRQFGSVDVAVRSSATAEDLPDASFAGQQETYLNVRGVQAVIQACHRCFASLFTDRAISYRQIKGFDHFEVALSVGVQKMVRSDLAASGVMFSIDTETGFRNAALVTAAYGLGENVVQGAVNPDEFFVFKPTLQQGFRPTLDKRIGSKEIRMVYDEGGSKLTKNVSVAESDRQRFAISDDEVLQLAQWACIIEDHYSAKRGCFTPMDIEWAKDGLSGELFIVQARPETVQSQRASNLLRSYQLQGSGSVLVEGRAVGEMIGQGTARVILDVHHIADFQAGEVLVTNRTDPDWEPIMKKASAIVTNQGGRTCHAAIIAREMGIPAIVGCGTATTAIATGADVTVSCAEGDQGRVYAGLLPFEVHETVLDDLPRPRTQILMNVGNPEEAFGLAAIPCDGVGLARLEFIIANHIQAHPLALLHFDQLEDLFVQDQIAKLTANYDRKADFFVEKLAQGIGRIAAAFWPKPVIVRLSDFKSNEYANLLGGRQFEPREENQMIGWRGASRYYDPQYREAFALECQAFRQVREGMGLTNVIPMVPFCRTPEEGQRVLAEMAANGLKRGENGLQVYVMCELPSNVICADAFSEVFDGFSIGSNDLTQLTLGLDRDSALVAALFDERNPAVKRMVAQAIQTVKAAGRKIGICGQAPSDYPEFAEFLVEQGIDSISLNPDSVLKTLLAIAAVEARLETGRDRGSQGTLRQIQDRQRR

SEQ ID NO: 32169 - protein, 333 aa, Vibrio vulnificus CMCP6
MTIKVGINGFGRIGRLAMRAAFDWPELEFVLINDVAGDSTTLGHLLEFDSVQGRWHHEVTVQGQQLHINGHVIETTQQRDISAVDWSGCDVVIEATGVHRKSRFLNQYLEQGVQRVVVSAPVKEEGIANIVVGVNDEIFNPEQHRIVTAASCTTNCIAPVVKVIHEKLGIEQASFTTIHDLTNTQTILDAPHKDLRRARACGMSLIPTTTGSATAIVEIFPELKDRINGHAVRVPLANASLTDIIFDVKRDTTAEEVNALLKEASQGELNGILGFEERPLVSIDYRGDQRSTIVDALSTMVVGTRMVKIYAWYDNEMGYATRTAELVRKVGAA

SEQ ID NO: 32170 - protein, 136 aa, Zea mays
MARTKQTARKSTGGKAPRKQLATKAARESAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 32171 - protein, 606 aa, Glycine max
MAIPLMMDFPPQTYKQLPDTTIKVNPKLSQHVNSESKQVLEDNKVSRNEDQVLSSENETKGTEHLAFHQVPSVEQNQNLASKLPDLNLSEVSTRESDNDTKVQSQTFPLTGNTGQDVSQEFPPEAKSRPTQGDILIDIEDRFPRDFLYDMFSKAIISEDSSSIGPLPTDRAGLSLNMGNHEPKRWSYFQNLAKEGFDNVSLIDQDNLGFSSAVRKVQEGDSKSQPSAPLPAAGVLAGHTESHLNVGEESQKNVPVATKTEATIFHQKYEHSQLKGNENKNMDAVMENIQPQESEYQDGKDEPRNVVVAGEFDTSTVQFIKNEDLEELRELGSGTFGTVYHGKWRGSDVAIKRIKKSCFAGRSSEQERLTIEFWREADILSKLHHPNVVAFYGVVQDGPGATLATVAEYMVDGSLRNVLLRKDRYLDRRKRLIIAMDAAFGMEYLHSKNIVHFDLKCDNLLVNLKDPMRPICKVGDFGLSKIKRNTLVSGGVRGTLPWMAPELLNGSSNKVSEKVDVFSFGIVLWEILTGDEPYANMHYGAIIGGIVNNTLRPTIPSYCDLDWKTLMEQCWAPNPAVRPSFTEIARRLRVMSAAASQIKGQGHKASK

SEQ ID NO: 32172 - protein, 416 aa, Vibrio angustum S14
MDYFNYQQNNQLWAENVPLAQLAEQYGTPLYVYSRATLERHWKAFDEAVATHPHLICYAVKANSNLGVLNVLARLGSGFDIVSQGELERVIAAGGDPAKVVFSGVGKTATEMKRALELGIKCFNVESEPELERLNAVAEELGVTAPISLRINPDVDAKTHPYISTGLRDNKFGIVFDRAVEVYRLAHSLPHLQVVGMDCHIGSQLTDISPFIDATDRLLALVDELKAEGIHIQHLDLGGGLGVTYNDEQPPQPADYASALLARLENYPDLELIFEPGRAIAANAGVLLTKVEFLKHTEHKNFAIVDAAMNDLIRPTLYSAWQDIVPVSPRQGEAHVYDLVGPICETGDFIGKDRSLCLAQGDLLAVRSAGAYGFVMASNYNTRARAAEIMVDGEQAHVVRERETLTQLWQLEQIIQ

SEQ ID NO: 32173 - protein, 107 aa, Prochlorococcus marinus str. MIT 9303
MDPTTKTRIEALIQSSPIMVFMKGTKLMPQCGFSNNCVQILNSLGMSFETFDVLSDMEIRQGIKDYSNWPTIPQVYVKGEFIGGSDILIEMYNAGELAEKLEIALSS

SEQ ID NO: 32174 - protein, 178 aa, Prochlorococcus marinus str. MIT 9303
MRCRLPLTALALSAGLALSSGSALAQTAASSNDKVLAQAGGGFNVAAVQALLNQGDAAVSAGNLTEARNDYDNARDASKQLLAFYRDLSGAFRGLDARIPREMDAKGRKAMGLLAQANLRLAALFRQQNQPEVAVPVLVEVVRVMSPSRPEGQKAYQSLLELGFVETPYAGAKLTAPN

SEQ ID NO: 32175 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDSEFKTHPMNFLNERTLKGTFFGNFKPRTDLPNVVEMYMKKELEVEKFITHSVPFSEINKAFDLMAKG

SEQ ID NO: 32176 - protein, 410 aa, Arabidopsis thaliana
MTMISDLSKDLVEEILSKAPITSLGAVRSTHKQWNALSKGRLLYKAEAKDQFLGFMVMDHRFLSMIFHLNGILKGDGEGFDRPSIREVGDIVNQIDISKVFQCDGLVLCVPSDNSSVVVWNPYLGQTKWIEAREPHDESDMFALGYDKDKNHKILRLYDECYYYYEVYNFKTESWGEEDHLPGWDIDSYNRGVSLNGNTYFLTQEQRAKDKYRVFLLCFNFTTEKFENFIAMPFKYHRKYVGTLSCVGNEKLAALYQRWDTGEMAIWVTTKIESNEVLWSNLFKVDMKPLVRFGFQQCKDEAGSFFIDEEKKLAVVFNLDKKRGKRNNKTRCYHTAYIIGEKGYLKKEVLGEAVEVRKDVYRSALVCSSSYVPSLEKINQIEEEEEDKCKSIKMVDTKRQRKKRKRKSKR

SEQ ID NO: 32177 - protein, 159 aa, Synechococcus elongatus PCC 6301
MLSVLRQLLANDVLVAALLACGLAQFSKLIVEGVRDRRLNWHVLIETGGMPSSHSALVAALATAVGRQQGWGSLEFAVVTVFAIIVMYDAAGVRWAAGRQARILNLISEQVLTTSEEEDAIERLKEALGHTRLEVLVGAIMGVAIALLLEPALLLSEWL

SEQ ID NO: 32178 - protein, 348 aa, Myxococcus xanthus DK 1622
MPGRNPLRDLTNRRIVLASRPEGRPTGENFRIEDVSVPEPGEGELLLKVQYLSLDPYMRGRMSTAKSYARPLDLGEVIVGGTVARVVRSRHPGYAEGDIVLSYSGWQTYSLSKGEGLRKLDPAAAPVSTALGVLGMPGFTAYSGLFTIGRPQPGETVVVAAASGPVGATVGQLARIKGARAVGIAGGPEKCAYVRDELGFDAVVDHHAPDFAERLKEACPKGVDVYFENVGGAVWDAVFPLLNPFARVPVCGLIAWYNSTGPFEGPNRLPLVMRDVLSKSLTLRGFIQTEFVSQLPDFYRDMSAWVREGRVRYREDIVNGLDHAPEAFVGLLEGRNFGKLVVKVDETA

SEQ ID NO: 32179 - protein, 197 aa, Synechococcus elongatus PCC 6301
MDDLQYLWTLLSGEFSNQPQAIAEPVHFVQLRLWQRPLLLFGHDRPCLFLEQANALQLDRPYRQRLLCLEADFSGQLSAQFYQFKNAAAVLGAGQDPDRLRSLTPEDVQLLESCRLAVEQTSRGGYNAQLPAGCRCRFWTDGIERQVSLGFEVWSESDRVNFHSFDRGIDPETGRSLWGALMGPYEFTKVADYAVTG

SEQ ID NO: 32180 - protein, 248 aa, Ralstonia solanacearum
MHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 32181 - protein, 356 aa, Oryza sativa (japonica cultivar-group)
MARRRRGFPATLVTLLRLVGCLLLAFFLAAPPCAAAQQVKTSHAQFAFHLPLPDGVTGAESLAFDSSNHGPYTGVSDGRVLRWGGAAAGWTTFAHHENYRKIPMCTTPVAPAEETESMCGRPLGLAFHDRTGDLYIADAYKGLMRVGPRGGEAEVLAAGADGVPFNFVNGIDVDQATGDVYFTDSSTTYPRRFNSEIMMNADATARLLKYDAATKRVTVLRAGLPYANGVAVSRDGSHAVVAHTVPCQAFRYWIKGPNAGEYELLADLPGYPDNVRRDANGGYWVALNQEKARLDATAAAAVAPPAKHLVGVRLDGDGVEVEELTAAKGVTLSEVVERGGKLWLGSVELDFIGLMQ

SEQ ID NO: 32182 - protein, 195 aa, Oryza sativa (indica cultivar-group)
MAAAAAKRKPVFVKVDQLKPGTGGHTLVAKVLSSKTVVQKGRAAAGAGAGPAARPTRIAECLIGDETGCILFTARNEQVGKIEAICVTQMVQVSLSIFICVRLFDLMKADSTVIIRNAKIDMFKGSMRLAVDKWGRIEVTEPASFNVKEDNNLSLVEYELVNVEGSYVFQAYLVKFYLLSWLKKVKDEGDSEVRL

SEQ ID NO: 32183 - protein, 133 aa, Triticum aestivum
RESAIQSGKFLTRQLALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 32184 - protein, 309 aa, Pisum sativum
WGIDKFRNVVEEYYGKKFEPFRSLPEWEFKSYLGWHQQGDGGLFCGLHVDNGRIAGKMKTALREVIEKYHLNVRLTPNQNLILTDIRAAWKRPITTILSQAGLLLPRYVDPLNITAMACPAFPLCPLAITEAERGIPSILKRIRDMFEKVGLKYNESVVVRITGCPNGCARPYMAELGLVGDGPNSYQIWLGGSSNQTSIARSFMDKVKLQDLEKVLEPLFYHWKQKRQSKESFGDFTVRLGFEKLKEFIEKWEGPAVPPTRHNLKLFTDKDTYEAMDGLAKLQNKNAHQLAMEVVRNYIASNLNGKGE

SEQ ID NO: 32185 - protein, 272 aa, Triticum aestivum
MAAAATAVRFHTAAARRAAPRRPARFAVRADAAQAATALTQDDLKRLAAVRAVEQVQSGMVLGLGTGSTAAFAVAEIGALLANGKLSGIVGVPTSKRTFEQAMSLGIPLSTLDDHPVIDLAIDGADEVDPDLNLVKGRGGALLREKMVEAASGKFVVVVDETKLVTGLGGSGLAMPVEVVQFCWKYNQVRLQGLFNEEGCEAKLRLNEDGKPYVTDNSNYIVDLYFKTPIKDALGAGKEIATLEGVVEHGLFLNMASSVIIAGSDGVSVKTK

SEQ ID NO: 32186 - protein, 441 aa, Chlamydia trachomatis D/UW-3/CX
MAGRRTKEEQINRKRSHFYRDNVGVIVLCGGEGKRLSPLTCWRCKPTVSFGGRYKLIDVPISHAFASGFSKIFVIGQYLTYTLQQHLFKTYFYHGVMQDQIHLLVPERRDGSQVWYQGTADAIRQNLLYLQDSRVEYFLILSGDQLYNMDFRSIVDYAIDAQADMVIASQPVSDKDVSRFGVLKVDDESKLIDFYEKPQSEEILKHFRLSNTAMKKFGLDPQHGNFLGSMGIYLFRKDCLFQLLLEETGDDFGKELIHRQMHRGKTVAYLYDGYWTDIGTIESYYEANMALTQRPSHNIRGFNCYDDGGIIYSKNNHLPGAIISDSRISSSLLCEGAMIESGQVSNSVVGVRGVIGQGSVFDRSIMMGSDSYGSESFPLGIGKNCEIHKTIIDENCCIGNGVRLQNLQGHKDYDSPDGKLVVRDGIIIVPRGTQIPDNYVF

SEQ ID NO: 32187 - protein, 558 aa, Silicibacter sp. TM1040
MSYKSDIEIARAANKLPIQEIGAKLGMKNDDLLPYGHDKAKVSQEFINSVQGNEDGKLVLVTAINPTPAGEGKTTTTVGLGDGLNRIGKNAMICIREASLGPNFGMKGGAAGGGMAQVVPMEEMNLHFTGDFHAITSAHSLLSAMIDNHIYWGNEQEIDIRRVAWRRVVDMNDRALRQITASLGGVSNGFPRETGFDITVASEVMAILCLANDLKDLEKRLGDIIVAYRRDKTPVYCRDIKAEGAMTVLLKDAMQPNLVQTLENNPAFVHGGPFANIAHGCNSVIATKTALKVADYVVTEAGFGADLGAEKFMNIKCRKAGIAPSAVVVVATVRAMKMNGGVAKADLGAENVEAVKNGCANLGRHIENVKSFGVPAVVAINHFVTDTDAEINAVKEYVASHGVEAILSRHWELGSEGSAPLAEKVVELVEGGGANFGPLYPDEMPLFEKIETIAKRIYRADEVLADAKIRNQLKEWEEAGYGHLPVCMAKTQYSFSTDPNLRGAPTGHSVPVREVRLSAGAGFIVVVCGEIMTMPGLPRTPAAESICLNEEGLIEGLF

SEQ ID NO: 32188 - protein, 169 aa, Aspergillus nidulans FGSC A4
MASFQDRAQHTIAQLDKELSKYPVLNNLERQTSVPKVYVILGLGGIYTFLVFFNIAGQLLVNLAGFILPTYYSLDALFSAGKADDTQWLTYWVVYAFFTVVESAISAPYWFPFYYIFKFALVLWLALPQTNGAQIVFKSLVQPLVGRYFTGGSTSANLRAQADAATKSQ

SEQ ID NO: 32189 - protein, 663 aa, Oryza sativa (japonica cultivar-group)
LCLAAMAHLPLLLLSFLVLIGVHASVSHGSPPLPSTYDPSICSKSSECGGVNISYPFYLSNATDYYTRFSCGYTDLKISCSRDRDGRNETPTILLGGDNYTVLDIIYDSHTIVLADTDALRGGSCPRVRHNITFAQADEWLQYTGPRDNLTFFFGCKLNLPPPIDPGLVSLADKHQINCKDFSNWPDSGDSFVFTSAELEAPVESELARRCRQVIVVPVNGDILNSSNQSALPSGGYGQVLNKGFDLAWNSRKDEQCYQCEQSQGHCSYSQNRVFLDCLCSDGKVGNQDCRNSGASNSSTLRYSSLKGRMKLYIIAGISSVLLLCLLSFPCLFSLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSW

SEQ ID NO: 32190 - protein, 81 aa, Arabidopsis thaliana
  misc_feature (10)..(10): Xaa can be any naturally occurring amino acid
  misc_feature (36)..(36): Xaa can be any naturally occurring amino acid
AKGAPFCSLXGPKFCFMKITEALPKFSKENGFGRVXKPLRQGMGALSEEFPLAKKTLTGDPPGEVGGKIFLPKSFVKAAQK

SEQ ID NO: 32191 - protein, 224 aa, Vibrio angustum S14
MNQPLNYRNTSFITSAPDIRHLPQDAGVEIAFAGRSNAGKSSALNRLTDQKGLARTSKTPGRTQLINMFEVVQGCNLIDLPGYGFAQVPLEMKLKWQKSLGEYLQRRECLQGLVVLMDIRHPMKDLDQQMINWALESRLPVLVLLTKADKLKSGARKAQVLKIRQMTKDLEGEVQVEAFSSLKGIGVDQVRRKLDEWYAPELERQRVLAGGDDAFPEQVEEDNE

SEQ ID NO: 32192 - protein, 498 aa, Solanum demissum
MATELEELIGFLSSPSHPVKKIAVDIVRDYTGSEDGLESLGKYSDVVLPSLSHLLGEKKVVSEPAAQALVNLSQKPELAGKMVEMHMVRTSMETLYKQDCEITNLLIMLLVNLTQLDAGIDSLLQSADEKMHGLYVMKLVRSFCSSSCEGKVDPFEHVASVLVNISKKEDGRKLLLDQKRCLLKQIFRNDSKSLLRKRGVAGTIRNCCFEAENQLQNLLLISEFLWPALLLPVAGNKNLLETRKAIFSIISRKAPIFVQGLSTKISFNKYTESYYVYSCYQCVSLLNVYSEEDTRKMPLELASALSIEREPVTDPEIRVQALEAIYLLILQEAGRRAFWSVNGPRILQVGYADEDDPKAMEAYERAGSLLIQESGLDEELTETSSGVGYDPLKGCYVKDSGDVSEISLSCLNDLAVLLIVSCHPTKGSSIQTCSQAKGLSETISLPPQGRGKSVLFVCTDNNKSSVILQVSFGEVEMYVVSLLWCRGEIATLLLYPDL

SEQ ID NO: 32193 - protein, 794 aa, Pyrococcus furiosus
MAYRFIKWFEELSKNDVPLVGGKGANLGEMTNAGILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTPRATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVLETKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCQRYGVETSICGQAGSDPKMARILVRLGIDSISANPDAVQLIRQVVAQEERKLMLEAARKQLFEKRKKRSSSEVFPPFL

SEQ ID NO: 32194 - protein, 428 aa, Oryza sativa (japonica cultivar-group)
MIEGSRFQNMLGGAGIGGGIGCRGRQENEMNGFHNMPYYHKVGESSHMSVDNADNLNMMNFVGGSVAMSVDNSSVGSNESRTVMLKHPGLRDMPAPSYSVHNSVIHPNRAMAPTLNEDALARVLMDPSHPTEILSNYEEWTIDLGKLDMGAPFAQGAFGKLYRGTYNGEDVAIKLLEKPENDPERAQLMEQQFVQEVMMLSTLRHPNIVRFIGACRKSIVWCIITEYAKGGSVRQFLARRQNKSVPLGLAVKQALDVARGMAYVHALRFIHRDLKSDNLLISADKSIKIADFGVARIEVQTEGMTPETGTYRWMAPEMIQHRPYDHKVDVYSFGIVLWELITGMLPFTNMTAVQAAFAVVNRGSRPAIPQDCVDSLSKIMTCCWDANPEVRPSFAEIVVMLENAEIEVMRNVRRARFRCCIAGPMTTD

SEQ ID NO: 32195 - protein, 333 aa, Vibrio parahaemolyticus RIMD 2210633
MTIKVGINGFGRIGRLALRAAFDWPELEFVQINDVAGDAATLSHLLEFDSVQGRWHHEVQVEGNELVINGKRIATTQHRDIDAVNWSGCDVVIEATGVHRKTSYLDQYLDQGVKRVVVSAPVKEEGIANIVVGVNDHIFDPDKHRIVTAASCTTNCIAPVVKVIHEKLGIEQSSFTTIHDLTNTQTILDAPHKDLRRARACGMSLIPTTTGSATAIVEIFPDLKGKINGHAVRVPLANASLTDIIFDVKRDTTAEEVNALLKEASDGELKGILGFEERPLVSIDYKGDQRSTIVDALSTMVVGSRMVKIYAWYDNEMGYATRTAELVRNVGLA

SEQ ID NO: 32196 - protein, 393 aa, Methylococcus capsulatus str. Bath
MSIRLSDRVQSIKPSPTLAVTARAAAMRAAGKDIVGLGAGEPDFDTPDHIKQAAIQAIEKGFTKYTAVDGTPGLKQAIQAKFKRENGLDYALDQILVSCGGKQSFYNLAQALLNPGDEVVIPAPYWVSYPDMVLLAGAVPVIVEAGQQQAFKITPAQLEAALTARTRLFVINSPSNPTGMAYTAEELAGLGEVLRRFPEVVIATDDMYEHILWEGGFSNVLNVCPDLYERTVVLNGVSKAYSMTGWRIGYAAGPERLIEAMTNIQSQSTSNPTSISQVAAEAALNGEQGFIAGMVEAFKQRHDFVVGRLNAIPGVDCLKTHGTFYVLPNVEAAMARLHLADDVALSEYLIEQGGVAVVPGSAFGAPGHVRLSIATSMANLEKAMERLATTLSK

SEQ ID NO: 32197 - protein, 336 aa, Vibrio parahaemolyticus RIMD 2210633
MATNHSPLTYTQETLFEQAIGGPIAALWQTRQEGFVKGTEKKKIYWCKLTNPEHKKAVLIVNGRIESSWKYQELFYDLYRQGYDVYSFDHRGQGLSDRLLSDSDMGHVYDFTDYIDDMDVVIKQHDLKQYQQCFIIAHSMGGAIATRYLQTHPEHPFTGLILSAPMFGINLPWYLSPIAIPVTQILSAVSPLPRYAPGHKPYFPKPFEDNPLSQSAGRYQWFRNLYTEKPELQVGGPSTRWVWQGLMAAKQCFLLTRQVKVPVLLVQAGNDRIVSNLAQKRFIEKLRKTNPHAALLSIEGAQHEILFETDQYRNQALDAIFRFMDDPTSSSDEKMQ

SEQ ID NO: 32198 - protein, 420 aa, Yersinia pestis CO92
MPRALNDRSSALTAQNLIALPERFGCPVWAYDGDIIAERINQLRHFDVIRFAQKACSNIHILRLMREQGVKVDSVSLGEIERALHAGYQPGQEPAEIVFTADLLDQATLLRVTELNIPVNAGSIDMLDQLGQQAPGHPVWLRVNPGFGHGHSQKTNTGGENSKHGIWHEELPRALKKIEHYGLTLVGIHMHIGSGVDYQHLEQVCDAMVQQVITLGHDISAISAGGGLSIPYQFGDDVIDTEHYYGLWNSARERIAAHLGHPVSLEIEPGRFLVAESGVLIAQVRAVKDMGRRHYVLVDAGFNDLMRPAMYGSYHHISLLPADGRDLTSAPLIDTVVAGPLCESGDVFTQQEGGGVETLALPAAVIGDYLVFHDTGAYGASMSSNYNSRPLLPEVLFEKGQPRLIRRRQTIEELIDLERV

SEQ ID NO: 32199 - protein, 300 aa, Oryza sativa (japonica cultivar-group)
MGSKSSKDTDDDHEPKQQEKKLPEHLEVQRTRVVCKADAPVNTEGFQYAGAYSAMGIDNSVSAEKFCKNFKVEISRLTEDDMEFDMIGIDASIANAFRRILIAELPTMAIEKVLMVDNTSVIADEVLSHRLGLIPLDADPRHFEYMSENDVPNERNTIVYKLHVSCKKGSPRLTVKSGDLEWLPEGSRLPLASPAQSRYKQKTYTSFSQSQKDILEKPLGVKFKDITIARLGPGQVVFRKEIKGDNAEKLVKKCPVNVFDIEDLGNVTIESTGGLPPEALFTEAVRILEEKCERVISGLS

SEQ ID NO: 32200 - protein, 120 aa, Glycine max
VYQPSHEERGESNTDGHNIKAWTEIYLLSLCDALVTSPKSTFGYVAHSLGGLKPWILQRAYGETIPDPPCRRAKSMEPCFHYPPKYDCRANSTVDFTSIFHHMKHCEDVSSGLRLVNVKH

SEQ ID NO: 32201 - protein, 141 aa, Chlamydia trachomatis D/UW-3/CX
MEQTLSIIKPDSVGKAHIGEIIAIFEKSGLRIAAMKMVHLSVKEAEGFYVVHKERPFFQELVDFMISGPVVVMVLQGENAVDRNRELMGATNPKEAAEGSIRALFGESIGVNAVHGSDSLENAAIEVSYFFAKTEIVNSVA

SEQ ID NO: 32202 - protein, 414 aa, Petunia x hybrida
MASTSKDTTTASTSTMDTRPENSEVDELPKELHEMKIKDERTDSHEDNLKDMEPAVVSGNGAETGQIIVTTVSGRNGQQKQTLSYMAERVVGTGSFGVVFQAKCLETGESVAIKKVLQDRRYKNRELQIMRTLDHPNVVKLRHCFYSTTEKNEVYLNLVLEYVSETVYRVSRHYSRMNQHMPIIYVQLYTYQICRALNYMHSVLHVCHRDIKPQNLLVNPHTHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPEIKAHPWHKIFQKKMPPEAVDLVSRLLQYSPTLRCTALEACAHPFFDALREPNACLPNGRPLPHLFNFTAQELSGAPADLRKRLMPEHMRK

SEQ ID NO: 32203 - protein, 828 aa, Vibrio angustum S14
MKMTRRAFVKANAAASAAAVAGITLPASATNLIVSSDETKIKWDKAPCRFCGTGCSVLVGTQNGRVVATQGDPKAPVNKGLNCIKGYFLSKIMYGKDRLQTPMLRMKNGQYDKEGEFTSVSWDTAFDVMAEKWKLALKKQGPSGVGMFGSGQWTVMEGYAASKMMKAGFRSNNIDPNARHCMASAVVGFMRTFGIDEPMGCYDDLEHADVFVLWGSNMAEMHPILWTRITDRRLSHPHVKVNVLSTYQHRSFELADNGMIFEPQTDLAIANFIANYIIQNDAVNWDFVNKHTHFKRAQTDIGYGLRDDNPLQQQAANPNSGDIFPMNFEEYKASVADYTVEKASEMSGVAPEKLIQLAKYYADPKLKVMSLWTMGMNQHTRGVWMQSLVYNLHLLTGKIATPGNSPFSLTGQPSACGTAREVGTFAHRLPADMVVANPKHREIAEKIWKLPEGTIPPKPGYHAVLQDRMLKDGKLNAYWVMCNNNMQAGPNINEERLPGYRNPENFIVCSDPYPTVTAQASDLILPTAMWVEKEGAYGNAERRTQAWYQQVEAPGEAKSDLWQIMEFSKRFKVEEVWGEELINKMPQYRGKTMYDILFRNGQVDKFPLSEAQALNDDAKAQGFYVQKGLFEEYASFGRGHGHDLAPYDTYHQVRGLRWPVVDGKETLWRFKEGSDPYAKKGTDWDFYGKPDGKAWIISAPYEAPPEVPDSEYDMWLCTGRVLEHWHTGTMTRRVPELYKAVPDALCYLHPDDAKKRGLRRGDEVNVASRRGEVRCRIETRGRNRPPEGLIFIPFFDARILVNKLILDATDPLSKQTDFKKCPVKISKV

SEQ ID NO: 32204 - protein, 317 aa, Arabidopsis thaliana
MGNPVDNKFTWVIKNFCSVSPKPIYSDQFLIGGNKWHILAYSKKRDGHQFLCLDLELVDCEFLPSEWRKVVKVSFTVVNFFSKKLSRQIGLKHCFNKKERSKGGSLFHLSELTDKKSGFLVDGEVEIVAQITVLETDRRFHVSKDYNMEMQCWDGMATTLVENKELNDDDKAGLVNVKGFQVLPSQLGIVNRIFEKHPETALECCTKNQELRASYINVIFSLIKLLYKGAQEHSTHDLSDAEGALAYMKNLGFKLDWLEKKLDEVKEIKKKCERVTEMEKELHDLMNKHTNVSKLLEKEKLEIKNASAPDLSFSDVI

SEQ ID NO: 32205 - protein, 321 aa, Arabidopsis thaliana
MGKQINNTFTWVIKNLSTLQGLEVRSKIFVVGGCKWRLIAYPEVNDADGYLSLSVYLGVPDCCESLPSGWKRHAKFSLTIVNQLSEGLSQVQETQAWFDENAPGWGFPPMLNLKDVSDKYGGFLVNDEVMVAVAVDVIEVVGSLDAPEMSESMDIKGFKVLPSQVKSVNRLFESHPDIASKFSIKNQSLKTAYMNVLLCLAETLHQSPMEISEDDLSDAKTTLAYMKSVGFKLDWLEKKLDELFEKKKEEADKIRMQNIEEELKDLRQKCSSLEALLKKEKTGVLAAKAPFLFFNNVNDDDLKWILRAVMYTLIMMLFISI

SEQ ID NO: 32206 - protein, 406 aa, Coprinopsis cinerea okayama7#130
MNFYFEAAQVLDRLDAKQGSIKGLIASLAEKNRKRSTALIIETLKCEVLHPHTGKVLVLNLVWVDKPVLSDVIAASKLTKEERKLSSHNLTLVLVYDLLLGKGIQAGDGPIKQAVLRHKTRLHGEFQKLKIKRGVTSNAQLVQRADERAESIPRYVRINTSLWTTDKAVLYYVSRGFTLNDTLNSSDHKAFVKDPHIPDLLAFAPLTSFVEDPAYLDGRAIIQDKASCFPAFVLNPPATEDSVVIDATAAPGNKTSHLSALMGNKGKLYAFERDKRRFLTLQKMLNTAQCRNAIPINADFLTIDPEDNKFRPVTHILLDPSCSGSGIVNRLDHLIPTAIEEEDIPNERLAKLATFQLKMIQHAMKFPNVERIVYSTCSIHATENEHVVRAALDSDEAKAGAGPLHS

SEQ ID NO: 32207 - protein, 495 aa, Coprinopsis cinerea okayama7#130
MWKPATRQITGTNDVPLGTRRRFGPPPTEDNSAPQLAQPSPSVYPRHQSQDRESPGKRGRDESPANGDPKVDPNAPRKRRSRWGEAKTEIPGLPTAISAAGVSQAQLDNYAIHLRLEEINRKLRLNDFIPPERERSPSPPPTYDAHGRRTNTREVRYRKKLEDERIRLVEKAMKNDPNFRPPVEYQQQKRSQRPSEKVYIPVKEFPEINFFGLLVGPRGNSLKKMERESGAKISIRGKGSVKEGKARPDQFAEDAEEDLHCLVIADSEDKVAACVKMINKVIETAASTPEGQNDHKRNQLRELAALNGTLRDDENQICQNCGGVGHRKYDCPEQRNFTANIICRVCGSAGHMARDCTVNRDPNAPPPPPGAPPGHGTRGGFDSEYASLMAELGETPASSDPLKSWSAPTGGHDITAGGTNIPPWRRPEVWQQPAQQSYRGPQQSYGGYPGAGGYGNPGAQWSGYSQPAPGGYGQGQEYSNYAAYYQNQYAQQQMS

SEQ ID NO: 32208 - protein, 315 aa, Cryptococcus neoformans var. neoformans JEC21
MAAPAQPSSPPPVCQFSDRLTTALNAAQDATGTDSPHAHHHHTPSALSGASSVISHNHDNMSHDHGHFHDHGPGLWTPEEHGHTHEHLEHAGKFAERDMPDYTGRNWTERAFTVGIGGPVGSGKTALLLALCRGFREKYNIAAVTNDIFTREDQEFLIRNEALPAERIRAIETGGCPHAAIREDISANMGALEKLQAEFDTEMLFVESGGDNLAANYSRELADYIIYVIDVSGGDKIPRKGGPGITQSDLLIVNKIDLAPYVGASLDVMRRDAAAMRGSGPTLFTSVRNNDGVDAVMDIIVSAWRASQGSGKARA

SEQ ID NO: 32209 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 32210 - protein, 250 aa, Agrobacterium rhizogenes
MINTPRRLIVGNWKMNGLTADLAEIEKLAWNIGDLSADVAICPPATLLQSAVRITAGSRLLLGAQDCSAQEAGAYTGDISARMIADCRARVVILGHSERRQYQGETDAIVRRKAEIALSAGLTPVICVGETEAEHLRQETLAVLKNQLQGCLPAEMNEIALVIAYEPVWSIGTGRLPDQGEILAAHACIRSSLIDAYGPVGAQMRILYGGSVKPENSIEILALENVDGVLVGGASLRAESFLQICEATRT

SEQ ID NO: 32211 - protein, 228 aa, Bordetella bronchiseptica RB50
MDIERVEQVRAVERLAHRRGLALMPRAGLAAADFVAARLPAGAQVLALAGPGNNGGDALVAATLLQARGYRVAVVMPAGPARLPDDARRAWQDWCAAGGQASADLPAHAPALVIDGLFGIGLARPLGGAWQGLIDQVNAWRVPVLALDVPSGLSAASGQPLGDPPGRPVRATWTLSFIGVPAALRAPGAAAWCGQQHLSLLGLTPAFLAEAVGPCGQATATAARRSGP

SEQ ID NO: 32212 - protein, 245 aa, Arabidopsis thaliana
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDESEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 32213 - protein, 436 aa, Geobacter sulfurreducens PCA
MNYVIIGNSVAAVGAIRGIRSIDQQGNITVISRERHNAYGRPLISYLLGGLVSEKRMAYLPEDFYEKNRVNLLLNSEVTGIDTAARQVRIAGGDTIGYDRLLVATGGDPFIPPIEGMADKDRIFTFTTWDDAAKLKGIASDIGRVVVIGGGLIGLKAAEGLHLIGKQITIVELADRILSAAFDRPAGRVVAKKMKANGIDVITEDTVVRIEGEGAEITGVTLRSGDFIPCDTIIVAIGVRPACGFLKGSGVEVNRGIVVDDRMETSVEGIYAAGDVAEAKDFFSGVKNPMPIWPDAYIQGDIAGVSMAGGTKAYEGGLAMNSIELFKVSTISMGITNPAEPKEYEILTYQDLENYQYRKIVIKDGLLAGAVLVGAVDRAGIFSGLIREKIAVVPFKDQLLAPDFGFANLPKDIRTALFAPAGKVTETGRPAVAVGH

SEQ ID NO: 32214 - protein, 401 aa, Oryza sativa (japonica cultivar-group)
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 32215 - protein, 497 aa, symbiont bacterium of Paederus fuscipes
MTTPTRADWEIRAKDLNIEGRAFVNGEYRNAASGETFDCLSPVDGRFLAKVASCDQADAEQAVKAARAAFDSGVWSRLAPAKRKRTMIRFADLLLKNAEELALLETLDMGKPISDSLHIDVSSAANSIYWNAEAIDKIYDEVAATPHEELGLVTREPVGVVTAIVPWNFPLLMACWKLGPALATGNSVILKPSEKSPLTAIRIACLATDAGIPTGVFNVLPGYGHTVGKALALHMDVDTLVFTGSTRIAKQLMIYAGESNMKRIWLEAGGKSPNIVFADAPDLKAAAEAAASAIAFNQGEVCTAGSRLLVERSIKDRFLPLVVEALKGWKPSNPLDPDTNVGALVDTQQLHTVLSYIEAGHKDGARLMVGGKRILEETGGVYVEPTLFDGVDNAMKIAREEIFGPVLSVITFENAEEAVRIANNTQYGLAAAVWTSDLSKAHLTAKALRAGSVWINQYDGGDMTAPFGGFKQSGNGRDKSLHAFDKYTELKATWIKL

SEQ ID NO: 32216 - protein, 293 aa, Yersinia ruckeri
MFTGSIVALVTPMDDKGAVDRVSLKKLIDYHVASGTAAIVSVGTTGESATLNHDEHADVVMMTLELADGRIPVIAGTGANATAEAISLTKRFDNTGVVGCLTVTPYYNRPMQEGLFQHFKAIAESTELPQILYNVPARTGCDMLPETVARLAKIKNIVAIKEATGNLSRVSQIQVLVDDEDFILLGGDDASGLDFMQLGGKGVISVTANVAAREMAQLCALAAEGKFAEARRLNQRLMPLHQHLFVEANPIPVKWACKALGLMANDAMRLPMTPLTDPAKLVVEKALKSAGLL

SEQ ID NO: 32217 - protein, 417 aa, Vibrio parahaemolyticus RIMD 2210633
MDYFNYQDDGQLWAEDVPLQALAEQYGTPLYVYSRATLERHWKAFDSAVGQHPHLVCYAVKANSNLGVLNALARLGSGFDIVSGGELERVIAAGGDAKKVVFSGVGKTPAEMKRALELGIKCFNVESEPELERLNKVAGELGVIAPISLRINPDVDAKTHPYISTGLRDNKFGIAFDRAPEVYQFAQSLPNLNVQGIDCHIGSQLTSIDPFIDATDRLLALIDDLKAQGINIRHLDVGGGLGVVYRDELPPQPSDYAKALLGRLENHQDLELIFEPGRAIAANAGILLTRVEFLKHTEHKNFAIIDAAMNDLMRPALYQAWQDIVPVSPRNGEPQTYDLVGPICETGDFLGKDRALVLQEGDLLAVRSAGAYGFVMSSNYNTRTRAAEVMVDGNQSHLVRQREELTSLWQLEQILPE

SEQ ID NO: 32218 - protein, 334 aa, Chlamydia trachomatis D/UW-3/CX
MRIVINGFGRIGRLVLRQILKRNSPIEVVAINDLVAGDLLTYLFKYDSTHGSFAPQATFSDGCLVMGERKVHFLAEKDVQKLPWKDLDVDVVVESTGLFVNRDDVAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSVFDAQAGVALNDRFFKLVAWYDNEIGYATRIVDLLEYVQENSK

SEQ ID NO: 32219 - protein, 664 aa, Listeria monocytogenes EGD-e
MPEEKNTFYITTPIYYPSGKAHIGHAYTTVAGDAMARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNFDLANDLGNLLNRTVAMINKYFDGEIPAYQGNVTEFDQILVDFKNNVVKEYEGSMDHMQFSVALNQLWSLISRTNKYIDETAPWALAKDEDKRTELASVMTHLAENLRIIAVLLQPFLTRTPGEIFLQLGLQEENLKKWDSIYGYGEIPAGTTVVKKGTPIFPRLDAEVEVTYIQDEMKGSAPAPAEEVAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEASSALPNGAKVK

SEQ ID NO: 32220 - protein, 574 aa, Vibrio angustum S14
MISGILASPGIAFAKALLLQEEEVVLNKAPISADQIDNEIQRFFDARKKSSEQLEVIKEKARVTFGEEKEAIFEGHIMLLEDEELEEEIIALIKDKMSADFAIYSVIEEQAQTLESLDDEYLKERASDIRDIGSRFVKNALGINVINLSAISEEVILVANDLTPSETAQINLDYVRGFITDIGGRTSHTSIMARSLEIPAIVGTNDITSKVKSGDMLVLDAINNQVVINPTDDELNKFKAISDAHKAEQEELAKLKDLPAITLDGKQVEVCGNVGTVKDCDGVNRNGGEGVGLYRTEFLFMDRDSLPTEEEQYQAYKEVAEAMHGEPVIIRTMDIGGDKDLPYLDLPKEMNPFLGWRAIRISLDRREILRDQFRAILRASAHGKIRIMFPMIISVEEVRTLKAAIEEFKVELTAEGLAFDADIEIGVMVETPAAAAIAHHLAKEVSFFSIGTNDLTQYTLAVDRGNELISHLYNPLSPAVLTVIKQVIDASHVEGKWTGMCGELAGDERATLLLLGMGLDEFSMSAISIPRIKKVIRNANFADVKAMAEYALTLPTAAEIEEHVEKFIAEKTIC

SEQ ID NO: 32221 - protein, 338 aa, Triticum aestivum
MLRHLLSSPATSPVSPLHRLLSAVSTPTTGFAVEDYLVGTCGLTRAQALKASAKLSHLKSPANPDAVLAFLAGLGLSAAGVAAAVARDPKFLCAGVERTLEPVVAGLSGLGVSRSEVARLVSVSASLFRHRSIVSNVALLQESGVDVCDIAKLCLAVPRLLRSSPERVQAAVASAEALGVPRGSGMFRYALQSVAFFSEEMIAARVAYLKKTFRWSDADVSIAVCRDPPLLTKSKELLRCRSKFLFSEVGLAPAYIARRPAMICYSLEGRLRPRYYVVKFLKGNGLLKRDPSYYTVFKVSEDVFMAKFIRPHKEIAPQLAEDYATACGGEVPSNFRFT

SEQ ID NO: 32222 - protein, 399 aa, Geobacter sulfurreducens PCA
MKLADRVNKIQPSPTLSIDAKAKALKAQGIDVVGFGAGEPDFDTPANIKEAGKKAIDAGFTKYMPVGGADDLKDAIIAKMKRDHGLEYTRDEISVACGAKHTLYNISQALIQEGDEVIIPGPYWVSYPDQIVLAGGTPVFIMTDESTGFKITAEQLEKAITPRTVYVILNSPCNPTGSTYTKDELKALAAVLLKHPHVYVVSDDIYEKLLYDGLEFCNIPMACPELKDRTIIVNGVSKAYSMTGWRIGYACGPKALMAAMTKMQSQSTSNATSIAQKASVEALNGPQEPVAEMVKEFEKRRTYIVDRLNAIPGVTCFKSTGAFYAFPNFSGVYGKTTPAGKKIENSSDFAAYLLEDAKVALVPGIAFGDDRYARLSYATSLETIKKGLDRIEEAIGNLK

SEQ ID NO: 32223 - protein, 306 aa, Glycine max
  misc_feature (70)..(70): Xaa can be any naturally occurring amino acid
SCFVWQSHIFLLNCDVCCSFPLPEMLDAHKRYGGMGTILVVKVSAESASEFGELVADPTTNELLHYTEKXPETFVSDRINCGVYVFTPDIFTAIEGVSTQRKDRANLRRVSSFEAMQPDTRSLPVNYVRLDQDILSPLAGKKQLYIYETNDFWEQIKTPGMSIKCSGLYLAQFRYTSPHLLANGDGIKKASITGDVYIHPSAKVHPSAKIGPSVSISANARIGAGTRLKHCIILDDVEIKENALVGHAIVGWKSSIGRWACVEASGDYNAKLGVTILGTFLNLVYILSLIIYFYFVFLWRSMKRQS

SEQ ID NO: 32224 - protein, 236 aa, Arabidopsis thaliana
MGSHEQSPENNGSSTVSKKVADIWQRMNEGVPNKRVNFVSTALPAKNSANSNWKSYLGVNVKKKDTSVSDVQKSVLNHSCSEEAKSIAAAALAAVRNATVTAAAASSRGKIEITEVKDFAGQEIEVKRLVEADSKEALERGNKGSSSSSAAPSAVDAVLEHIKKKQKLSVLDKTKKDWGEYKEEHKGVEDELDKYKKSSDQYLDKVGFLERADYRQFEKERDARLALQSKRRHDDV

SEQ ID NO: 32225 - protein, 433 aa, symbiont bacterium of Paederus fuscipes
MNQKFRLCIIGGGPLGIGLGRELSEGAIDYDLYEAESDLGGVWNREGKCGRVYPSLHLISPKFNTQVPDYPMPDHYPVYPNHKMMLAYMRSYARDFGVYEHAIFNTSVTRLEPDGEGWEVELSSGERKRYEVVAVCNGAQRVARFPDPPHPGTFQGKVLHSMDYKSPDLVRDKRVLVVGAGNSGCDIAVDASHHAEQVYHSTRRGYHYFPKFIDGKPTPQWMLQLGNKFETKEQTLAYMQQVFKVAGFDGMDYGLKKPDHPLDGAHPIMNSQILYHIGHGDILPKDNIEYFEGNTVFFIDGTKADVDLIIYATGYDRDFPFIDHALLEWKDGLPDLFIHIVPRNLDNIFFFGFVNAAAGLGDGLRLQGQFVRSYVRALQQKSKGYFKFIQTKQNDNPDLGQDYFLDSHRHRWEVDFWKFIKCARRYREMLDEI

SEQ ID NO: 32226 - protein, 865 aa, Anaerobranca gottschalkii [sequence omitted]

SEQ ID NO: 32227 - protein, 711 aa, Oryza sativa
MDEKVKMESKLSSAAAFVEGGVQDACDDACSICLEAFCDNDPSTVTSCKHEYHLQCILECQELLEAVEQERNIRANRLNTAAVFHHPVLGDFEVPVGADDAELEERIIQHLAAAAAMRRNEAIPGGSLHASSGQDEDHEQSSDLGSAHPFAALAAVDQGHMSGGSQLYVGHSDQGASNPSLHDERAMSRKPNNASSSSCGKLGAPKGSLADEGAVAAAQAIRAGEKWPQAAAMGAPVCGALVCFFVLLVARAAAETAPVERPTLPSADVAIDGNGNGARAGAGKAAGAGAVGGGIVSNSVLVALLDSRYTEMAELVEKALLLQALEDAVAEHNVTILAPRNEALERDIDPEFKRFLLEPRNLNSLQSLLLFHVLPARLPSGSWPAAATHPTLAGEDVELAAADGGGGMRVAHAAVSRPDAVVRTDGVIHGIDRLLVPRSVQDEFNRRRSLADISAMPPTAAPEVDPRTDRLKKPAPPGDSPVLPISDATVPDPSVALASEPSDHYDGDSQVKDFIQTLLKYGGYNELADIFVNLTSLATELAQLVSEGYALTVLAPNDEAMARLTADQLSEPGSPENILYYHMIPEYQTEESMYNAVRRFGKVRYDTLRLPHKVVAREADGSVKFGHGEGSAYLFDPDIFADGRISVQGIDAVLFPPAETKTKTKPATARIRTAPAITGVSKIKHRRGKLLEAACQMVGILGQRSQFTRCQ

SEQ ID NO: 32228 - protein, 760 aa, Gibberella zeae PH-1
MEPQQKPGTPFLVYGTDRTGSGYHSTYLTTDDSALNITTTSCLNSITPSSARYTARQNKCLLALYSYHITALPRHMPYPHPPPPTSSNVSTANSNHSSAAPLTQSSTPSSTHQQNRNRARTGIANIGPSVANPARLPGQTPAQTLGRRQRSPASDGPSDPQPDSSQAPDNDLTEPPTKRRRENNTMGGSDILDPHNGAPLGFSNGSTEPSVGVTNGHKSAMNGSTNRDNNSTITKSHGMPSEYFGHNREEVTRLLIQALSDMGYQTAADNVSRESGYELESPTVAGFRSAVLSGSWSKAEELLTGASFETEGQGNGLVLAPSADRNAIRFWLRQQKFLELLEQKDTSRALVVLRSELTPLSHDTGKLHFLSSLLMCRSVDDLMAKADWDGANGQSRKLLLSELSIMLPENRLAVLLEQVKQSQIDTCLYHTQALSPSLYSDHFCDRRWFPTEVALDLVDMNDEIWQVQFSHDGSKLAACGSGRQVIIWDTHTYSVAEILDDHDEGVGNMSFSPDDTMILCCARDGYARLWSTSVSNPWVVTAGYNANREIQDGRLIRQFNRFAEPVSGCVWAHDNRSLILGTLDPTFSLRTINLQTNEEYDWGKKHRVEDLCGSLDGRWLVALDNEKRIHVYNAITRELEFDMELNKRPTSVSISQDSRHLLINKSDGEAQLIDLVTRNSVQKFFGHTGGAYMIRSAFGGANESFVVSGSEDGNILIWHKNTGAAIERLPGHHPRCNAVAWNPTDPYVIASCGDDGRLKM

SEQ ID NO: 32229 - protein, 798 aa, Oceanospirillum sp. MED92
MKFSEKWLRELVNPAIDTQGIVDQITMAGLEVDEVEAAAKDFTGVVVGEILAAEQHPNADKLQVCKVTDGNEEFQVVCGAPNARAGLKTAFATIGAVLPGPDGKDFKIKKAKLRQVESFGMLCAEDELGISDDHDGIMELPANAPVGTSIREYLNLDDKIIDVDLTPNRGDCLSIAGLAREVGVLNKAPVTFVEDKETAAVIDDTFAVELKDAADCPRYVGRVIRGIDPAAETPLWMKQKLERSGVRSIDPVVDVTNYVLLELGQPMHAFDLDKLAGGIVVRRAEQGEKLTLLDGQEVELNADTLAITDANGPVAMAGIMGGEPTSVTAETKNIFLESAFFNPISIAGRARSYGLHTDSSHRFERGVDWQLQTRAINRATELLLDIVGGEAGPVTETANQDELPSDRQVFLRHAKVNAMLAFDMPAEEIEEILTRLGLGVEKTSTEGEWHVSVPSYRFDIAIEVDLIEELARVYGYNNLPVRTPTASMPIKERDETKVAIQQVRRALIALGYQEAITYSFIEAGLAKQFDDKYEAIALANPISAEMAVMRTTIWPGLAKALQHNQNRQQSRVRMFESGQRFLPTSGDEIIQENVVAGILAGSRDPEGWNAGKDQVDFFDIKGDLESLLALGGAEDEFSFVADRHVALHPGQTARIERNGQPVGFIGALHPNLVKELGLNGPVYLFEINQAALLQGKLPRYTEISKFPESRRDLAVIVEEGIAFDSVRQAAEKQAGEFLKNITLFDVYQGQGIEKGRKSLALGLTWQHPSRTLNDEEINSAIDAVVSALTSEFGASLRE

SEQ ID NO: 32230 - protein, 134 aa, Glycine max
MGRKKGYVEFEESPPDDFDPANPYKDPVAMLEMREHIVREKWIQIEKAMIIREKLRWCYRIEGVNHLQKCRHLVNQYLESTLPRLTLLSLNDLPVDNNNKKKGRPFIQLIILLNRILGWRSVCCSYCVHVLFFS

SEQ ID NO: 32231 - protein, 628 aa, Methylobacillus flagellatus KT
MNATDKNLQQNFLNATAQVDPGATQPFTNSRKIYIEGSRPDIRVPFREISLSDTPSAFGAEKNPPVIVYDTSGPYTDPDVQIDIRNGLPALRAGWIAERGDTEQLDGPTSSYGLERLHDPKLADMRFNLHRKPLRAKAGRNVTQMHYARQGIITPEMEFIAIRENQRREGMSELLQTQHAGQHFGASIPEIITPEFVRDEVARGRAIIPANINHPEIEPMIIGRNFLVKINANIGNSAVSSSIGEEVEKMVWGTRWGGDTVMDLSTGKNIHETREWIIRNSPVPIGTVPIYQALEKVNGKAEDLTWEIFRDTLIEQAEQGVDYFTIHAGVRLQYIPMTARRMTGIVSRGGSIMAKWCLAHHKESFLYEHFEEICDIMKAYDVSFSLGDGLRPGSIYDANDEAQFAELRTLGELTRIAWKHDVQTMIEGPGHVPMHMIKENMDLQLEHCGEAPFYTLGPLTTDIAPGYDHITSGIGAAMIGWYGCAMLCYVTPKEHLGLPDKEDVRVGIVTYKIAAHAADLAKGHPGAQIRDNALSKARFEFRWEDQFNLGLDPEKAKEFHDETLPQEGAKQAHFCSMCGPHFCSMKITQDVREYANKLGVDEQAALSKGMQEKAIEFVKRGSEVYQKV

SEQ ID NO: 32232 - protein, 302 aa, Pseudomonas syringae pv. tomato str. DC3000
MHDLLNEILDEVRPLLGQGKVADYIPALGGVRPDQLGIAVYGNDGQVFSAGDAETLFSIQSISKVFSLVQAIGHSGEDIWQRLGHEPSGQPFNSLVQLEFEQGRPRNPFINAGALVICDINQARFAAPSLSMRDFVRRLCGNRSITSDSKVAESEYQHRSRNAAAAYLMKSFDNFHGDVEDVLRSYFHHCALSMNCIDLAKAFGFLANQGFCAHSGVQILTARQATQVNSIMATSGLYDEAGNFAYRVGLPGKSGVGGGIVAIVPERASVCVWSPALNAAGNSLVGMAALEKLSARVDWSVF

SEQ ID NO: 32233 - protein, 126 aa, Staphylococcus epidermidis
MKIINSDKVPEALGPYSHATVINGFVFTSGQIPLTLDGTIVSDDVQEQTKQVLENLTVVLKEADSDLNSVVKATIYISDMNDFQQINQIYGNYFVEHQPARSCVEVSRLPKDVKVEIELIGKVKEL

SEQ ID NO: 32234 - protein, 542 aa, Physcomitrella patens
MEAGGRPMGPATAEYYLPNYKLGKTLGIGSFGKVKVAEHSPTGHKVAIKILNRRKVKMMDMEEKVRREIKILRLFMHPHIIRLYEVIETPADIFVVMEYVKSGELFDYIVEKGRLGEHEARRFFQQIVSGVEYCHRNMVVHRDLKPENLLLDSKSNVKIADFGLSNVMRDGHFLKTSCGSPNYAAPEVISGKLYAGPEVDVWSCGVILYALLCGSLPFDDENIPNLFKKIKGGIYTLPSHLSPGARDLIPRMLLVDPMKRVTIPEIRQHPWFLNHLPRYLAVPPPDTTQQAKRIDEEILERVVALNFDRDLLIDSLLNRVQNKATVAYYLMLDNRRRLSNGYLCSEFNEGKEHLMSPMDAFNGTPRSGYPRTLTHMSSMDRRSASPSGLQHRVVAERKWVLGLQLRSHPKEIMNDVLKTLRDLGINWKKTGAYNLKCRWVAPGQNSNDTTAENHSLPDSPMAGSMPRASSCRWSSEQHGVSGSVAAGNRDNESGVESNVLKFELQLFKLREEKYLLDLQRVVGPTYLFLDLCAAFLAELRVL

SEQ ID NO: 32235 - protein, 545 aa, Physcomitrella patens
MDSGGRPVAPVAVEYYLPNYKMGKTLGIGSFGKVKVAEHTPTGHKVAIKILNRRKVKSMDMEEKVRREIKILRLFMHPHIIRLYEVIETPTDIFVVMEYVKSGELFDYIVEKQRLGEDEARRFFQQIVSGVEYCHRNMVVHRDLKPENLLLDSKWNVKIADFGLSNIMRDGHFLKTSCGSPNYAAPEVISGKLYAGPEVDVWSCGVILYALLCGSLPFDDENIPNLFRKIKGGIYTLPSHLSPGARDLIPRMLLVDPMKRVTIPEIRQHPWFLNHLPRYLAVPPPDTLQQAKRIDEEILERVVALNFDRVHLIESLLNRVQNKATVAYYLMLDNRRRLSNGYLGSEFDEGKEQSLSPMSPYGAHGGTPRSTYPRSLIRTPSMDRRGSSSSVLQHRVVAERKWALGVQLRSHPKEIMSDVLDTLRKCDINWKKTGAYNLKCRWVAPNQHLNDRASEHRGIPDSPMAGTTPRVSSGRWSSEQQGISGSVASGNKDDESGVESNVLKFELQLFKMREEKYLLDLQRVEGPTYLFLDLFSAFLIELRVA

SEQ ID NO: 32236 - protein, 462 aa, Poncirus trifoliata
MDSNYTVIPKNSFLELQVYDNDQNPPSRINSHVKIQTFDEEHDADSKNFVDHVDNNQDDEHDDYPLISAKSNEGSGVAGAVFNLTTTVIGAGIMALPAAMKVLGLAVGFVLIIFMGILSEVSVELLVRFSVLCKATSYGEVVQYALGRPAKILSEICIILNNAGVLVVYLIIVGDVMSGSLHHTGVFDQWLGKGMWDHRKLLILIVLVVFLAPLCALDRIESLSMSSAASVALAVVFVVVCFFIAFIKLVEGKLDPPRMSPDFGSKKAILDLLVVIPIMTNAYVCHFNVQPIYNELEGRTPQKMNHVGRLTTILCIVVYSSTAISGYLLFGKDTESDVLTNFDKDLGIGYSTALNYIVRGSAPLLESRKRSLALTGVLLVLIYFGSTMIPSIWTAFKFTGATTAVSLGFIFPPLVALRLRKEGPGLSLWEKFLSGLMLVLAIVVSFVGVMGNIYSLESKSDD

SEQ ID NO: 32237 - protein, 98 aa, Zea mays
MFAHRKGVKGLGKGGPNRHRKALRYNIERITKPAIQLLARRGCVNRISGLIYDETRGVLKIFLENVIRDAGTYTEHARRKTVTDMDVDYALKRPGRTL

SEQ ID NO: 32238 - protein, 451 aa, Gibberella zeae PH-1
MSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRWEGVLTGKGLSWGGSLIRPEATGYGLVYYVDYMLKHANRGSFEGKRVALSGSGNVAQYAALKIIELGGSVVSLSDSKGALVAKEGSSFTPEQIHNIAALKIKHQSLTAFEHQDKFTWIEGARPWVHVGKVDIALPSATQNEVSKEEAQALLEAGAFIVAEGSNMGCTADAIDVFEAHRKENGAQALWYAPGKASNCGGVAVSGLEMAQNSQRIQWSEKEVDDRLKAIMKDAFVAGLETAQKYVEAKEGELPSLVAGSNIAGFIKVAEAMHNQGDWY

SEQ ID NO: 32239 - protein, 313 aa, Coccidioides immitis RS
MDVALEILDPLIFDKAYTYFIPAAVSNATTQTGLGATPSASSNSAWPRDNILRQCVSILVVTQVGATLLYWVFSAFSYYFIFDRRLEYHPRFLENQVRKEIISSMKAIPWINLFTLPFFLAEVRGKSFLYTRVEEYGRAWLGISTVLFMIWNDFLIYWIHRLEHHPSVYKYIHKPHHKWIIPTPWAALAFHPLDGYVQSLPYHLFVFLFPVQKYLYMTLFVLVQIWTIFIHDGDMISGHWLEKYINSPAHHTLHHMYFTVNYGQYFTWADSYFGSHRAPRPELDPLHDALRVMRTKGLVDEDGNPIPNKNKKE

SEQ ID NO: 32240 - protein, 348 aa, Magnetospirillum magnetotacticum MS-1
MSASEKANEPFLITTAISYPNGAPHIGHAYEVIATDAIARFHRLDGRDVLFTTGTDEHGLKIQQTAARAGVTPRAFVDDMAGRFKAVADRLDCAYDRFIRTTEADHYAAAQELWRRMEANGDIYLAKYAGWYSVRDEAYYDEAETVLGPDGNRRSIKTDTPVEWMEEENFLFRLSKYQDRLLKLYEEQPGFLAPETRMNEVASFVRSGLKDLSISRTTFDWGVPVPDRPGHVMYVWVDALTNYLTVTGFPDAADPNARFWPASLHVIGKDIVRFHAVYWPAFLMSAGLPLPKRVFGHGFFLSRGEKMSKSLGNVVDPLDLVGTTASIRCATSCCARRPSAATQLRPRG

SEQ ID NO: 32241 - protein, 421 aa, Oceanospirillum sp. MED92
MDACGGAAVSCLGHNHPDIKAALKSQVDQLSYAHSAFFTSQAAEQLAEKLTRLAPGNLNHAYFVSGGSEAVESALKLARQYFVEKGELSRKRFVARRQSYHGNTLGALAVGGNEWRKEPFTPLLMEHLYISPCYPYRDQRDGETLYEYGQRVANELEEIILQEGADSIIGFIAEPVVGATSGVLTPVDGYFKRIREICDQYGILLILDEVMCGMGRTGTLFAHEQEGITADIVTVAKGLGAGYQPIGAMLASDEIYNTVSEGSGFFQHGHTYMAHSAATATALEVLNVFERERLIPKAWATGNDLGRKLKEAFSDSPFIGDIRGRGLFWGLEIVQDRTTKAPFPVTSAIHKKIKQAAMGHGLMCYPMGGTIDGKNGHHILLAPPYIISAEQVDELVLKLKKAVNSVLPSEYTAIMPQAGSN

SEQ ID NO: 32242 - protein, 291 aa, Exiguobacterium sibiricum 255-15
MREEELEQMHQQARGQTQDQQPGIEAEMHPEPVYDDPEYVGSGKLKGKVALVTGGDSGIGRAVAIAYAKEGANVAIVYLNEGRDAEKTKQLIEGYGVKALALAKDVSQPENAQPIIDQVIQEFGQLNILVNNAGKQFPQDDFLAITPDQLKETFETNLFSMFYLTQAALPHLNKEDSIINTSSVTAYRGAPSLIDYSATKGAITTLTRSLASNLIEKGIRVNAVAPGPIWTPLIPATFTKEKVEAHGEDTPMKRRGQPSENAPAYVYLASRDSSYVTGQTIHINGGDYITS

SEQ ID NO: 32243 - protein, 215 aa, Glycine max
MAPKFQELSEKYLDVVFLKLDCNQENRPPKQAPIMALNLCISPNCKWVSSPASLDSASSLRSSLGSCFGNINIASVSLSTSRSLSLRRSGSVSVRSSLETTGPTVTVGQVTEVNKDTFWPIVKAAGDKTVVLDMYTQWCGPCKVMAPKFQELSEKYLDVVFLKLDCNQENRPLAKELGINVVPTFKILKDNKVVKEVTGAKYDDLVDAIDKVRSS

SEQ ID NO: 32244 - protein, 410 aa, Pseudomonas syringae pv. tomato str. DC3000
MLRKMMLFVGPGLLVSIGYMDPGNWATAIEAGSRFGYSLLFVVVLASLSGMVLQNLCSRLGIATGRDLAQLSAARYSRNVAKGQWLLAELSIIATDLAEVLGAALAFHLLLGVSITTGVALTAFDTLIVLALQGANFRRLEAIVLGLIVTIASCFAVELILIKPFWPDVVAGLRPSWDVLSSQEPLYIAIGILGATVMPHNLYLHSSVVQTRVNGMDVASKASAIRYARLDTIGSLSLALLINAAILILAAAAFHKTGHTDVVEIQDAYHLLDPLVGGAIASVLFGVALLAAGQSSTFSGTIAGQVVLEGFLQAKIPCWQRRFITRALALIPALIGVIWLGDSSVGKMLVLSQVVLSLQLPFALWPLIRFTSDPQLMGPFVNSRLVKTAAWCLFGLISAANLTLLWFWVS

SEQ ID NO: 32245 - protein, 450 aa, Bacillus anthracis str. Ames
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 32246 - protein, 170 aa, Triticum aestivum
  misc_feature (51)..(51): Xaa can be any naturally occurring amino acid
MAAALAEPLASPCRAPTFPSSCFSSVRLTCLCEPREFGTRGLTAYQLICLXDLEFDYINPYDSSSRINAVVIIEYVLQGVLCASFLLTLNWFPFLVMAPVTYYHVKLYMNRKHLIDVTEIFRQLHGEKKYRMIKLAFYFALFIISIYRLVMTAVLLFIDEDVNLVETRTI

SEQ ID NO: 32247 - protein, 1043 aa, Rhodococcus sp. RHA1
MFLDFDGTLANIVSDPSKAVLVDGVGDELVRLTHECPVAVISGRDLADVQTRVGLADIWYAGSHGFELAGPQGQYYQNPDALAAVPLLHHATRALTDRLRDVPGVLIEPKKYTVAVHYRNVAPDRIDEVVATVHDVATTGEVRLRVTGGRKVVELRPDVDWDKGRALNWVLEHIHDAKSLLPIYIGDDLTDEDAFDAVTTNGVGIVVRSTEVGDRRSAARFAVNDPAQVRELLQRLADLLGRDPETAATADAWMLFYDGYDPATEKLREAICTLGNGYFATRGCAPEATAGSVHYPGTYIAGLYNRLRDERAGTEIVNESMVNAPNWLTTTFRIEGGPWFDVDATDLLEYRQYLNLRRAVLTRRFRYRDGAGRTTSVIQRRFVAMHLPHVCALQTTIVAENWSGSFEVRSALDGAVRNTLVERYRDLAAEHLAPLQSGALSADTVLLAMQTTQSRIPVAMAARTTLSPRDRHRECTYRLHDDDGRIGHDLTVDLTEGESVTFEKMVTVFTGRDHALSEPADEAARWVPSIGGFEEVLDGHVLAWEHLWDRIGISLGHYQDGLRIARLHQMQLLQTVSPNTADLDVGVPARGLHGEAYRGHVFWDELFVFPVLNLRVPTLTRSLLRYRYRRLPEARRAARAAGHRGAMFPWQSGSDGREESQQVHLNPRSGRWLPDPSWRQHHIGIAIAYNVWNYYQVTGDLEFLSDFGAEMLVEIARFFAGLASYESARRRYTIRGVMGPDEFHSGYPDAPHEGVDNNAYTNVMAVWVILRAREALDMIPAPDRADLVDTLSLDAHEMARWADVSRRMFVPFHDRVISQFEGYEALAELDWAGYRQRYTDIQRLDRILEAEGDDVNRYRASKQADVLMLFYLLSADELRDLFGRLGYQLEPEAIPRTIDYYIARTSHGSTLSAVVHSWVLARANRDKAMEFFDRVLASDITDIQGGTTSEGIHLAAMAGSIDLLQRCFTGLETRGDRLVFSPEWPHTLGALEFPIVYRGHQLWLTISGRRVQVSAGAGNQRAIEISCRDQVVRLEPGCTVSLG

SEQ ID NO: 32248 - protein, 330 aa, Oryza sativa (japonica cultivar-group)
MAQPQRPLQVPDITKSTHSGGNTVLAYASSAMQGYRSTMEDAHATIENLDALTNTSFFGVYDGHGGSAVARMDEMLRNQAASKELTEYGSGNEYWRTAGRSWLRCAPCVLGPVYCGPLAEGCTACVVLIRNTQIVVGNAGDARCVISRNGQAIALSNDHKPNFPEETQRIVAAGGSVSFSRGSHRVNNGIAVSRAIGIAYMFVGGDLSYKNNKKLRPEQQLLTCSPEIRADQLTDDTEFLVIACDGVWDVLANQAVVDFVRLHLNNGVELSVICESLLQEAITRDPPSTDNMSVILVRFLHPEGNRGARAATSSTSTGTVPSRHSKSISL

SEQ ID NO: 32249 - protein, 514 aa, Oryza sativa
MAAMVGAPLAVAAAAAAPGARVFLARPLLRRSPRGVACALRRRPSKYKNKIQNEEVVVEDDIGGGGEDDDDALEALFKQLEEDLKNDDLSVEDDDDGISEEDMARFEQELAEAIGDIADADESGEGSSLGSEAYGNDEKTDEIKRPELKNWQLKRLARALKIGRRKTSIKNLAGELGLDRTLVIELLRNPPPKLLFMSDSLPDEDPSKPEIKEIEPSPVVDNADVTETKPQTELPVHVMCAEWSSQKRLKKVQLETLERVYSRTKRPTNTMISSIVQVTSLPRKTIVKWFEDRREQDGVTFSTLLDQTHALPYFNRNRVAIFNMEKFRSSSEGNYVETGEGGSIWGPARLQHRDSERGVVVLVVQMMAGLQRSATTFRRSGSSGLVWDERFLTEDAEAAKAGDGDGGGGTEEPQPELRHSKSVGSIGMMRRVAADDGDDSEKTTKQQRKKKKKKKKDGQKEDDNRSQQVFRTKDIAPDVDPPSPRVSGCILCSIFSGSGSSSSATSRRAKPRKK

SEQ ID NO: 32250 - protein, 406 aa, Oryza sativa (indica cultivar-group)
MEQSARQRSSVATNATVDLEVLDCTVCCHPLKPPVLQCGVGHVICSSCHGKLPDKNRCHVCAMDTAYNRCFAVEQILRSILVPCRNAGYGCDAKTAYHDSDSHEDGCPHAPCFCPEPGCGFAGATSSLPAHFTGGHGWPPATEFRRARAFDLQVQEGKRVLRDVDGGHLFLVDVAPAGPAGLAGAVLLLDPHAGAKAKPKFECHVAFHCRATGWRSSSEFPVRSTALAGGSLPADCYAFVVPRVAHPPATASIIVSVYDVSKKRPRNAYNTTQNTTSTFMEVVQEVLKHGSTQGVRAAIRSDQKSYNLVQLIASALDVYNILRNKNVPPLSFSMTQNGSTGSSVKGINGTGFLGGARIGIVAKPSPEFVAGIFGTWLSGGVAVPLALSYPEAELLHVMNDSMIKYE

SEQ ID NO: 32251 - protein, 429 aa, Desulfovibrio desulfuricans G20
MSILEANTALRSLLDQHISMLAEKEHISAETIRAGIENGTMVLLGNPSHGNVLPTLVGQPAGVKVNANIGTSPLKNSVACEMRKLQVAEQAGADTVMDLSIAGDLDAIRREMLSQTRLPLGTVPMYSVAQRYLDADRDPAEMDPEELFEEIEKQAGQGVDFITVHCGLTRRGAELATDGSRLLGIVSRGGSILARWMLRNNKENPLLTGFDRLIDICRRHNVTFSLGDGLRPGAGHDAGDAAQYEEVMVLGQLAKRALAAGAQCMIEGPGHVPFNQVRSQIQTIKRMTNNAPLYVLGPLTIDSCPGYDHIAGAIGGAIAVEAGVDFLCYLTPAEHLTLPTMDDVHAGVVASRIAAQAGEVALGRAAALEREEGISRARKDLDWDAMKKYALDAPKIDERRGEHKDEEECAMCGKFCAVKMLREDPMGKI

SEQ ID NO: 32252 - protein, 226 aa, Sporosarcina psychrophila
ILDFTKVMEAKWFEFPQMLIPGVDYDFVITPTLLFLMVPIAIVTISEHIGHQLVLGRIVGRDYIKNPGLNRSLLGDGLGTLISGLVGGPPKTTYGENIGVLALTRVYSVYVILGAAVFAIAFSFLGKVMALIATIPTAVLGGVSILLFGIIASSGLRMLVDHKIDFGSQRNLVIASVILVIGIGGASIEFSDTFQIEGMALAAIIGVILNLVLPGRTNESLVDEKE

SEQ ID NO: 32253 - protein, 262 aa, Oryza sativa
MAAMLLRLHPCPLLFPPPPPHPHLRRQLAVYSIPKSSFRSAAAAARARNPPRLASVGGAERRRVGDDYDEEEEDLGQALERTRQLVECAMFASVAGLAYFLSNSLAIEVRCLLPFSSESYWLAGAWRDQERASSGADERREGRRSAPAHGGAAAAAAATRREEGAAPARRWAAAPVRGGVARQLLPQGGREGQLQRVVVGGAVGPAPAVATRREGWAAPRTEGWWHWLLPRGGREGGPALALGRRSGDADARREEEQRRQRV

SEQ ID NO: 32254 - protein, 620 aa, Oryza sativa (indica cultivar-group)
MEIERESSERGSISWRASAAHDQDAKKLDADDQLLMKEPAWKRFLAHVGPGFMVSLAYLDPGNLETDLQAGANHRYELLWVILIGLIFALIIQSLAANLGVVTGRHLAEICKSEYPKFVKIFLWLLAELAVIAADIPEVIGTAFAFNILFHIPVWVGVLITGTSTLLLLGLQKYGVRKLEFLISMLVFVMAACFFGELSIVKPPAKEVMKGLFIPRLNGDGATADAIALLGALVMPHNLFLHSALVLSRKTPASVRGIKDGCRFFLYESGFALFVALLINIAVVSVSGTACSSANLSQEDADKCANLSLDTSSFLLKNVLGKSSAIVYGVALLASGQSSTITGTYAGQYIMQGFLDIRMRKWLRNLMTRTIAIAPSLIVSIIGGSRGAGRLIIIASMILSFELPFALIPLLKFSSSKSKMGPHKNSIYIIVFSWFLGLLIIGINMYFLSTSFVGWLIHNDLPKYANVLVGAAVFPFMLVYIVAVVYLTIRKDSVVTFVADSSLAAVVDAEKADAGDLAVDDDEPLPYRDDLADIPLPRCPQHAYITPMTHPIIMSTSARLSRHLLILTKSPHVPRCRSASDLAPIPTLSASGSSQCGLLKLTFRIWCVVTVGVIGEEGDD

SEQ ID NO: 32255 - protein, 494 aa, Oceanospirillum sp. MED92
MKSYSEWQALSETLSFQGQAYINGEFQSAASGETFPCINPSTEKVLTDIASCDEADVNAAVANSREVFKSGVWSEMHPRQRKQIMLKWADLIEQHKDEFALLDTLDMGKSINEMVNIDVPDAIDCFRWTAECIDKVYGEIAPTGTDTLALISHNPVGVVGAITPWNYPLLMVSWKIAPAIAAGNSVVLKPSEKASLSALRLAELAVEAGIPKGVLNVLPGYGHTAGKALALHMDVNVLAFTGSTRVAGMLMGYAGQSNMKRVWLEAGGKSPNLVFADCDIKKAAAGTANAIFANQGEVCIACSRLYVEKSIKEEFMAALMEEAKRFQTGDPLDPATTMGPMVDGMQLETVERYIRSAVEEGGNIVTGGLPEYTDGQGFFARPTIIDNANNDMTFVKEEIFGPVLAVCDFETEDEAIELANDSQYGLGAAVWTENLSRAHRVSGKIESGMVWVNTWGEGDTTVPFGGVKASGNGRDKSLHALEKYTDIKNVLIRL

SEQ ID NO: 32256 - protein, 518 aa, Oryza sativa (indica cultivar-group)
MGVTKAEAVAGDGGKVVDDIEALADLRKEPAWKKFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDACRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEDSKEPPV

SEQ ID NO: 32257 - protein, 791 aa, Oryza sativa
MASSHQEDREEEEEHSHGDDEITAPFSQQDRRHRSLAHSFFRLVAALIGSCVYAVRPSTSRGSPELEEEENSPIEQVALTVPVSDEPETPVLTFRMWVLGTASCAVLSFLNQFFWYRKEPLTITAISAQIAVVPLGRLMAAALPERAFFRGRPWEFTLNPGPFNVKEHVLITIFANSGAGTVYAIHVITAVRVFYGKHISFFVSLLVVLTTQVVDDQVLGFGWAGIFRRYLVEPAAMWWPSNLVQVSLFRALHEKEARSKGGLTRNQFFLVAFICSFAYYIFPGYLFQMLTSLSWICWVFPHSVLAQQLGSGLSGLGIGAIGLDWSTVSSYLGSPLASPWFATANVAAGFFFIMYIITPIAYWFNFYKAQNFPIFSDGLFTSTGQKYNISSIVDSHFHFDTKAYEKNGPLYLSTFFAVTYGVGFASLTATIVHVLLFHGSEIWQLSKSAFQEKRMDIHTKLMRRYKQVPEWWFVCILIANIAVTIFACEYYIEQLQLPWWGVLLACAIAFFFTLPIGIITATTNQTPGLNIITEYIMGYLYPGRPVANMCFKVYGYISMSQALTFLQDFKLGHYMKIPPRTMFMAQVVGTLIAAFVYIGTAWWLMETIPNICNTELLPSDSPWTCPGDHVFYDASVIWGLISPRRIFGDLGTYSAVNWFFLGGAIAPVLVWFAHKAFPNQNWILLINMPVLIGATGQMPPATAVNYTTWILVGFLSGYVVYRYRRDWWERHNYLLSGALDAGLAFMAVLIYLCLGLENISLNWWGNDLDGCPLASCPTAKGVVVDGCPVYT

SEQ ID NO: 32258 - protein, 160 aa, Aspergillus nidulans FGSC A4
MAEKMLVMTSNDGKNIEVPRDVAERSLLIKNMLEDLGDPTEPIPIPNVSENVLSKVLEWCAHHRNDPPSSADDDDSRRKTTDIEEWDQKFMQVDQEMLFEIILAANYLDIKPLLDIGCKTVANMIKGKSPEEIRKTFNIQNDFTPEEEDQIRRENEWAEE

SEQ ID NO: 32259 - protein, 378 aa, Aspergillus nidulans FGSC A4
MKLTFRDLKQQKFVIDAEPSETVGQVKEKISTEKGWDVPSLKLIYSGKILQDDKTVEFYNIEEKGFIVCMVSKPKTQPSSQSPSTPAKSVTSTPAPPPAPAPSTNTSTTATSGPVPATPSPASSGAAQSSASTFNDPSALLTGSQSEEVINQMMSMGFEREQINRAMRAAFFNPDRAIEYLLNLLISAFAIKGIPENIQQEQQQRSAATTPAAPQAAAASGAPPATSGEDEPVNLFEAAAQAGEGRGGAGGASGGEPQSLDFLRNHPAFQQLRQLVQQQPQMLEPILQQVGQGNPQIAQLIGQNEEAFLQLLSEEDDAALPPGTTQIHVTEEERDAIERLCRLGFPRDLVIQAYFACDKNEELAANYLFENSDDGDDA

SEQ ID NO: 32260 - protein, 260 aa, Arabidopsis thaliana
MASSSSMQMVHTSRSIAQIGFGVKSQLVSANRTTQSVCFGARSSGIALSSRLHYASPIKQFSGVYATTKHQRTACVKSMAAEEEEVTEPQAKVTNKVYFDVEIGGEVAGRIVMGLFGEVVPKTVENFRALCTGEKKYGYKGSSFHRIIKDFMIQGGDFTEGNGTGGISIYGAKFEDENFTLKHTGPGILSMANAGPNTNGSQFFICTVKTSWLDNKHVVFGQVIEGMKLVRTLESQETRAFDVPKKGCRIYACGELPLDA

SEQ ID NO: 32261 - protein, 911 aa, Aspergillus nidulans FGSC A4
MRAKCLAAWLTSTTTPPSISLHHPWIASIFALPGARGVLNHAGGGWQLQESSSSPSSCSPPFFVSESWTMVIKKAEMKQSAVLTRDFKDIRRSDGAAVGGKNASLGELVNALVPQGVAIPSGFALTAQAYWEFVRTNGIRENIARLLAGWQAGRATLPETGDAIRKRFLWGGWPPDVEEAIRAAYRRLAASERENTRDGRDGHDGHDGNGDGDGAFDVDVAVRSSATAEDLPDASFAGQLDSFLNVRGEEAVLQACQRCYASLFTDRAISYRQTMGFDQVSIALSVGVQRMVRSDIGGAGVLFSLDPDSGFNQVVLINAAWGLGENVVQGTVTPDEYHVFKPLLLADPGLTPIIDQRCGEKAMKMIYTQGRHGEEGKGCTRNVPTSKAEREAMVLSPREILQLARWGCLIEQHYGRPMDMEWARDGLTGQLFIVQARPETVHSRRRDLDVFQRHKLVGPRGRELVRGLSVGDAAVSGRVCLIETADEISQFVPGSVLVTGATDPDWVPIMKQAAAIVTDHGGRTSHAAIISRELGLPAVVGAGRATYMLHSDQEVTVSCAEGDAGFVYEGLSEIRTETIDLSSLAFPSPSPSSHSTQVMLNMANPAAAYRWWRLPASGIGLARMEFVVSNSIQVHPMALVHFDELRDPAAKDQIARLTAGYRDKPAYFVDRLAHGFAALCAAVYPRPAILRLSDFKTNEYAGLIGGSQFEPREENPMLGLRGASRYYSPRYREAFALECRAIKQLRQTIGFTNAIVMIPFCRTVDEARRVLALMAENGLVRGQDGLQVYMMCEIPSNVILAADFAEYFDGFSIGSNDLTQLTLGVDRDAEELAHLFSEQDRAVRWMIAEVIMVCRKKGCKIGLCGQAPSDRPEFARFLVQAGIDSISVSPDSFVAVARNVQAALSSGESPA

SEQ ID NO: 32262 - protein, 383 aa, Abies grandis
MAYSCMAASCHGLHFMNIASQECNLKRGIIPSKRLHGISSSLWASNGFQGHLERDLSAYRHLVSSSRCLNTIAMLSNLSEQAKEKATEFDFKEYLHSKAISVNEALERAVPLRYPEKIHEAMRYSLLAGGKRIRPILTIAACELVGGSEELAMPTACAMEMIHTMSLIHDDLPSMDNDDLRRGKLTNHKVFGEGTAVLAGDALLSFAFEHIAVSTRKTVASHRVLRVVSELGKAIGSQGVAGGQVADITSEGDPSVGLETLEWIHIHKTAVLLECAVVSGAIIGGASENEIERTGRYARCVGLLFQVVDDILDVTRSSEELGKTAGKDLVSDKATYPKLMGLEKAKEFADELLDRAKEELSCFNPAKAAPLLGLADYIALRQN

SEQ ID NO: 32263 - protein, 381 aa, Abies grandis
MAYSAMATMGYNGMAASCHTLHPTSPLKPFHGASTSLEAFNGEHMGLLRGYSKRKLSSYKNPASRSSNATVAQLLNPPQKGKKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 32264 - protein, 359 aa, Thermoplasma volcanium GSS1
MTVKGVLMAGGKGTRLRPITYSIPKPLVPVAGKPVISYILDSFYNAGVKDIIITTGYKFEALIKGVLENKFSDQNILFSVEKDPAGTAGGVKLAENFIDDTFVVGSGDILIDFDVSKMIEEHKKRGANITIALTRVDDPSQFGIAEVDDEGYVKRFLEKPKKSETFSNTINAGVYVIEPSVLEYIPKGVQFDFAKDLFPKAMANGIKIYTYEINGVWLDAGRPGDLIKANQIMVDKYGDRNINGSRMILKARIPDGVNVSGPTYIGEGVAIGKGSSIDSSTIYEGVQIGNDVEIKNSVIMSSCRILDGSKISDSVIMQNTVIGEACEIRNSVLSQKLNLQKGSRVFDVALSSEIIQDEN

SEQ ID NO: 32265 - protein, 509 aa, Sesamum indicum
MALPLLILSFLTIFIAYKLFQRLRYKLPPGPRPLPVVGNLYDIKPLLVRCFTEWSQVYGPIFSVYLGSHLSVVVNSAELAKEVLKDNDQQLANRNRTRQIAKFSKNGADLIWSDYGPHYVKVRKLCTLELFSMKRLEGLRPIREDEVTAMVESIFKDCNKPENKGKALVLREYLGMMAFLHIARLTFGKRFMDSNGVVDGQGEELKAILHNGIKLGTKKSWAEFLPWFRFLFKTENQLLAEHDALADSFTKKIMQEHTLARQKTGNTKNHFVDALLTLQKEYDLSDDTVIGLLWDMISAGMVTTTITVEWAMAELVRNPRVQQKVQEELDRVVGSDRVMTEADIPNLPYLQCVTKECFRMHPPTPLMLPHKASTNVKIGGYDIPKGATVSVNVWALARDPAVWKNPLEFRPERFQEEDIDMKGTDYRLLPFGSGRRICPGAQLAIYLVTSMLGHMLHHFTWTPPAGTKPEDMDMMEQPGTVTYMRTPLQAVPTPRLPADLFKRVASGNV

SEQ ID NO: 32266 - protein, 1081 aa, Geobacter sulfurreducens PCA
MPKRTDIKKILIIGAGPIVIGQACEFDYSGTQACKALKEEGFEVVLLNSNPATIMTDPDFADRTYVEPVTPEVLAKIIEKERPDAVLPTLGGQTALNTAVAVAENGTLEKFGVELIGAKLPAIKKAEDRTLFKEAMEKIGLSVPRSGLAHNYSEAMTVVKTVGFPAIIRPSFTLGGTGGGIAYNMEEYEKMAMAGIDASPTDEILVEESVIGWKEYELEVMRDTADNVVIICSIENFDPMGVHTGDSITVAPAQTLTDKEYQILRDAALKIIREIGVDTGGSNIQFGINPRNGRLVVIEMNPRVSRSSALASKATGFPIAKIAAKLAVGYTLDEIRNDITRETPACFEPTIDYVVTKIPRFTFEKFPAADATLTTQMKSVGEVMAIGRTFKESFQKALRSLEIGSAGFESRIFTNGDTRRALAPNEQQQLQDKLRVPNWERLWYLGDAFRCGMSIEEVFQLTAIDPWFLHNIKQIIEKEEELRKVDVTAAAPDDLRAIVREAKQYGFSDRMLGRFWGKSDEEIRQLRLSLGIKPVFKRVDTCAAEFVAYTPYLYSTYEDECEAEVTDRKKIMILGGGPNRIGQGIEFDYCCVHGVFALAEDGYETIMVNCNPETVSTDYDTSDRLYFEPLTYEDVLSIVELEKPEGVIVQFGGQTPLKLAVALEKAGVPIIGTSPDAIDRAEDRERFQEMLHKLNLLQPENGTARSFEEAEEVANRIGYPVVVRPSYVLGGRAMEIVYDVENLRRYMTTAVQASPEHPILIDKFLDKAIEIDVDALCDGTDVVIGGIMEHIEEAGIHSGDSACCLPPHSISQALVEEIRRQTTVMALELNVKGLMNVQYAIKDGTIYILEVNPRASRTAPFVSKATGRPLAKIAARVMAGRSLKDLGVSGDIVPKHMSVKEAVFPFVKFPGVDTLLGPEMKSTGEVMGIGPDFATAFAKAQLGANVRLPRSGKVFISLHDADKKHIVESAKKLYNAGFRLVATRGTAAYLKEKGVEVEVINKVLEGRPHVVDAIKNGEICMVLNTTQGAQAVADSFSIRREALMHNVAYFTTVAGANAAAGGIVAMLEGELDVKPLQEYLG

SEQ ID NO: 32267 - protein, 192 aa, Yersinia pestis CO92
MTKHVAVLLAHGFEEAEAVIFIDIMRRLDIRVDILSCEATTALSTYFETPISADALLSDRLDHHYDAVMMPGGPKGTDSLTANPQVIAFLRRHIAQDKYICALCSSGAKVLAAHHLLAGRTYSTGDKLADKFADGAYLDQDVVVDGKFITAKGLGVSFEFAFTVARHLLSDNLPKVEHQASHIYFKHGSAQT

SEQ ID NO: 32268 - protein, 551 aa, Desulfovibrio desulfuricans G20
MTTAAKAGQLPAHDELINIARLVSDFYTVSPDRQNPDERVMFGTSGHRGTSGTASFNEAHILAVTQAVCDFRRDNGFSGPLFMGMDTHALSEPARCAALEVLAANGVTTFIEPESGYTPTPVISHAILTHNAGRTSGFADGIVITPSHNPPQDGGFKYNPPHGGPAETGVTNDIEKRANLLLASDNKAVRRIPLTKALASEYTVLHDFAAHYINDLGSVINMQAIARSGLRLAADPLGGASVTYWDRIAEKYGLNIDVPNRQVDQTFRFMPYDRDGVIRMDCSSPWAMGGLLELKDSYDLAFGNDPDADRHGIVTPAGLMNPNHYLAAAIAYLFRHRPAWKATAGIGKTLVSSSMIDRVAADMGRTVIEVPVGFKWFVPMLLDGTAGFAGEESAGASLLRQDGTVWTTDKDGIALNLLAAEITAVTGNTPDRLYKELTGRFGTPVYRRLQAHADGRQKEVLKALNPETVTITELGGDPVEKVITHAPGNGAAIGGLKVVSAGGWFAARPSGTEDIYKIYVESFRGEEHLEQLAGEAQAIVSNAFAAAGIKN

SEQ ID NO: 32269 - protein, 456 aa, Chlamydia trachomatis D/UW-3/CX
MNLWTKIFQPPCHIKEISDPELVKKQYKYWRMRIFYSMFLGYVFFYFTRKSFTFAMPTLIADLGFDKAQLGIIGSTLYITYGISKFVSGVMSDQSNPRYFMAIGLIITGISNIFFGLSSTIPLFVLFWGINGWFQGWGWPPCARLLTHWYSKSERGTWWSVWSTSHNIGGALIPVLTGVAIDYTGWRGAMFIPGIICIIMGFILIDRLRDTPQSLGLPAIEKFRKEEDAHPHEETTADILEEEAERELSTKEILFTYVLSNKWLWFLSFASFFIYVVRMAVNDWSALYLIETKDYSTVKANLCVSLFEIGGLFGMLLAGWLSDTISKGKRGPMNVVFSLGLLVSILGLWGTRDYFVWWIDGTFLFIIGFFLFGPQMMIGLAAAELSHKKAAGTASGFTGWFAYFGAAFAGYPLGKVAQDWGWHGFFVALLACALIALILFLPTWNASEQSLRKHSH

SEQ ID NO: 32270 - protein, 172 aa, Triticum aestivum
KTSQSVAIHFKFPKSPTPQRAQAEARFAVDEKQERSMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 32271 - protein, 864 aa, Hordeum vulgare subsp. vulgare
MLGVGGIVSDLTGGIRGAHLKGSVVLMRKNALDFNDFGAHVMDGVTELLGRGVTCQLISSTNVDHNNGGRGKVGAEANLEQWLLPTNLPFITTGENKFAVTFDWSVDKLGVPGAIIVKNNHASEFFLKTITLDNVPGRGTIVFVANSWVYPQAKYRYNRVFFANDTYLPHQMPAALKPYRDDELRNLRGDDQQGPYLDHDRVYRYDVYNDLGDSRDVLGGSKDLPYPRRCRTGRKPSDSKPDHESRLLLLVQNVYVLRDELFGHLKQSDLLGYTLKGWLDGIILAIRTYVDLSPGEFDSFADILKLYEGGIKLPNIPALEEVRKRFPLQLVKDLIPKGGDFLLKLPKPEIIKVDQKAWMTDEEFAREMLAGVNPMMIKRLTEFPPKSTLDPSKYGDHTSTMTEEHVAKSLEGLTVQQALAGNRLYIVDQHDNLMPFLIDINNLDASFVYATRTLLFLRGDGTLAPVAIELSSPLIQGELTTAKSAVYTPQHAGVEGWIWQLAKAYASVNDYGWHQLISHWLNTHAVMEPFVIATNRQLSVTHPVYKLLHPHYRDTMNINARARGLLINAGGVIEMTVFPHKHAMPMSSMVYKHWNFTEQALPADLIKRGMAVEDASSPHKVRLLIKDYPYATDGLAVWDAIEQWVSDYLTIYYPNDGVLQGDVELQAWWKEVREVGHGDLKDAAWWPKMQTVAELIKACATIIWTGSALHAAVNFGQYPYSGYHPNKPSASRRPMPVQGSEEYAELERDPEKAFIRTITSQFHALVGISLMEILSKHSSDEVYLGQHDTPAWTSDAKALEAFKRFGAKLEGIEKQVVAMNSDPQLKNRTGPAKFPYMLLYPNTSDHTGQAEGLTARGIPNSISI

SEQ ID NO: 32272 - protein, 580 aa, Zea mays
  misc_feature (122)..(122): Xaa can be any naturally occurring amino acid
MEVRGGVGQGSAARHPPAPEPSRAAARVQAGDALPLPIRHTNLIFSALFAASLAYLMRRWREKIRSSTPLHAVGLAEMLAIFGLVASLIYLLSFFGIAFVQSIVSSGDDDEDFLVGSGSSGXSAAAPSRQHAQAPAPCELLGSPAAAPEKMPEDDEEIVASVVAGKVPSYALEARLGDCRRAAGIRREALRRITGRDIEGLPLDGFDYASILGQCCELPVGYVQLPVGVAGPLLLDGRRFYLPMATTEGCLVASTNRGCKAIAESGGATSVVLRDAMTRAPVARFPTARRAAELKAFLEDPANFDTLSVVFNRSSRFARLQGVQCAMAGRNLYMRFSCSTGDAMGMNMVSKGVQNVLDFLQDDFHDMDVISISGNFCSDKKPSAVNWIEGRGKSVVCEAVIGEEVVKKVLKTDVQSLVELNTIKNLAGSAVAGALGGFNAHASNIVTAIFIATGQDPAQNVESSHCITMLEPVNAGRDLHISVTMPSIEVGTVGGGTQLASQSACLDLLGVRGASRDRPGSNARLLATVVAGGVLAGELSLLSALAAGQLVKSHMKYNRSSKDVSSTTATEKTRQREVDV

SEQ ID NO: 32273 - protein, 220 aa, Oryza sativa (japonica cultivar-group)
MDAMAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 32274 - protein, 232 aa, Exiguobacterium sibiricum 255-15
MYEQEKKMLAEAAIKQVKNGMILGLGTGSTTRSFIDALGEWVKAGGEVQGVATSNETVEQAKRLNIPLLSLEEATHIDLVIDGIDQIDPRFRVLKGGGGALFREKVVALMSREILYLADASKFVHHLTGPLPVEIDAFARPYVERYLRDKQLDVTLREHDGQPFVTDGGHLILDVDLERVQDVRHFAQELKSLTGVLETGYFERQPDHVLTVEQGKVRQLAHPNLRDGGGLV

SEQ ID NO: 32275 - protein, 469 aa, Vibrio fischeri ES114
MKFAHDFLFGAATASYQVEGAWDQDGKGPTNWDEFTKIPGKTFEGTNGDVAVDHYNRYKEDIALMAEMGLESYRFSISWARIFPNGTGEINQKGIDFYNNLIDECLKYGIVPFVTLYHWDLPLALEKEGAWLNKATGDAYVEFAKLCFNEFGDRVKHFITFNETVVFCALGYMAGAHPPGIQNDPKKYFQATHNVFYAHAKAVIEYKKLNQFGEIGLSHVFSPAFGVDDSEESHFAAMHANQFSMNWFYDPILLGKYPEYVVKQLQEEGNLPDWTDEELQTIFEAAPLNDFMGLNYYQPQRVEKIQGDVEARTITRENSTGSPGNPSYDNVYRTVKMADKKYTKWDWEISPEGFVGGLEMLKEHYGQIKLYITENGLGDEDPIIEGEVCDIPRINFIKEHLGAVKEAVRRGVHIKGYYAWSAIDLLSWLNGYKKQYGFIYVDHQNGLARKKKASFHWFKDVIATRGEDI

SEQ ID NO: 32276 - protein, 335 aa, Pseudomonas putida
MLPKVCIIGAGCSGFTTAKALADRGIPFDCFDMSDQIGGNWVFKNKNGRSACYQSLHIDTSKYRMQFEDLPIPSHFPDYPHHSQVLEYFNAYVDRFGLRKRITFNTEVTKAELMPDKTWRVTLSNGETRSYGALVVANGHHWDQYIPSFPGTFDGPSFHSHRYIDPFEPVDMRGKRILVVGMGNSAMDIASELSQKPIAKRLVVAARRGVWIFPKYINGKVPDKGHAFVDAPLPDPRAGEAHDHPCRRAHEGLRASRARASSCGCAPFGVRRVPDAGRMWRCCREAEYRGTARYQGQVRGRFCRNPTYKPSAFSASLKAHMLEPRPGKSTETGRF

SEQ ID NO: 32277 - protein, 387 aa, Abies grandis
MAYSGMVRSFQGVYFMAVALDRNRNLKRIDIPSKRFDGVSTSFVACNGEHLGLPVNLKKEFLSCIQRASSSRSSNTIVQFANLPEQGKKVVEFDFNKYMLSKAMAVTEALDKAIPHSYPQKIHESMRYSLLAGGKRVRPVLCIAACELVGGREELAMPTACAMEMIHTMSLIHDDLPCMDNDDLRRGKPTNHKVFGQDTALLAGDALHAFAFEHIVAFTSKSVGSDGILRAVTELARATGPQGIMGGQIVDIASERDAFVDLQTLEWIHIHKTAVLFECATVCGAIIGGASGDEIERIRRFARYLGLLFQVVDDILDVTKSSEDLGKTAGKDLVSDKATYPKLMGLEKAKGFSLELLNKAKEELSCFDPMKAAPLFGLADYMALRQN

SEQ ID NO: 32278 - protein, 950 aa, Arabidopsis thaliana
MNRNHHDHLDAAGKDMWSRLSDLADKADMLYEREGISKDRKSVSEEEEEKKTRFSILVDLVGRLCDQEERRTLGSSPTKTNTLFEGSEKSHLDHHLDHLPQKPRSSLECFFTRVYTRRNHNNVSTSSSLFNTDEFERTETKSPTIRNSQSSPSSCLMENTKRKRYQSSGKSKKPKFDPFSLTAARETPEWLLDVMRKMKGAEGPIKLIYEKTLTATDVKPSESRLLIPFNKLLRNDFLTPEESRAIAIDKEEEEEDTKKIGVKTIIVNQFSKEWSLRFLIWVMKKKKSGNGTLYYTLNRGWNGVVSGNKLKANDNISLWTFRQTLLWGKNCYSSSVGSIFRIVVSSESPYASTILSSSLKHDDTGLQTARGSGTNGYVQTNKFFVRPRNGGKPVKGGKGFEDDEGTAGLSKKPNKAILEHDRKRQIHLKLAILEDKLADQGYSDIEIAQKLEEARVSLEAAAAANEEESDSKVSNTQTHQVAAGRVGQMEAFRAALGLPDQQQVAEEGIIDDEPMREGFEGRLKERREHSFLDRDSGRKKVDEDVDEKDAKVKESKKQRGGDDDDVDVVKRHKKKESKKRRHDDSSESDEHGRDRRRRSKKKAKGRKQESESDSSSSDSESDSDSDDGKKRGRKKPTKTTKKRSRRKRSVSSESEEVESDDSKKLRKSHKKSLPSNRSGSKELRDKHDEQSRAGRKRHDSDVSEPESEDNKQPLRKKEEAYRGGQKQKRDDEDVEADHLKDRYTRDDKKAARDSDDSEIEYQNKKQLRSKVEVYSAGMSQKRKEEEDVTKHGKDKYRSDSRGKEVARDSDDSEAEYENRKKLKNESYQRGRKHKREEDEDNDNHGRDRYRGDDAVKRYGTIKEDDDRYRGRAIEEEGDDDRGRYRPRRESVKDDEEEYKHGRDRYRGDGRRATGKEDDDDDRVSREREYSSRGRSRYDDSRSSGKRSSHG

SEQ ID NO: 32279 - protein, 536 aa, Thermoplasma volcanium GSS1
MRDIEEILHEMGLSKDDYELYGRYMAKLSLNLQEVNKKKAKLILVTAMTPTAAGEGKTTTTIGLGQAFKKLGKNVAIAIREPSLGPCFGIKGGATGGGKSKVEPSDRINLLFTGDFPAISAAHNLLSAMINNHIYHGNELNLDPKRITFPRTIDMNDRSLRSIVVGVGPRDMGAIANDNFVITPASEVMAITGLSLNYKDLKEKLSRILAGFTVKNKPVFAADLKAEGSMAALLRDALKPNLVQTTEGVPAFVHTGPFGNIAHGTSSIVADRIAMNLFDYVITEAGFGSDLGAEKFFNIVSRIGNLPINAVVLVATIRALKLHGGSKKQGEDVEAVKEGSKNLLRHVANIRKFGVEPVVALNKFPTDTENEIMAIGEILDSHGIKWALSEVFEKGGEGGIELANKVLSSIGDYQIKRTYEVREDLKTKIEKIAVNVYGADGVIFEKKALNDLKKAEEIMNDPYVCMAKTQYSFSDDASLLNDPHGFKVRVQSVNISSGAGFVVPILGEIMTMPGLPKRPAAENIDLAEDGEITGLF

SEQ ID NO: 32280 - protein, 114 aa, Triticum aestivum
GELGTSHAPGRHGRGSVAEVIDKVDKGGLDKMTLVEVGPRYCLNPIKIFGGSFGGPTLYENPFYVSPNQIRALEKRKKAGKYAKKVKAKVRRKMHEMENTLEPDEFTDLWKGED

SEQ ID NO: 32281 - protein, 198 aa, Triticum aestivum
  misc_feature (114)..(114): Xaa can be any naturally occurring amino acid
MGNASSMLTQYDIEEVQEHCSYLFSQQEIVSLYERFCQLDRSAKGFVSEDEFLSIPEFSTNPLSKRLLRMVDGLNFKEFVSFLSTFSARASLQPKIEFIFKVYDLDGQGKVSFXDLVEVLRDLTGSSMSEQQREQVLTKVLEEAGYTRDSTLALEPQFLSQTLLHTSTKANFKLENRQGTPSRVSVGFSLSLDRGDLS

SEQ ID NO: 32282 - protein, 413 aa, Coccidioides immitis RS
MPFAAPRSLLSASIASRRIFKIPLGFVLQNTKAIPIPQAPKRFPPLTLPSAVPYRGLATQSTGPTDKMKALVYAGNGKVALEERPKPTLSSPTDAIVKLKYGTICGTDLHIIKGDVPTATPGRILGHEGVGIIEEVGSNVTGLSKGDTVLIACITACGSCSFCRKGMSSHCSHGGWILGNTIDGTQAEYVRIPCAMSSLYKLPPTVDLAEAVMLSDALPTGFECGTLNSKVRPGSSVAIVGAGPVGLAAMKTAQLYSPAKLVLVDLDDSRLQVGQKLGATHGVNPKGQDGIKRLLDLTPNGQGFDAVMEAVGIPATFQLCQEIVGPGGVIANIGVHGTKVDLHLEKLWSQNISITTRLVDATTIPELLTLFEAKTLNVSDFITHRYKFADCVKAYDTFKAAAQHQALKVSLEF

SEQ ID NO: 32283 - protein, 310 aa, Arabidopsis thaliana
MSETEFKVLLETFTFPADSAPFKSCHASTIVEVVKDHFLAAYFGGTREGAPDVKIWLQHFKDGQWDSPVIVDEEPGVPMYNPVLFKLPSHELLLFYKIGQEVQKWSGCMKRSYDKGITWTEREQLPPGILGPIKNKPILLEGGTLLCGSSVESWNSWGAWMEVTSDAGRTWRKKGPIYIQGKSLSVIQPVPYQTAAGNLRILLRSFTGIDRICISESLDGGENWSFAVPTVLPNPNSGIDGVKLKDGRLVLAYNTDSRGVLKLGVSLDDGDSWTDILTLEESPGMEYSYPAVIQAGDGNVHVTYTYNRTN

SEQ ID NO: 32284 - protein, 312 aa, Pseudomonas syringae pv. phaseolicola 1448A
MFLVCGEALFDIFTRADDSGSLNRLGFDAIAGGSPFNVAIGLRRLGVEAGFFAGLSTDYLGRRLRAVLEKETVNTDHLIEFDAPTTLAMVAVGSDGSPTYSFRGDGCADRQLRLEHLPELDAQVRGIHVGSFSLVVQPIADTLLALVARESATRLISLDPNVRLNPAPDIQRWRSQVAAFAEHAHLIKVSDEDLHLLYPDSDPQKIAEGWLGKRTQLVIVTRGTQGASVFTRQHGTWSVPAKTVVTADTVGAGDTFQAALLTFLSERQLDTPQGLSTLSRETLDEMLNFAVGAAALTCTKVGPDLPYRHQLG

SEQ ID NO: 32285 - protein, 228 aa, Triticum aestivum
TPSVFEQLVRAAGYSQIRNIVFMGMGEPLNNYTALVEAIQVLTGFPFQISPKRVTVSTVGIIHSINKFNNDLPNINLAVSLHAPDQDIRCHIMPAARAFPLAKLMNALQSYQNASKQTIFIEYIMLDGVNDQEEHAHKLGKLLENFKAVVNLIPFNPIGSASTFKTSSDQSIKKFQKVLRGIYSIRTTVRQEMGQDIAGACGQLVVSLPDERSAGGATLLSDIEDLRI

SEQ ID NO: 32286 - protein, 465 aa, Chlamydia trachomatis D/UW-3/CX
MNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGRGSLISSTEVKILGENPSVIKAHSIILATGSEPRAFPGIPFSAESPRILCSTGVLNLKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIAGHKEEIDYSAVPSVIFTFPEVASVGLSPTAAQQQKIPVKVTKFPFRAIGKAVAMGEADGFAAIISHETTQQILGAYVIGPHASSLISEITLAVRNELTLPCIYETIHAHPTLAEVWAESALLAVDTPLHMPPAKK

SEQ ID NO: 32287 - protein, 226 aa, Triticum aestivum
MARDLHHLLLLAALLQQLSATSAGDVATGSGGEKVHVAIYYESLCPYSARFVTNHLLKAYRDGLLDAADLTLVPYGNAKVDAHGAITCQHGPDECLLNTVQACAIDAWPDVKVHLGFIYCVSDLVMKNRHREWESCFQKQGLDPKPVTECYKGERGHNLSLEYGRQTAELVPPHQFVPWVVVDGKPLYNDYGKFEAYICKAYKGYPLLEACRSPGMEAENDVYGRL

SEQ ID NO: 32288 - protein, 140 aa, Novosphingobium aromaticivorans DSM 12444
MAVTRTFSIIKPDATRRNLTGAVTKMLEEAGLRVVASKRIHMSREQAEGFYAVHKERPFFGELVEFMISGPVVVQVLEGEDAVKRNRDIMGATNPKDAAPGTIRKELAESIEANSVHGSDSEENAAIEIAYFFKPEEIVG

SEQ ID NO: 32289 - protein, 129 aa, Brassica napus
MGDLLDWIISFLFLVTLLIIVIYQLTCLADLEADHINPYDSSTKINRVILPEFCLQGLLCVYYVLTGHWFMAILSLPHLFYNIRLYMKKEHLADVTEMHNTNKGEHEKRLYKTRLHELGQYPLNIIGPG

SEQ ID NO: 32290 - protein, 331 aa, Triticum aestivum
  misc_feature (68)..(68): Xaa can be any naturally occurring amino acid
  misc_feature (194)..(194): Xaa can be any naturally occurring amino acid
  misc_feature (222)..(222): Xaa can be any naturally occurring amino acid
VTLQNKFVQKSRLVPVRNSRDIVDPRVRTREWRRRRPSPPPASPPPPRPRSTTTTRTTSSASAAPAAXAQRLVAMAGSGKFFVGGNWKCNGTKVSISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSXNLKVMACIGELLEEREAGKTFDVCFKQXMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 32291 - protein, 709 aa, Oryza sativa (japonica cultivar-group)
MAFLGWAVDIARDSGASSSVVLTCDGYGSALYFSPWDSVPLPATASPDDGFLLPRFPDVCVQRSQFTNHLAPANGTGGGGSRTGVKEEASEVLSWPPTSKQSVRRLEVAEHWYRLYKTDNQRLSPDSQQVSVLAESHCDLASGNWKEISIHHKKMPSSTTTKTTTPSRDAWIVSARSDPFHLLLEAQAPLGIKADALSQIAAVHQSHRNTSHIRELSLAMDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGELKRRLFEVSLSVLMETIAHTKATRPETDPDTDMSLEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 32292 - protein, 527 aa, Oryza sativa (japonica cultivar-group)
MDKAYIAVFSIAILFLLVDYFRCRRRRGSGSNNGENKGMLQLPPSPPAIPFFGHLHLIDKPLHAALSRLAERHGPVFSLRLGSRNAVVVSSPECARECFTDNDVCFANRPQFPSQMPATFYGAGFGFANYGAHWRNLRRIATVHLLSAHRVRGMAGVVSGEIRPHGAEDVPRRAAAGVGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNGVDGGDDGEKKSVISVLLSLQKTEPEVYKDIVIVNLCAALFAAGTETTAMTIEWAMSLLLNHPKILKKAKAEIDASVGNSRLINGDDMPHLSYLQCIINETLRLYPVAPLLIPHESSADCKVNGYHIPSGTMLLVNVIAIQRDPMVWKEPNEFKPERFENGESEGLFMIPFGMGRRKCPGETMALQTIGLVLGALIQCFDWDRVDGAEVDMTQGSGLTNPRAVPLEAMCKPREAMSDVFRELL

SEQ ID NO: 32293 - protein, 401 aa, Glycine max
  misc_feature (13)..(13): Xaa can be any naturally occurring amino acid
  misc_feature (26)..(26): Xaa can be any naturally occurring amino acid
  misc_feature (152)..(152): Xaa can be any naturally occurring amino acid
  misc_feature (232)..(232): Xaa can be any naturally occurring amino acid
  misc_feature (305)..(305): Xaa can be any naturally occurring amino acid
RGSKILACAASNXAVDNIVERLVPHXLVRLGHPARLLPQVLDSALDAQVLRGDNSGLANDIRKEMKALNGKLLKTKDRNTRKDIQRELRTLSKEERKRQQLAVTDVLKSADVILTTLIGAFSKKLDSTSFDLVIIDEAAQALEIACWIPILXGDHLQLPPTIQSVEAEKKGLGRTLFERLAEMYGDEITSMLTIQYRMHELIMDWSSKELYNSKIKAHPSVTAHMLYDLEGXGRGQIPTDPTLLLIDTAGCDMEEKKDEEDSTFYEGEAEVTVTHAKRLVQSGVLPSDIGIITPYAAQVVLLKMXKNKEDQLKDVEISTVDGFQGREKEAIIISMVRSNSKKEVGFLSDRRRMNVAVTRSRRQCCLVCDTETVSGDGFLKRLIEYFEEHGEYLSASEYQNE

SEQ ID NO: 32294 - protein, 436 aa, Thermoplasma volcanium GSS1
MYDAVVLGAGPGGYAAAIRLGQRKKKVAIIEKDKIGGECLNYGCIPSKAIIELANSINYLKEMPGVSINYNVDMKKWQEWKWSMINKLTGGVELLLKAYGVDIFRGTGYIQDKNHVKVNDKVLETDSLVIATGSKPVSINGINDVMYNREVLDLDHIPSSIVIIGGGYIGVEIGIALAKLGSKVTIVEMMPSILPGTDNELVRHVVRRMSQLGINVITGRKVLSTAKNGEVTVKLDDGQELRAEKVLMTVGRIPNTEGFGLENLKLAMDGRFIKTDSRKMTSVKGVYAIGDVSGQPMLAHKAYYEADIAADNICGIDSEVDYRAMPYVIYSDPEIAYTGVKGAKSTRFPVAANGRSLTMNENIGTFNIYYDEKGIVTGAGIAAPHASELISEISLAVESGLMAMDIGLTIHPHPTVSEGVKESAEEVYGKPLHFKL

SEQ ID NO: 32295 - protein, 402 aa, Thermoplasma volcanium GSS1
MFLYEFKLPDIGEGVTEGEIVKWDVAEGDEVKKDQDLVEVMTDKVTVKIPSPVNGKISKILYKEGQVVPVGSTLVQIDTGEETSQQTMAEEHAELKPQTTAAQQIAIETVPAGKVLASPAVRRIARENGIDLAKVKGTGDNGRVTLDDLDAYMRGETKAKAPEKPIEAAKPAEVPPVQRSPGREEILEMHGLRRIIFDKMTKAKQIMPHFTVVEKVDVTGMISIIESAKSSGKKVTITGYIARIVPIVLKQYPYLNAIYDEANRRYLIKKYYNIGIAVDTPDGLNVFVVKDADRKSMYEITAEITDKAERARNNQLKIDEVQDSTFTITNVGTIGGVLSTPIINYPEVAILGVHRVMDENGKKIMYLSLSCDHRLIDGAVATRFIMDLKKIIEDPNSLIYEM

SEQ ID NO: 32296 - protein, 319 aa, Thermoplasma volcanium GSS1
MNIVQALNNAMDIKMAEDNDVVVLGEDVGKDGGVFRVTDGLLAKYGPERVIDTPLTELGIVGMAIGMAVNGLKPIPEIQFQDFIYTAMDQIINQMAKIRYRSGGDYTVPLVLRTPVGGGIKGGLYHSQSGETYFAHTAGLTVVSPSNPYDAKGLLISSIESPDPVIFLEPKRLYRSQKADVPEDKYTVPLRKANLLREGNSVTLVTYGSMVPTVLSTVDKNGIDADVVDLRTIAPLDKDTIISSVKKTGRVVIVHEAPRTLGVGAEVSAMISERAIEYLYAPILRITGPDTPFPYRLEDYYLPNEQRIMAAIKKVMEYR

SEQ ID NO: 32297 - protein, 371 aa, Glycine max
  misc_feature (261)..(261): Xaa can be any naturally occurring amino acid
MGVVNRRNSAAHTSNQNKTTSIQLPLGIFGTVLAVLFIGFVAWSYQTIQPPPPKICGSLNGPTITAPRIKLRDGRNLAYKEHGVPKDVAKHKIIFVHGFDACRHDAYVAKTLSPDVAEVLGVYIVSFDRPGYGESDPHPNQTVKSLALDIEELTDKLGLGSKFYIIGFSLGGQVVWRCLKYIPHRLAGAVLIAPVLNYWWAGLPANLTNEVFYQQKLQDQWTVRVAHYIPWLTYWWNTQKWFPSSSLIADSIDLLSLQDKXELLPKRSDRKNHVAQVRQQGEHETVHRDLILAFGSWEFSPLDLENPFPNNEGSVHIWQGDEDLIVPVKVQRYIAQKLPWIQYHELQGAGHLFPHVDGMSDTIIKSLLSGK

SEQ ID NO: 32298 - protein, 407 aa, Arabidopsis thaliana
MAETLEPSLVGEIDTSAPFESVREAATHFGGFGFWKPSSLNISEASQNEVGMVLKASELEKELIEKEGETLKVLKSLESTKAIVEELKSKIQNKEDKENCDMNVFKELNQAKMNLCKTTKDLAAIRVSVGLLNKRLEEERAALEKTRERLNSENAAEMSMEIQRLSYEAKEFSRTGENVRYAVNKAVAEIEQTRNKIEAAEMRLIAARKMKEAARAAEAVAIAEIKAVTRRGRRRRRGGNGEETMQEEILETIDETAREIRSSRRTLEEGLAKMEAEEGNWWWTEQRRISSCSAKFKNPPYMMDVKGLNMMMNGDGTSSSVAVLKPTMSIGQILSRKLLLADESAMMMNGRVSLGQILGKTNFGDREKEKRFNGKRKRFGFANLSVMLNKESKKKNKKKKIALNLSC

SEQ ID NO: 32299 - protein, 436 aa, Oryza sativa
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGAGDYSNPFDLFESLLEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLVRVQVEIPKRLSSDERKLIEELAN

SEQ ID NO: 32300 - protein, 473 aa, Coccidioides immitis RS
MALAARASRQALRAAKASSSRTVAGSSRSYASAAESELKSVFRSVLPAKRALLKELKEHNDAKIGDVTVANAIGGMRGLKAMIWEGSVLDPEEGIRFHGHTIKDCQQMLPKGTSGTEMLPEAMFWLLLTGQVPTTPQIRAFSRELAEKSHLPKHILDMIKSFPKDMHPMTQLSVAVAALNTESTFAKKYAEGLNKADYWEPTFDDSISLLAKIPRVAALVFRPNEVDTVGTQQLDSTQDWAYNFAVLLGKGGKEHESFHDVLRLYLALHGDHEGGNVSAHATHLVGSALSDPFLSYSAGLLGLAGPLHGLAAQEVLRWILNMRAKIGDNFTEKDVKDYLWSTLKSGQVVPGYGHGVLRKPDPRFEALMDFASTRPEIMNNPVFKLVKKNSEIAPGVLTEHGKTKNPHPNVDAASGVLFHHYGFQEPLYYTVTFGVSRALGPLAQLIWSRALGLPIERPKSINMQGLLNSVKKN

SEQ ID NO: 32301 - protein, 262 aa, Oryza sativa
  misc_feature (202)..(202): Xaa can be any naturally occurring amino acid
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPXLLANKDFEGAVVSRTPLRRVGEPEEVSSLVAFLCMPGSSYITGQTISVDGGMTINGLYPS

SEQ ID NO: 32302 - protein, 358 aa, Triticum aestivum
  misc_feature (74)..(74): Xaa can be any naturally occurring amino acid
  misc_feature (226)..(226): Xaa can be any naturally occurring amino acid
  misc_feature (232)..(232): Xaa can be any naturally occurring amino acid
  misc_feature (263)..(263): Xaa can be any naturally occurring amino acid
MAASDETPMVQDLASTGVEEPPSRYLVHEQDRHGDLLAAGEMPEPIPLIDLSRLMDADEADKLRAALQTWGFFXLATNHGIEDSLMDAMMSASREFFRQPSEEKQKCSNLVDGNGKHYQVEGYGSDKVVSEDHGLNWNDRLHLRVEPEDERNFAKWPSQPESFRDVLHEYASKTKKLRDLVLRSIAKLLDIDEDYFVNQISNKASGFARLYYYPPCPRPDLVLGLXPHSDGXNLLTILFCRRTMLGGLTRFQRDGENGTNVPXAKPHTLVINLGDCLEIMNNGIFRSPVHRVVTNTEKERLSLAMFYAVDEETVLEPAPGLLDDKRPPRYRKMLTKDFVAGLFEHFRQGKRFIDTLKI

SEQ ID NO: 32303 - protein, 197 aa, Nocardia farcinica IFM 10152
MPMTKLTRAAAVLALALLTFLAPGPLTAPQAHADALPRVYLDLTIGGAPAGRVVIELRSDVVPRTAENFRALATGEQGFGYRGSTLHRVIPGFMAQGGDFTHGDGTGGHSIYGPVFADENFQLPHAGPGVVSMANRGPGTNGSQFFITLDATPWLDGKHVVFGTVVEGMDVVQAVAATGSDTGATTQPVVVADSGQL

SEQ ID NO: 32304 - protein, 672 aa, Rhodobacter capsulatus
MDLAALRAKTPDHWKLATAIRVLAIDAVQAANSGHPGMPMGMADVATVLFRNHLKFDAKAPNWADRDRFVLSAGHGSMLLYALLHLTGYEQATLDEVKNFRQWGARMAGHPEYGHLEGVETTTGPLGQGISTAVGMAIAEKSMAARFGKKLVDHKIWVIAGDGCLMEGISQEAIGLAGKQELDNLIVLWDNNNITIDGRVTVSDVTDQKARFAASGWDVLSCDGHDAEDIDRALTAAKKAKRPVLVDCKTLIGFGSPNKADSYAVHGAPLGDAEIKLTREAYGWEHGPFVIPAEIKAEWEAIGAKGAAERAEWEARLAALPAGKRAEFERQMARGVAPKLAGAIRAFKKAQSEAAPKVATRKASEMVLAAVNPVVLRNHRRLADLTGSNLTKTSDIEDFMPGNHKGRYMRYGIREHAMAAAMNGMWLHGGVRPYGGTFFCFTDYARGAMRLSSLMGVPTVYVMTHDSIGLGEDGPTHQPVEHLTICRATPNTWTFRPADVIETAEAWELALSSERTPSVLALSRQNLPTLRTKHEAKNLTAKGAYVIAEAEGKRQAILMATGSEVEIALKARALLQAEAIGTRVVSMPCMELFAAQDEAYRKRILPAGGVRVAVEAAIRQPWDRWLLGERGMERKAGFVGMEGFGASAPAERLYAEFGITPEAIAAKVKSLL

SEQ ID NO: 32305 - protein, 850 aa, Brassica oleracea
MRIFRKTLVSFPLFIFLFLYESSTAQDTIRRGGFLRDGSTHKPLVSPQKTFELGFFSPGSSPGRYLGIWYGNIEDKAVVWVANRENPISDRSGVLTISNDGNLVLLNGQNITVWSSNITSTNNDNNRVGSILDTGNFELIEVSSERVIWESFNHPTDTFLPHMRVRVNPQTGDNLAFVSWRSENDPSPGNFSLGVDPSGAPEIVLWGRNNTRRWRSGQWNSAIFTGIPNMALLTNYLYGFKLSSPPDETGSVYFTYVPSDPSVLLRFKVLHNGTEEELRWNETSKRWTKFQAAPESECDKYNRCGSFGICDMRGDNGICSCVKGYEPVSLGNWSRGCRRRTPLRCERNVSNVGEDEFLTLKSVKLPDFETPEHSLADPEDCKDRCLKNCSCTAFTFVNGIGCMIWNQDLVDLQQFEAGGSSLHVRLADSEIGESKKTKIVVIVAVLVGVLLLGIFALLLWRFKRKKDVSGTYCGHDADTSVVVVDMTKAKDTTTAFTGSVDIMIEGKAVNTSELPVFCLKVIVKATNDFSRENELGRGGFGPVYKGVLEDGQEIAVKRLSGKSGQGVDEFKNEIILIAKLQHRNLVRLLGCCFEGEEKMLVYEYMPNKSLDFFIFDEMKQELVDWKLRFAIIEGIARGLLYLHRDSRLRIIHRDLKVSNVLLDGEMNPKISDFGMARIFGGNQNEANTVRVVGTYGYMSPEYAMEGLFSVKSDVYSFGVLLLEIISGKRNTSLRASEHGSLIGYAWFLYTHGRSEELVDPKIRATCNKREALRCIHVAMLCVQDSAAERPNMAAVLLMLESDTATLPVPRQPTFTTSTRRNSMDVNFALDSSQQYIVSSNEITSTVVLGR

SEQ ID NO: 32306 - protein, 144 aa, Vibrio fischeri ES114
MTIERTFSIVKPDAVKRNLIGAIYRRIEKTGMQIVAAKMLRLTKEQAEGFYAEHEGKEFFDELVAYMMSGPVMVQVLEGENAVVRYRELMGKTNPEEAACGSLRADYAISMRYNSVHGADSPESAAREIAYFFAEDEICPRPAE

SEQ ID NO: 32307 - protein, 372 aa, Vibrio fischeri ES114
MTTAKINLLDFDRKGLRAFFSEELGEKAFRADQVMKWMYHFGCDDFDQMNNINKKLREKLKHKCEIRAPYVSEAQHSSDGTIKWAMKVGDQDVETVYIPDGDRATLCVSSQVGCALECKFCSTAQQGFNRNLKVSEIVGQIWRAAREIGLEKETGRRPITNVVMMGMGEPLLNMKNLIPALEIMLDDLGFALSKRRVTVSTSGVVSGLDQMTGKIDVALAISLHAPTDELRSQIMPINDRWDIDAFLASVRRYIASSNANRGRVTVEYVLLDHVNDDMDHARQLAELLKDTPAKINLIPFNPYPGSPYKKPSNSRIDRFMKTLMEYDYTVTIRKTRGDDIDAACGQLVGDVIDRTKRTKVKQQGEAIPVKTV

SEQ ID NO: 32308 - protein, 585 aa, Desulfovibrio desulfuricans G20
MPNQPEQQQTAMMTSENSTGFPWLTHYDEGVQPSIEYKKHALFAFLDEAAAEHPRRTAIIFRNYRLNYRKLNELVEIVAANLRAQGLRDGDRVSIMLPNLPQTVIAFWAVLKAGGVVVMTNPLYMEKELVHQIHDSGARFMITLDLVWPKISELRDKLGIEKIFVTKISEALRFPLNILYDFKSRREGTAKQVPFDNETLLPWKVLLKGKERFCTRIDDPAERLALLQYTGGTTGIAKGVMLTHHNISVNVQQCCAMLQELVHQKHTFMGLLPYFHVYGLTTCLIFPTSLAATIIPFPRYVPKDVLDGIAKHKPTIFPGAPSVYISLMQQKDVAKYDLTSIDYCIAGSAPMPVEQMKRFKKLTGAAIIEGFGLTEASPITHLNPIRGLNKPGSIGVPFPDTEARIVDMEVGSVPLPPGKIGELIIKGPQVMQGYWNRPDETAGTLRNGWLYTGDIATMDEDGYFFIVDRKKDMFIVGGYNVYPREIDEVLYEHPKVKEAVSVGVPHATRGEIIKAYVVPKSGETLTKNEVISHCRAKLANYKVPRQVEFREELPKTIVGKVLRRALRAEEEEKLRKKKNTKSDDQ

SEQ ID NO: 32309 - protein, 404 aa, Arabidopsis thaliana
MTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNAKKETLVKGLKEVGFTVFPSSGTYFVVADHTPFGMENDVAFCEYLIEEVGVVAIPTSVFYLNPEEGKNLVRFAFCKDEETLRGAIERMKQKLKRKVLSLN

SEQ ID NO: 32310 - protein, 463 aa, Burkholderia thailandensis E264
MKGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGIGAVLAAMLTTMFSFLGTEIVTIAAAESEHPERQIVRATNSVIWRISLFYLGSIFVVAALVPWNDALLPAHGSYQRAMELIGVPHAKAIIDVIVLVSVASCLNSALYTASRMIFSLSRRGDAPALLRRTDASGTPRAAVLASTAFGFITVIANYVMPEQVFGFLLATSGAIALLVYLVIAISQLRMRKMLDATGERLQLRMWCFPWITWAVILFICGVLTVMLVSEAHRMEVGATAVLALIVLAASWLNKRGRDAQASVGRRVSAT

SEQ ID NO: 32311 - protein, 132 aa, Leifsonia xyli subsp. xyli str. CTCB07
MKLVNRMDAMTERQDERSVFTRIIAGEIPADVVYDGERLIAFKDIAPQAPVHLLVVPKTDQYRDVVELAAGDPELLAELVATARSLAAEHADGDFRLIFNTGANAGQTVFHVHAHVLSTPAGGLEEGSLADE

SEQ ID NO: 32312 - protein, 369 aa, Leifsonia xyli subsp. xyli str. CTCB07
MADHYEVLGVERNATPDEIKKAYRRLARELHPDVNPSTEAQERFKLVTHAYDVLSDPQQRQQYDRGGASGFGGGGGADFSGFGDIFETFFGGGGASRGPRSRRERGQDALLRVEVDLDEVVFGAHRDLEVDTAIVCETCDGSCCQPGTAPVPCDICHGTGSIQRSVRSLLGNVMTSSPCGSCRGYGTVIATPCVTCQGQGRVRARRTVPVDIPAGVDTGLRLQMPGSGEAGPAGGPNGDLYLEIKVKHHDVFSRDGDDLLCTLEVSMADAILGAAATIKALDGDIRLELKPGTQSADIVSVKDRGITHLRCSGRGDLRVGIQVVTPTKLDHREKELIKKFAESHKASEPSLARFQQGLFAKLRDRFLNV

SEQ ID NO: 32313 - protein, 616 aa, Leifsonia xyli subsp. xyli str. CTCB07
MSPRALKVLEPAATDPALIRNFCIIAHIDHGKSTLADRMLQITGVVAERDMRAQYLDRMDIERERGITIKSQAVRMPWGFDGDFYALNMIDTPGHVDFTYEVSRSLAACEGAILLVDAAQGIEAQTLANLYLALENDLTVIPVLNKIDLPAADPDKYAAELAGLIGGKPGDVLRVSGKTGVGVDDLLDRVVQEIPAPVGAADAPARAMIFDSVYDSYRGVVTYVRMMDGRLGPRERIQMMSTRATHEILEIGVSSPEPTASKGLAVGEVGYLITGVKDVRQSKVGDTVTSAAKPAVDPLPGYTEPKPMVFSGLYPIDGSDYPELREALDKLKLSDAALVYEPETSVALGFGFRCGFLGLLHLEIITERLSREFGLDLITTAPSVIYEVTTEDRNVITVTNPSEYPAGKIERVEEPIVKAAILAPKDYVGVIMELCQSRRGTFLGMEYLGEDRVEIRYTMPLGEIVFDFFDNLKSSTAGYASLDYEPAGEQEADLVKVDILLQGEQVDAFSAIVHREKAYAYGTMMAGRLRELIPRQQFEVPIQAAIGARIIARENIRAIRKDVLAKCYGGDITRKRKLLEKQKEGKKRMKMVGRVEVPQEAFIAALSGEVGKKGKK

SEQ ID NO: 32314 - protein, 276 aa, Corynebacterium efficiens YS-314
MTDKPTHRAAVLGQPIGHSRSPVLHNAGYAALGLDDWAYDRFDCDADALPGLVGGADLSYRGFSVTMPAKFAALAFADEATERARRIGSANTLVRTATGWRADNTDVDGIRGALVELLGGGELVDKRAVVVGGGGTARPAIWALLEAGVSHITVINRSDRTGELSELVDAFPATLSYLPLEGGVEAETTAAAVVISTVPSAAIEGLEGKLAHAPVLDVIYDPWPTPLVTVARSRNIPAVGGHVMLAHQAYGQFEQFTGHPAPRDAMRAALEASLGM

SEQ ID NO: 32315 - protein, 433 aa, Aeromonas hydrophila [sequence omitted]

SEQ ID NO: 32316 - protein, 302 aa, Nocardia farcinica IFM 10152
MTNGESTPTELRASGTVGVAMVTPFSADGKLDVDAGVSLAAHLVDRGVDLLAISGTTGESPTTTESEKFDLLHAVVDAVGDRATVIAGAGTYDTAHSIELARNAERAGAHGLLVVTPYYSRPSQDGLYAHFTAVADATDLPVTLYDIPPRSIIPIGPETLRRLADHPRIVAVKDAKGDLNSGADIIAHTSLDYYSGDDCLNLPWLSIGAVGFISVIGHLVPERLREMYDAFVAGDVVRAREINASLVPLNAAMARLGGVSMTKAGLRLLGIDVGEPRLPQLMPNTAQLDQLSADLRTAGVLV

SEQ ID NO: 32317 - protein, 175 aa, Brassica napus
  misc_feature (106)..(106): Xaa can be any naturally occurring amino acid
  misc_feature (159)..(159): Xaa can be any naturally occurring amino acid
VFLPFRHSLPYLIPPQLSSTIHFALVAVSYNALAQSLQARSNCFVPKDLCIKQRSSRCRTSVVVFAASDDNNIALQAKVDKLLDGIKWDDKGLAVVIAQSVDTGAXLMQGFANRDALSTTITSRKATFFSRSRSALWTKGETSNNFINVLDVYLDCDRXSIIYLGTPDGPTCHTG

SEQ ID NO: 32318 - protein, 562 aa, Aspergillus nidulans FGSC A4
MGVDIKGLFKPKAEQQEHSQATTPSRTDSIAEKDNGIIDDSPVKYLTWRSFILGIVVSMGGFIFGYSTGQISGFTTMADFKKRFAERQANGEYVFSNVRNGLIVGLLCIGTMIGALVAAPIADRIGRKLSMSFWSIIHIVGIIIQIATDSNWVQIAMGRWVAGLGVGALSSVVPMYQSEAAPRQVRGAMISAFQLFVAFGIFISYIINYGTESIQSTASWRITMGIGFAWPLILGLGALFLPESPRYAYRLGRIDEARKVMAKLYGVEVNHRVVVQEMKDMKDKLEEERAAGVAPWHEVVTGPRMLYRTLLGIALQSLQQLSGANFIFYYGNSIFTSTGLNNSYVTQIILGAVNFGMTLPGLYIVEHFGRRASLMVGGAWMAICFYIWASVGNSVLDLDNPQNTPKAGAAMIVFTCFFIAGFATTWGPIVWSICSEMYPNRSRATSIGIATCANWTWNFLISFFTPFISGSIHFAYGYVFASCCVVGVLIVFFFVNETQGRTLEEVDTMYVLHVVPWKSASWVPDESIVRDLHPGSDANKTEGLGQAEHGEESRPEPVEIRE

SEQ ID NO: 32319 - protein, 399 aa, Triticum aestivum
MMTQLQATPLRTLALSRRRGAGAAARPMAGSVRCSAAARSYSITLLPGDGIGPEVVAVAKDVLSVAGSKEGVELRFQEMLMGGAALDAAGVPLPDETLAAARASDAILLGAIGGYKWDNNEKHLKPETGLLNIRAGLGVFANLRPATVLPQLVDASTLKKEVAEGVDIMVVRELTGGIYFGKPRGFGTNDKGEETGFNTEIYSVAEIDRIARVAFEVARKRGGKLCSVDKANVLEASMLWRKRVTAIASEFPDVELSHMYVDNAAMQLVRNPKQFDTIVTNNIFGDILSDEASMITGSIGMLPSASVGESGPGLFEPIHGSAPDIAGQDKANPLATILSAAMLLKYGLGVESAAKRIEAAVTETLDNGFRTGDIYSPGTTLVGCKRMGEEVLKALESQK

SEQ ID NO: 32320 - protein, 517 aa, Vibrio fischeri ES114
MTTNIHDQRILILDFGSQYTQLVARRIREIGVYCELWSWDVEESDIRDFNPDGIILSGGPESVTEENSPRAPQYVFDSGVPVFGVCYGMQTMAEQLGGKVATSTEREFGYAAVQVTGESALFKDLEATQDVWMSHGDKVVEIPSDFVKIAETETCPYAAMANEEKKYYGVQFHPEVTHTKNGMKMLENFVLNVCGCEGLWTSASIIEDAVARIKEQVGDDEVILGLSGGVDSSVVAMLAHRAIGDKLTCVFVDNGLLRLNEADQVMEMFGNKFGLNIVHVNAEQRFLDALEGESDPETKRKIIGHVFVDIFDEESKKLKNAKWLAQGTIYPDVIESAASKTGKAHVIKSHHNVGGLPDDMEMGLVEPLRELFKDEVRKIGLELGLPYNMLYRHPFPGPGLGVRVLGEIKKEYCDLLRRADAIFIEELHNADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 32321 - protein, 539 aa, Oryza sativa
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKPYFFSVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 32322 - protein, 126 aa, Vibrio fischeri ES114
MKEIIVAASAPEAIGPYSHGTQFNGLIFTSGQLPVDGSTSKVVEGGITEQSQMSLQNLIAVIEAGGGDVNTVLKTTCYLANITDFAAFNEVYKTVFKTDCPARSCFAVKDLPLGVLVEVEAIAHQK

SEQ ID NO: 32323 - protein, 670 aa, Oryza sativa
  misc_feature (208)..(208): Xaa can be any naturally occurring amino acid
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPXMATATCRSCLGGIVGMMPKYFSGKQGGRVLGLRCNYRYEIYPFFDGVSLLQLPAASLGAPPAPSPAAVNVTPPATTTGTRRRGNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMVNVMLSSSTVSLQAPSRPAFCIQKSSVNSDSYSEPFRGANQSTV

SEQ ID NO: 32324 - protein, 460 aa, Thermoplasma volcanium GSS1
MGYYDDMRHDDLNYEYLYGSTYPLMKNAGSSVAKVIEKNFASGQKVCVVCGTGNNAGDAIVAAELLRTKFEVTVLLVNGLKSELAKKALQEYGGNVVDASHIDECLAADIIIDGIFGVGISGEPKEPYKSTIEKINASGKKIVSVDVPSGLGTNCAVRPDITVTFTSLKYGMNKENSGEIIVADIGIPDDVRKYAGPGDLIYYPRPDPDSHKGMNGTLGIVAGWEYHGSSVIAALAAENLGLDLVRIYVTNKNYEIVSSYDPGIIVRLFDYKRQASYEEVWRNSALLIGPGLGTSHEAEIALKRLVNGSAVPIVIDADGITLLSKHLSIIKGKKIVVTPHKNEFRKLTGTEPNEENAVEFAKEKGIIIVLKGKVDIITDGKEVHYAKGGNARMTMGGTGDLLAGLISSFISKGIDPMRSCLMGTYLNKRIGELAYDKKGLFYKITDMIDEIPSVMASYVR

SEQ ID NO: 32325 - protein, 227 aa, Triticum aestivum
SARRPMEPGLARRLWHVVLAVCHMLRRGLCRKRLMMDLHLLLGRGKLAGRALRGLLAQPATAHGHGHRISSSSTSAMASFYGHHARAVEFSCTTTPSYPQYYGLFPFKSRGGRSGGGRGTARDDYGGLDAAAVARAFEMMSADVESGRATPAVAGMATATPSPMVAWILGRSPAGVRRLRVTDSPFPVVPEDGNSGSNERVDAEADDFIRRFYEQLRIQHSIAIPEC

SEQ ID NO: 32326 - protein, 552 aa, Pseudomonas syringae pv. phaseolicola 1448A
MYVYDDYDQKIIEDRVKQFRDQTRRYLAGELSEEEFRPLRLQNGLYVQRFAPMLRVAVPYGQLTSRQARMMAKIARDYDKGYAHISTRQNVQFNWPALEDVPDILAELATVQMHAIQTSGNCLRNVTTDQFAGVAADELVDPRPWCEIVRQWTTFHPEFAYLPRKFKIAINGSTSDRAAIEVHDIGLEPLCNEAGELGFRVLVGGGLGRTPVVGAFINEFLPWQDLLSYLDAILRVYNRYGRRDNKYKARIKILVKALTPEVFAAKVDAEMAHLRGGQTTLTEAEVQRVSRHFVDPQYKALSDQHAELAALDAQHPGFARWRQRNVLAHKKPGYIAVTLSLKPTGVAPGDVTDKQLDAIADLADRYSFGQLRTSHEQNIILADVEQAELFTLWNELRDNGFATPNIGLLTDIICCPGGDFCSLANAKSIPIAESIQRRFDDLDYLFDIGELDLNISGCMNACGHHHVGHIGVLGVDKKGEEFYQVSLGGSASRDASLGKILGPSFAQEAMPDVIEKLIDVYVEKRTEDERFIDTYQRIGIDPFKERVYAANH

SEQ ID NO: 32327 - protein, 220 aa, Triticum aestivum
TRREFPSENPTPLQVCAKARPEVFDVVIFGASGFTGKYVIREALKFLPPNASPLRTLALAGRSRERVAAALSWAASPGPVPDVPILVADTSDPASLAVVTARARVLLSCAGPFRLHGRQVAAACAEAGAHCLDISGEPEFMERVEADLHEVAAKNGSLIVSACGFASTVADLGFLFHSRQGTPPSAPGSVVAYVNLESSDRKIVGNFATFESAVLGGANT

SEQ ID NO: 32328 - protein, 1011 aa, Mycobacterium tuberculosis CDC1551
MSFLLVEPDLVTAAAANLAGIRSALSEAAAAASTPTTALASAGADEVSAAVSRLFGAYGQQFQALNARAATFHAEFVSLLNGGAAAYTGAEAASVSSMQALLDAVNAPTQTLLGRPLIGNGADGVAGTGSNAGGNGGPGGILYGNGGNGGAGGNGGAAGLIGNGGAGGAGGAGGAGGAGGAGGTGGLLYGNGGAGGNGGSAAAAGGAGGNALLFGNGGNGGSGASGGAAGHAGTIFGNGGNAGAGSGLAGADGGLFGNGGDGGSSTSKAGGAGGNALFGNGGDGGSSTVAAGGAGGNTLVGNGGAGGAGGTSGLTGSGVAGGAGGSVGLWGSGGAGGDGGAATSLLGVGMNAGAGGAGGNAGLLYGNGGAGGAGGNGGDTTVPLFDSGVGGAGGAGGNASLFGNGGTGGVGGKGGTSSDLASATSGAGGAGGAGGVGGLLYGNGGNGGAGGIGGAAINILANAGAGGAGGAAGSSFIGNGGNGGAGGAGGAAALFSSGVGGAGGSGGTALLLGSGGAGGNGGTGGANSGSLFASPGGTGGAGGHGGAGGLIWGNGGAGGNGGNGGTTADGALEGGTGGIGGTGGSAIAFGNGGQGGAGGTGGDHSGGNGIGGKGGASGNGGNAGQVLGDGGTGGTGGAGGAGSGTKAGGTGSDGGHGGNATLIGNGGDGGAGGAGGAGSPAGAPGNGGTGGTGGVLFGQSGSSGPPGAAALAFPSLSSSVPILGPYEDLIANTVANLASIGNTWLADPAPFLQQYLANQFGYGQLTLTALTDATRDFAIGLAGIPPSLQSALQALAAGDVSGAVTDVLGAVVKVFVSGVDASDLSNILLLGPVGDLFPILSIPGAMSQNFTNVVMTVTDTTIAFSIDTTNLTGVMTFGLPLAMTLNAVGSPITTAIAFAESTTAFVSAVQAGNLQAAAAALVGAPANVANGFLNGEARLPLALPTSATGGIPVTVEVPVGGILAPLQPFQATAVIPVIGPVTVTLEGTPAGGIVPALVNYAPTQLAQAIAP

SEQ ID NO: 32329 - protein, 247 aa, Pseudomonas syringae pv. phaseolicola 1448A
MQTAAALRHAQRILVITGAGLSADSGLPTYRGVGGLYNGKTDEGLPIEMALSGPMLRRDPELCWKYIAELGKACLGGEPNVAHYAIAQLQRIKPECWVLTQNVDGYHRAAGSPPERLIEIHGQLSPLFCQSCGAEDPQLSEHLQRPLPPLCPACSGVMRPPVVLFQEMLPEKALETLYEQLAKGYDAVLSIGTTASFPYIHEPVIRTRVSGGFTAEINPQPTDHSAQMDVFLQCRAAHVMAELISHI

SEQ ID NO: 32330 - protein, 432 aa, Enterococcus hirae
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALAAILKSRGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKAA

SEQ ID NO: 32331 - protein, 295 aa, Brassica napus
SNYFFAKLPVHIGWRFMLGVGAIPSVCLAIGVLAMPESPRWLVLQGRLGDAFKVLDKTSNTKEEAISRLNDIKRAAGIPEDMTDDVIVVPNRKSAGKGVWKDLLVRPTPAVRHILIACLGIHFAQQASGIDAVVLYSPTIFQKAGLKSKNDQLLATVAVGIVKTLFIVVGTCVVDRFGRRALLLTSMGGMFLSLTALGTSLTVIDRNPGHTLKWAIVLSVTMVMTFVATFSIGAGPVTWVYCSEIFPVRLRAQGASLGVMLNRLMSGIIGMTFLSLSKGLTIGGAFLLFCRVAAA

SEQ ID NO: 32332 - protein, 377 aa, Striga asiatica
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNSPAMYVAIQAVLSLYASGRTTGIVLDSGDGVSHTVPIYEGYALPHAILRLDLAGRDLTDHLMKILTERGYSFTTTAEREIVRDIKEKLAYIALDYEQELETAKTSSAVEKNYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 32333 - protein, 382 aa, Vibrio fischeri ES114
MALDIKPGQTHIKSKAMVAWAAGEPLKMEEVDVQLPKAGEVLVRIVATGVCHTDLFTLSGDDPEGIFPSILGHEGGGIVEMVGEGVTGLEVGDHVIPLYTAECGECKFCKSGKTNLCQAVRETQGQGLMPDGTSRFSINGETIFHYMGCSTFSEYTVLPEISLAKVSKDAPLEEVCLLGCGVTTGMGAVLNTAKVEKGDTVAVFGLGGIGLSAIIGAKMAGASRIIGVDLNESKYELAKKLGATDCINPMNYDKPIQEVIVEMTDGGVDYSFECIGNVNVMRSALECCHKGWGESIIIGVAGAGQEISTRPFQLVTGRVWRGSAFGGVKGRTELPGIVDRYMQGEFALDDFITHTMGLADVNAAFDLMHEGKSIRTVLHMDK

SEQ ID NO: 32334 - protein, 377 aa, Striga asiatica
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDHLMKILTERGYSFTTTAEREIVRDIKEKLAYIALDYEQEMETAKTSSAVEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 32335 - protein, 616 aa, Arabidopsis thaliana
MAARINTSLHNALSFLKPFNTPLNTKPFSFRRNSFRFSKKLPYYSQFSSGKRALYCTSSSQESTVDEGETFVLTTPLYYVNAPPHMGSAYTTIAADSIARFQRLLGKKVIFITGTDEHGEKIATSAAANGRNPPEHCDLISQSYRTLWKDLDIAYDKFIRTTDPKHEAIVKEFYARVFANGDIYRADYEGLYCVNCEEYKDEKGLLENNCCPVHQMPCVARKEDNYFFALSKYQKPLEDILAQNPRFVQPSYRLNEVQSWIKSGLRDFSISRALVDWGIPVPDDDKQTIYVWFDALLGYISALTEDNKQQNLETAVSFGWPASLHLIGKDILRFHAVYWPAMLMSAGLELPKMVFGHGFLTKDGMKMGKSLGNTLEPFELVQKFGPDAVRYFFLREVEFGNDGDYSEDRFIKIVNAHLANTIGNLLNRTLGLLKKNCESTLVVDSTVAAEGVPLKDTVEKLVEKARTNYENLSLSSACEAVLEIGNAGNTYMDQRAPWFLFKQGGVSAEEAAKDLVIILEVMRVIAVALSPVAPCLSLRIYSQLGYTEDQFNSITWSDTKWGGLKGGQVMEQASPVFARIELNPEKEEDEKKPKVGKKTGKAKVKVVEQTPTVAEA

SEQ ID NO: 32336 - protein, 106 aa, Triticum aestivum
  misc_feature (71)..(71): Xaa can be any naturally occurring amino acid
MAEVAPVDQGKKEEEEFSTGPLSILMLSVKNNTQVLINCRNNKKLLGRVRAFDRHCNMVLENVREMWTEVXKTGKARKSSPGDQDRFISKMFLRGDSVIIVLRNPK

SEQ ID NO: 32337 - protein, 250 aa, Glycine max
MENGFPGEVLKAVFPLLDGKDLVFCMLVCRQWCEIAKDDYFWKCICSRKWPSICKQPPSDTNFQKLYLTFSKPRKTVHLPVPKLTFEDLVFYIDMWLEGSLIFSQAVSGCILRAGLQNTPGGIPDVLVAHLNAADCILMMEVKPKLTVPMGPAITVSVLAHRKDTNKMTCIINTSSFDYIDSNAARALAYEYLRFSPRHPFISDIRAWMSLLFLYKGTNSIEVFGIELDFCDAARSEPEILWLLDMLDWK

SEQ ID NO: 32338 - protein, 126 aa, Prochlorococcus marinus str. MIT 9312
MVSETTKTISVSNLIEEFENEQLKKELPEIYVGDTVKVGVRITEGNKERVQPYEGVVIAKRHGGIHQTITVRRIFQGIGVERVFMLHSPQVASLKVERRGKVRRAKLFYLRDRVGKATRVKQRFDR

SEQ ID NO: 32339 - protein, 668 aa, Bacteroides thetaiotaomicron
MKMGTNYLAILGVTTVTTVMSCTTAKKEYMSYELYPVRTGSLIEMEYTPEATKFTLWSPTADEVRLMLYEAGEGGHAYETVKMQSGEEGTWTAVVSKDLIGKFYTFNVKIDDKWQGDTPGINARAVGVNGKRAAIIDWQSTNPDGWESDTRPPLKSPADMIIYEMHHRDFSVDSTSGVKNKGKYLALTEHGTMNSDKLLTGIDHLIELGVTHVHLLPSFDYASVDETRLNENSYNWGYDPQNYNVPDGSYATDPYQPATRVKEFKQMVQALHKAGIRVIMDVVYNHTFNTDESNFERTVPGYFYRQKEDKTLANGSGCGNETASERLMMRKFMVESVLYWIKEYHVDGFRFDLMGIHDIETMNEIRKAVNAVDPTICIYGEGWAAEAPQYPADSLAMKGNIAQIPGVAVFSDELRDGLCGPVGDKRKGAFLAGIPGGEMSVKFGIAGAIEHPQVQCDSVNYTQKPWAKQPVQMISYVSCHDGLCLVDRLKASMPDITPEQLIRLDKLAQAVVFTSQGIPFIYAGEEIMRDKQGVDNSYKSPDAVNAIDWRRKTTSADVFMYYKRLIDLRKSHPAFRMGDAGQVRKHLEFLPVEGSNLIAFRLKDHANGDHWEDIIVAFNSRPTPARLTIPVGKYTVVCKGGVIDVRGLGIQNGPEVIIPSQSALILYK

SEQ ID NO: 32340 - protein, 538 aa, Streptomyces coelicolor A3(2)
MAATGTEKQGAKAYYVSTPIYYVNDAPHLGHAYTTVAGDVLTRWHRQRGEKVWYLTGTDEHGQKIMRTAEANGVTPQAWADKLVTESWKPLWEHLDIANDDFIRTTQKRHTDRVQEFVQDLYDKGEIYKGGYEGPYCVGCEEYKLPGELLDGEGEYAGQKLCPIHKKPVEILSEENYFFKLSEYSEKLLAHYEANPGFVQPESARNEVVNFVRQGLQDLSISRSTFDWGVPVPWDDKHVIYVWVDALLNYATAVGYNENPEKFESTFPADVHLVGKDILRFHAIIWPAMLMAQGLPLPGKIAANGWLMVGGEKMSKSNLTGIKPQDLTTHFGVDAYRWYFLRAIAFGQDGSFSWEDFSARYTSELANDYGNLASRVAAMVGKYFGGELPAATADGDAEQAIHDGLTKAVAEADRKIGEELDFQGGILAVFDFVKQVNGYITEQEPWKVAKDDSPEGKARLATILYTAAEALRAVAVLLNPIMPDTSQKLWDSLGAEPSLGALADQHVQDAADWGRLPAGATVTKGAVLFPRLEEKPAA

SEQ ID NO: 32341 - protein, 317 aa, Triticum aestivum
  misc_feature (272)..(272): Xaa can be any naturally occurring amino acid
  misc_feature (277)..(277): Xaa can be any naturally occurring amino acid
  misc_feature (297)..(297): Xaa can be any naturally occurring amino acid
RPSAVVDLSPYLKEAMYVGFSASTEGSTQQHTIKEWTFQTFGLPPATNASSFTNTTSNVSEPAVPGVAASGGATSKKRFGRAITILGPVALAVAFMFFACVSVKKLAELSSKKDAVFLPGLLKGPRKFNHKELSMATRGFHASRVIGRGAFGTVYKAAMPGAPTTYAVKRSTQAHQSRSEFVAELSVIACLRHKNLVQLEGWCDEKGELLLVYEYMPNGSLDKALYGDPCTLSWPERHNVAAGIASVLSYLHQECEQRVIHRDIQDGNILLXRHLSXPRLGDFGLARLMDHNKSPVXTLYAGTMGYLAPEYLQSGRA

SEQ ID NO: 32342 - protein, 425 aa, Corynebacterium glutamicum ATCC 13032
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 32343 - protein, 103 aa, Solanum lycopersicum
MSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 32344 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTGVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 32345 - protein, 173 aa, Brassica napus
MSPPERKRKKTKQSLVLEPTPESTPITSLPDDLVVSCLARVSRLQYPTLSLVSKSFRSLLASPHLYETRSSLGRTESCLYVCIRFPDETIPRWFTLCQKPKKKNKRTKKASGYVLAKLPTPPSRSAHWSGLVAVGSDIYNIGGPIDEADEPSSSVSILDCRSNTWREGPRQCD

SEQ ID NO: 32346 - protein, 294 aa, Clostridium perfringens ATCC 13124
MKEIFDVLPDKINSCLKDKSNLNKLQEIRVKVGKPLNIVLDNTETIFNYVIRREDVKAIIQKISNYSLYAFEEDIRQGYITIQGGHRVGLAGQCVIEDNSIKTIRNITSLNIRVCREIVGCSNSLMNSLVENNRVNNTLIISPPKCGKTTLLRDITRNISNGISQIGFKGKRTVVIDERSEIAACYNGIPQMNVGMRTDVYDNCIKSEGMMMAVRGLSPEVIICDEIGTYKDMEGLMMAYNSGVSIIATLHGRNVEELYRRPVFREIVENNIINKVVVLSGKKGIGTIEGIYNV

SEQ ID NO: 32347 - protein, 292 aa, Glycine max
MAAAAAWTGAASPNSLLLSRSPPHAAALAPSPGSSMRRRLLLGVGTPAVAALAAAAPPAVLQDGAVTVLITAGAYSLVRVFDELTERRLIEKSLSRKVVHVLSGVLFMSSWPLFSNSTEARYFAAVVPFLNSMRLLIYGLRLYTDEALELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 32348 - protein, 761 aa, Corynebacterium efficiens YS-314
MSLERNPQKSTIGVRSMSARLARSLTGTRMRTNPVLDPLLSIHRQFHPKADGAVLERAYSTAERLHEGVVRKSGDPYITHPLAVATIAAEIGMDTTTLVAALLHDTVEDTDYSLDDLTRDFGEEVARLVDGVTKLDKVALGAAAEAETIRKMIVAMSQDPRVLVIKVADRLHNMRTMRFLPPEKQAKKARQTLEVIAPLAHRLGMASIKWELEDLSFAILYPKKYEEIVRLVADRSPSRDRYLKEIIDQVTAGLHDNNIPAEVLGRPKHYWSIYQKMIVRGRDFDDIFDLVGIRILVDNVNNCYAAIGVVHSLFNALPGRFKDYISAPRFGVYKSLHTTVMGPGGKPLEVQARTHEMHYNAEFGIAAHWRYKETKGSHTGDREEVDQMAWMRQLLDWQKEAADPNEFLDSLRYDLTSKQIFVFTPKGDVVNLPVDSTPVDFAYAVHTEVGHRCIGAKINGKLVALETKLKSGDRVEVFTSKDPNAGPSRDWQDFVVSPRAKAKIRQWFAKERREEYLEAGRDALAAVIQRGGLPMHRLFTATTMKRVATELHYSDVDALYTAIGSGSVSAQHVVNRLVAIFGDQEDAEDALVDRTPFSELVESRAATGNNESGILVEGSPDVLAKLAKCCMPVPGDEIFGFVTRGGGVSVHRTDCTNAEKLREEPERMVQVAWASEGQGSVFSATLQLEALDRAGLLFELTRVINEQKVSVTAMNSHCSDDRVATVRFTFAVSDTKQLGSLMTQLRNAEGVFDVYRVTSGG

SEQ ID NO: 32349 - protein, 143 aa, Brassica napus
TERLSPPPGSSEGRASMYTTSEEGPSSRSKSSSLVLPEKCIAVLRYTEEPQEDFKRSMVSMMESKLGGSEVDWDLMEELLFCYLDLNNKKSHKFILSAFVDLIISLRDKEKNITRKGLVRSLSTRAARERLRKRMASSDAFRN

SEQ ID NO: 32350 - protein, 131 aa, Triticum aestivum
MSYYDRRGESSVLEAFTLSPLPYPVILILMMVTLLLGASWFFSYEEFMEEASEQFSWFLLGVPIALVLLIRWISSVDTFEGYFGFYPTESRWRGYPAAPSEGSSPWGVAMVVLLLLVLASFHSTFQDMWKA

SEQ ID NO: 32351 - protein, 197 aa, Corynebacterium efficiens YS-314
MTETDMDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 32352 - protein, 265 aa, Arabidopsis thaliana
MASMPSKLLPVLVCYVFLFPFASSSDYSGVSLPSSSPKVSVGLYYESLCPYCSSFIVNHLAKLFEDDLISIVDLHLSPWGNTKLRSDNVTAVCQHGAFECFLDTVEACAIDAWPKVSDHFPFIYCVEKLVTEHKYDKWETCYEKLNLNSKPVADCLSSGHGNELALHYAAETNALQPPHKYVPWVVVDGQPLYEDYENFISYICKAYKGNKVPGACTKYATGNFIRSVKLKRSPLVSWKGVNKMWDVLERITTSLSSYIDITGLL

SEQ ID NO: 32353 - protein, 270 aa, Zea mays
  misc_feature (251)..(251): Xaa can be any naturally occurring amino acid
MPSQLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVDMSLGRGLGPCGGPPAPGDLADHVERLRAGMGSEIARYLDCAGFTKTMSTGLEATRTSGKXCLVRMGHNFRPSPLCHRRP

SEQ ID NO: 32354 - protein, 519 aa, Oryza sativa
MLIMLGLGLVPAGAAAALAVALVCLAAAAWWTVERAPRRLERALRAQGVGGGRYQLLLGGDVAENGRLNREAWSRPLPLGCHRIAPRVLPLLWNAVRDHGKLSFIWFGPVPRVMIPDPELVREVFDKFDQFGKPKMIRVGKLLATGVVSYEGEKWAKHRRILNHAFHHEKIKRMLPVFANCCTEMVTRWENSISLEAASEIDVWPEFRNLTGDVISRTAFGSSYQEGRRIFQLQEELAQYLTEALQKLFIPGYWYLPTKNNRRMREIDREVRKILLEIIGNKERAITNGENSNDDMLGLLVESNTKQPELRMSTDDIIEECKLFYFAGMETTSVLLTWTLIVLSMHPEWQERAREEVLHHFGRTTTPDYDSLSRLKIVTMILYEVLRLYPPVVLLNRRTFKETNLGGIKFPADMNLILPILFIHHDPEIWGKDASEFNPGRFADGISNASKYHDASFFPFGWGPRICIGQSFALLEAKMALSMILQRFSLELSPSYIHAPYIVLTLRPQHGAQIKLKRI

SEQ ID NO: 32355 - protein, 590 aa, Burkholderia thailandensis E264
MSFTLHGIPVSRGIAIGRAYLIAPAALDVAHYLIEAERIEAEIERFRAALDAVRRELDALRADLSDDTPTEVAAFIDVHAMILGDAMLVQETIDLIRTRRYNVEWALTEQLDVLAGHFDDIEDEYLRERRADIEQVVERVLKALAGAPSAAQALDRAAGNGRDEMIVVAHDIAPADMMQFKTQSFQAFVTDLGGRTSHTAIVARSLGIPAAVGVQHASALIRQDDLIIVDGDQGIVIVDPAPIVLEEYSYRQSEKALEQRKLQRLKFSPAQTLCGTKIDLLANIELPDDAKAAVDAGAVGVGLFRTEFLFMSKERMPEEEEQFAAYKRAVELMHGMPVTIRTIDVGADKPLDAHDEGYETAPNPALGLRAIRWSLSEPQMFLTQLRAILRASAFGQVKILVPMLAHAQEIDQTLDLINEAKRQLDAAGLAYDPNVRVGAMIEIPAAAIALPLFLKRIDFLSIGTNDLIQYTLAIDRADNAVAHLYDPLHPAVLHLIAFTLREAKRAGVPASVCGEMAGDPALTRLLLGMGLTEFSMHPSQLLVVKQEILRAHLKALEKPTADVLAAFEPEEVQAALKRLASAEPKADVAA

SEQ ID NO: 32356 - protein, 662 aa, Exiguobacterium sibiricum 255-15
MIVLTNMTTVELLAVNTIRTLSIDAVQKANSGHPGMPMGAAPMAFTLWADHMNHNPKNPEWFNRDRFVLSAGHGSMLLYSLLHLSGYDLAMDDLKSFRQWNSKTPGHPEYRHTAGVDATTGPLGQGIAMAVGMAMAERHLEAKYNRDDLNVVDHFTYGICGDGDLMEGVSAEAASLAGHLGLGKLVVLYDSNDISLDGDLDKSFSENVQQRFEAYNWQVIRVEDGTDLDSISKAIEAAKAETTKPTLIEVKTVIGFGSPNKSGKSASHGAPLGDAEIKLTKASYVWDHEEFYVPDEVKDLFEERIEKRGADTEAAWTEKMEQYKAAHPELHAELVQAINNELPSNWEADLPTYDLTSKKATRQTSGEVLNAIAKNVPTIFGGSADLAGSNNTMLKGEADFDIDPSGRNIWFGVREFAMAAAVNGMALHGGVIPYGATFFVFSDYLRPAVRLAALMGIQSIFVLTHDSIAVGEDGPTHEPVEHLMSFRAMPNLTVYRPADGKETIAAWKTAVQSTNKPTLLVMTRQGLPELEGTTVEGAEKGGYVIAGDIEKADTILMGTGSEVHLLVEAQKELGETAAVVSLPSWELFEAQSAEYKESVLPKRITKRLAIEAGASLGWYKYVGTEGQVIGIDRFGASAPGDLLLKEYGMSVENVLNTVKQLG

SEQ ID NO: 32357 - protein, 220 aa, Triticum aestivum
  misc_feature (144)..(144): Xaa can be any naturally occurring amino acid
ARTGLADATASEADAMPAASKDAADVRMISTKELQAHAAADDLWISISGDVYDVTPCVEHHPGGEVPLITLAGQDANDAFMVYHPPSVRPLLRRYFVGQLTDYTVPHRFADFRRLFEQYSFRGLFERRGHTSKFLFVELLGLFXIALYCFLGWFSMRAHYFFRGLNCFIWIHRVDLAIFRPTQITRYLSFTRFFRGSSEIVSRPWCCWWNVTSSNNYFLV

SEQ ID NO: 32358 - protein, 297 aa, Corynebacterium efficiens YS-314
MSAPTTNAAPRAKTGYADRFKGGVIMDVVNPEQARIAEAAGAVAVMALERVPADIRAQGGVSRMSDPDMIDGILEAVDIPVMAKARIGHFVEAQVLQSLGVHFIDESEVLTPADYANHIDKFAFEVPFVCGATNLGEALRRVNEGAAMIRSKGEAGTGDVSNAVTHMRTIRAEINRLTSMAEDELYVAAKELQAPYELVVHVAREGKLPVPLLTAGGIATPADAAMMMQLGADGVFVGSGIFKSGNPEQRARAIVAATQNYNDPDTIARVSRGLGEAMVGINVDDLPVSHRLAERGW

SEQ ID NO: 32359 - protein, 129 aa, Exiguobacterium sibiricum 255-15
MKPIILFDGECNLCDTSVQFILKRDHGYYQFASLQGIKGQELIQKHRLPSDLNSVVVIEEGIPYVKSDAALQITKHLNGAWPLASIFRVLPRAARDLAYDFIAKHRHKWFGQKQQCLLPSKETRARFHE

SEQ ID NO: 32360 - protein, 321 aa, Solanum pimpinellifolium
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYLDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 32361 - protein, 206 aa, Vibrio fischeri ES114
MQDYKQPLRIGVGGPVGSGKTALLEVLCKTLRDTYQIAVVTNDIYTQEDAKILTQAEALAADRIIGVETGGCPHTAIREDASMNLAAVEELAQRHKNLDVVFVESGGDNLSATFSPELADLTIYVIDVAEGEKIPRKGGPGITKSDLLIINKIDLAPYVGASLEVMESDTARMRPTRPYVFTNLKEGVGLDKIIEFIVDRGMLDAK

SEQ ID NO: 32362 - protein, 303 aa, Solanum neorickii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELDQTHLSTVVKGTLGYLDPEYFIKGRLNEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32363 - protein, 223 aa, Saccharomyces cerevisiae
MSSQPSFVTIRGKAISLETQTESLLSKYSTFAQTTSSEQTGQEKKIDKQLEGILGQRQDVIDSLTQICDSNPAISASKLSQLHRHKEILQDHWKSFRNIRSSIQQERNRLNLLFSVKNDIANSTTDAPAPIGDADEYIQNETRRIDQSNNVVDRLISQAWETRSQFHSQSNVLNTANNKVLQTLQRIPGVNQLIMKINTRRKKNAFVLATITTLCILFLFFTW

SEQ ID NO: 32364 - protein, 332 aa, Prosthecochloris aestuarii DSM 271
MNKLITIERHFLEQQKSHPEATGELTDLLNDVAFAAKLVRREVVRAGLADILGMAGTTNVQGEEVKKLDLFANEKIINAIGEHGRFALMGSEENEGTIIPPNNDTGRYILLFDPLDGSSNIDVNVSVGTIFSIYRLTGDDPKEADINDCLQKGSEQVAAGYVIYGSSVMMVYTTGQGVHGFTYDPTIGEFLLSHENITTPERGKYYSINEGSLHQFNDSTVNFINYLKEDDEATGRPYSTRYIGSLVADFHRNLMTGGVFVYPATKGHPNGKLRLMYEANPLAFICEQAGGRATNGKERILDINPTELHQRTPLYIGSKEDVLKAEEFEKEG

SEQ ID NO: 32365 - protein, 843 aa, Frankia sp. EAN1pec
MRAVVMAGGEGTRLRPLTANLPKPLLPVVNRPIMEHVLRLLKRHGFDETVVTVQFLAAMIRNYFGSGDELGMHLSYATETTPLGTAGSVKNAEDALRHEEFLVISGDALTDIDLTDLVAYHRAQGALVTVALKSVPDPLEFGIVITGEDGRISRFLEKPTWGQVFSDTVNTGIYVMEPEVLDHVPAGEAVDWSGDVFPRLVAAGAPVFGYVAGGYWEDVGTIASFQRAQADVLNRQVDVSIGGFEVSPGVWIGEDADVHPDAILKGPLVVGDYSKVEAGAELREFTVLGSNVVVKRGAFLHRVVVQDNALIGPRTNLRGCVIGKSTDVLRAARIEEGAVIGDECVIQEEAFVSHDVKVYPFKTIEAGAVVNTSVIWESRGQRSLFGPRGVSGLVNAEITPELVVRLASAYATTLKKGSTVTTARDGSRAARALKRAVISALTAGAINVRDLEVAPLPVARFDVRTSDAAGGIMLRSKPGDAERIDIVFLDADGDDLSPAAQRKLDRVFTRQEFRRAFPGEIGDLRFPARTADVYTQDLLDRVDTSGLAEADLKVVVDPSGGAASLLLPTLLGRLGVDVLTVNGRLDETYPEPGAEQERRALDRLGALVASSRAAFGVRFDHIGERITIVDERGDLISDERALLVMLDLVAAENRGAQAAVPVTTTRVADQVGRFHGLTVRRMSMSGSELSRVVQAEPIVFAADGRGGFVVPEFAPVIDGLAAFVRLVALVARTRLTLSAIDARIPPVAMVRASVPTPWAEKGTVMRRVVESVDVDSGDQVDTTDGVRVVGPDGSWVLVLPDPSEAVTHLWAEAADLGGAQKLVRRWSAVVETVPPEQAPVTRS

SEQ ID NO: 32366 - protein, 267 aa, Glycine max
MDPKLKEVSQLFDRFKASFIRNDFDTCSNLLSQLKVLLTGFRSLPPLFADTPNAVHELTIARDIYEHAVVLSVKNEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNGSVFFQKAKESAPCKEIPSLQLINQTLSYARELERIV

SEQ ID NO: 32367 - protein, 469 aa, Streptomyces coelicolor A3(2)
MTDSSVREFKMPDVGEGLTEAEILKWYVQPGDTVTDGQVVCEVETAKAAVELPIPYDGVVRELHFPEGTTVDVGTSIIAVAVGDGAAAAAEPVQEAVAEEPKPEGRQPVLVGYGVSTSSTKRRPRKGAEAPAAAQTPAAAIQAELNGHGQAAPAAPATPAAPVTGDRPLAKPPVRKLAKDLGVDLATVVPSGPDGIITREDVHAAVSAPEPAQAAAPRSEQAAPAPSPSAPSSYDTTRETRVPVKGVRKATAAAMVGSAFTAPHVTEFVTVDVTRTMKLVEELKQDKEYTGLRVNPLLLIAKALLVAIRRNPDVNASWDEAAQEIVVKHYVNLGIAAATPRGLIVPNIKDAHAQTLPQLAGSLGELVSTAREGKTSPAAMQGGTVTITNVGVFGVDTGTPILNPGESAILAVGAIKLQPWVHKGKVKPRQVTTLALSFDHRLVDGELGSKVLADVAAVLEQPKRLISWA

SEQ ID NO: 32368 - protein, 326 aa, Streptomyces coelicolor A3(2)
MAAEKMALAKAINESLRRALESDPKVLIMGEDVGKLGGVFRVTDGLHKDFGEDRVIDTPLAESGIVGTAIGLALRGYRPVVEIQFDGFVFPAYDQIVTQLAKMHARSLGKVKMPVVIRIPYGGGIGAVEHHSESPEALFAHVAGLKVVSPSNAADAYWMMQQAIQSDDPVIYFEPKRRYWDKAEVDKEAIPGPLHTARVVREGTDLTLAAYGPMVKLCREVADAAAEEGRSLEVVDLRSISPVDFDTIQASVEKTRRLIVVHEAPVFLGSGAEIAARITERCFYHLEAPVLRVGGYHAPYPPARLEEEYLPDLDRVLDAVDRSLAY

SEQ ID NO: 32369 - protein, 404 aa, Brassica rapa
MGICMSVQVKAESPSNTGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 32370 - protein, 417 aa, Streptomyces coelicolor A3(2)
MTESTAARKPRRSAGSKAAGTTGTKAAGTTGSKAGTGKRTTRTTSTTRTAAEKGSDTELVQLLTPEGERVEDAAHAEYASYVADITPDELRGLYRDMVLTRRFDAEATALQRQGELGLWASLLGQEAAQIGSGRATREDDYVFPTYREHGVAWCRGVDPTNLLGMFRGVNNGGWDPNSNNFHLYTIVIGSQALHATGYAMGVAKDGADSGVIAYFGDGASSQGDVSEAFNFAAVYNAPVVFFCQNNQWAISESNEKQTRVPLYQRAQGFGFPGVRVDGNDVLASLAVTRWALDRARRGEGPALIEAYTYRMGAHTTSDDPSRYRHDDERAAWEAKDPILRLRRFLESANHADEGFFAELEAESETLGKRVREVVRAMPDPDRFAIFENVYADGHALVDEERAQFAAYQASFADAEGV

SEQ ID NO: 32371 - protein, 97 aa, Zea mays
  misc_feature (64)..(64): Xaa can be any naturally occurring amino acid
IYSRAKIEDTDTVCLWLGANVMLEYSCDEANALLKKNLENAKASLEVLVADLHFLRDQQTITQXTGRKRNLTTYITRPTNATGTFLFFLYLLLPLAD

SEQ ID NO: 32372 - protein, 161 aa, Glycine max
  misc_feature (159)..(159): Xaa can be any naturally occurring amino acid
PKPGILFQDITTLLLDPQAFRDTTDLFVERYKDKDITVVAGVEARGFIFGPPIALAIGAKFVPIRKPKKLPGEVISEEYSLEYGTEKIEMHVGAVQPNDRVLIVDDLIATGGTLCAAAKLIERVGAKVVECACVIELPELKGRDKLGDMPVFVLVQADXSV

SEQ ID NO: 32373 - protein, 148 aa, Glycine max
  misc_feature (62)..(62): Xaa can be any naturally occurring amino acid
  misc_feature (76)..(76): Xaa can be any naturally occurring amino acid
MACSMISYAAVTTVNRACAGMVAPFTGLKTMAGWLPRMRAFDITSIASNGGRAQCVQVWPPXWIKKFETLIYLPDXLEDAQLRKEVEYLLRKGWMPSLQFELDHGFVYREHNRSPGYYNGRYWTMVKLPMFGCTEATQVVNELQEAKT

SEQ ID NO: 32374 - protein, 1008 aa, Schizosaccharomyces pombe 972h-
MKDSEHHHHGHNGFSKFLHKLGFGKSKGKSHKSNTSSIHERENTAAKGPASNVRPARPNVSTSSTSNEVRKSVPVGNPTVHTKTGSSSSPASKMRNTVNLQHIQAANQKTRNAEGERKVAQRRVQSDKAEANDAAMSSSAPTVDVSEGNSAAEPKITPDDSDTPRLNVDMNDKINVDEAAAKSDSKLNVDQINSTTESEKRVEKVNPNIANNPLKSPDAVAYSSETVSDEKQPTEHPVSANVPAKSEKAVCDENTKISLTNTEHYKFHSLRGDVEVVVGDLERDGRDTSLGDASVNEAAKETDVDSSRFISDEKAVTEDAMKTEHASNAPLTDERHFQFHSSEGDIEGIVGTMQRQRQSVSSYDTIVPSQFYKQKVVQNSPPSLLSTDNKIPESGSDHPSSQDNSSKASLVENSQTQSSTPRKPLPTTTSPKVNPEPHSESISDTRPSTPRKVPPSTVPKMNPKLQGGNSVTAPSTPSKVLPAMSPKVAPKFQGGRSSTAPSTPNKVLPAASAKAAPKLQEKAASFDIPNKSTIISTKSTVASPIKANENSPALKSKASFEFPKELDPDGTWNAPIPYPDANCPMAPTYRNLTSEQEEMYEEVLKYCLELKEIPVASNSSKKTDLIELERLWLTRECILRYLRATKWHVSNAKKRIVDTLVWRRHFGVNNMDPDEIQEENATGKQVLLGYDKDGRPCLYLYPARQNTKTSPLQIRHLVFSLECAIDLMPPGVETLALLINFKSSSNRSNPSVGQGKEVLNILQTHYCERLGRALVINIPWAVWGFFKLISPFIDPITREKLKFNEPLDRYVPKDQLDSNFGGSLHFEYHHEKYWPQLVELCKSRRLGILEKWRKMGSKIGTSEWDLKGGEEYVELMQQYVRPSLTNRSSSPTVTPTVNTDRQPKTLTNSADELSPQKRRVENPKPVVKDEGPVSIVEDEESTPVVTKKEDSIPVAQSTKADAGLDAENDLLPKSGSGVSETPAFSHARDVSTASFSDAVSFITADSIE

SEQ ID NO: 32375 - protein, 132 aa, Synechococcus sp. CC9605
MAKSSKASSAAAKKLSPEALIRSFESSQQKDDLPEIYVGDTVRVGVRISEGNKERVQPYEGVVISKRHGGLNQTITVRRIFQGIGVERVFMLHSPQVASIKVERRGKVRRAKLFYLRERVGKATRVKQRFDR

SEQ ID NO: 32376 - protein, 363 aa, Debaryomyces hansenii CBS767
MSIDPETRRKLLVLQKNGSNKTCCDCAAPNPQWASPKFGIFICLECAGIHRGLGVHISFVRSITMDQFKPEEVLRMEKGGNEKLKNYFSENGVDLKLDARQKYDNYVAEDYKEKLTCEIEGKEFTPKDHSGQSLPDINAASASDDTTSNSAPKQQEKIQSRRGTPLPSDQKQKNESYFAELGSKNGTRSDSLPPSQGGKYGGFGNTPASQSSNQGGSLSGFTIDNFQSDPFGTLSKGWGLFSNTVAKSVNEVHESVIKPGINQLQESELSGEAKRAMAQFGQKMQETGKYGQETFQKFTNEHNAPDSKFGKLFDGLNVQDESEGVTPAFGLQKPQQKTKLDSLGGGKSKKDDDWKNDDKWDEF

SEQ ID NO: 32377 - protein, 430 aa, Xylella fastidiosa Dixon
MTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 32378 - protein, 253 aa, Zea mays
  misc_feature (128)..(128): Xaa can be any naturally occurring amino acid
MAATAPNGNPTVSSLAATVPVQAVLFDIDGTLCDSDPLHHVAFQEMLLEIGYNNGVPIDEVFFIKNIAGRSDVEAAQNLFPDWELEKGLKFLEDKEAKYRSLAKERLVPVKGLAKVVQWVKDHGYKRXAAVTNAPRINAELMISLLGLSDFFQAVIVGGECEQPKPAPYPYLRALKELQVSAEHSFVFEDSPAGIRAGVAAGMPVVGVATRNPEKSLVEAGTKKLVKDYEDPKLWAALEEVEGEEAKLKKASE

SEQ ID NO: 32379 - protein, 447 aa, Prosthecochloris aestuarii DSM 271
MSKNSHAISLVEAVSMAVGTMIGASIFSIFGLGAEIAGQNLPMAFFLSGMLAFMVAYSYAILGRQIISNAGPISFLLKGIGDNVLTGTLAVLMWLSYVISIALFVKGFSGYLLPFINIESTPLAIGLTEAGIIMFFTLLNTYGSQAVGKLELYIVAVKLSILLIFIVLGMSSIHLSSIVPSLTPKGTEGMLMGSIVFFLSYMGFGLITNASENIDNPFVNVPRAIYISISIVIMVYVLVSVVALGNLAIPDLVKAQDNALAVAARPFLGQTGFALLSVGALFSIASALNATLYGGANIAYSLAKDGELPGIFERKIWFGSSEGLYITAGLGLFFALLFDIGAIASITSTIYTIIYLCVMISHYRIAGTYGGSRPLIFIFSCTMAVVLIGLMSYQYMTSKITFFATIATFFGALLIEYLYRYGRKRRFGIINNLSDTSQALHPARKDI

SEQ ID NO: 32380 - protein, 491 aa, Streptomyces coelicolor A3(2)
MAHASDGHVLEFKLPDLGEGLTEAEIVRWLVEVGDVVAVDQPVVEVETAKAMVEVPCPYGGVVTARFGEEGTELPVGAPLVTVTVGGGGAAADGPARDSGTDAGAAGTPVAGTPAAAAAETSPAAETKAEGSGNVLVGYGTSEAPARRRRVRPGRQAATGASGRANGRVRGAGAVDGPVRTAEPADGPVPVISPLVRRLARQHDLDLRELTGSGPDGLILRADVEYALRAAAAQGGRTADPEAGTGRVPDAAPAAVSSAPRSDGTRVPLKGVRGAVADKLSRSRREIPDATCWVDADATELMRARTAMNASGGPKISLVALLARICTAALARFPELNSTVDTDAREVVRLDRVHLGFAAQTDRGLVVPVVRDAHTRDAEALTAEFARLTEAARAGRLTPGELTGGTFTLNNYGVFGVDGSTPIINHPEAAMLGVGRIVPKPWVHEGELAVRQVVQLSLTFDHRVCDGGTAGGFLRYVADCVEQPAVLLRTL

SEQ ID NO: 32381 - protein, 208 aa, Hypocrea lixii
MASPLPVRAAALSRDTNETSIQIALSIDGGELPQDADPRLLEASSAHASQTSKSQVISINTGIGFLDHMLHALAKHAGWSMALNCKGDLHIDDHHTAEDCCIAVGTTFAKALGALTGVARFGYAYAPLDEALSRAVVDLSNRPYTVVDLGLKREKLGELSCEMIPHCLQSFAQAARITLHVDCLRGDNDHHRAESAFKALAVAVRWYD

SEQ ID NO: 32382 - protein, 195 aa, Triticum aestivum
GEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTMPSSKGVLSRS

SEQ ID NO: 32383 - protein, 143 aa, Zea mays
MVHGKLEVLLVSAKGLEDTDFLNNMDPFVILTCRTQEQKSSVANGAGSEPEWNETFVFTVSDDTPQLHLKIMDSDLTNDDFVGERTIPLEAVFQEGSLPPAVHPVVKEEKYCGEVKLALTFTPAAETRRPDDNEEGPPYSSWS

SEQ ID NO: 32384 - protein, 542 aa, Salinibacter ruber DSM 13855
MASSDAEALCPPVLTAGAMQAADRYTIEEYGLPSFTLMETAGRGCAARIQDAYGPLEDEAVVVLCGKGNNGGDGLVVARHLVTDGARVHVVLASAPDELSDDAAHNLSLLRQLQADGAVGERLTIGELEDVETLTAAVAPLRPRLYVDALLGTGLTSDVREPIRSLVTWVNGRTAPTVALDVPTGLHSDTGAVLGVAVRADRTATMAAPKVGLRVGEGPTRAGTVEVVDIGMPPFVLDRAAEKPGCVRETTDAAVRAWWPARDPDAYKYSVGTALIVGGAPPFAGAPVMAAKAAGRSGAGYVRCAGPETIHATLAGALTTIPTLPLPTGDDDGIAPDAALDALAEAADTADAILVGPGLGRAPGTAQFVRRLVRTVDTPLVLDADGLNALAGHIDELADQRQAPWVLTPHAGEFRRLAGEEGALTDRVRAAQTYAERWDAVCLLKGMPSVVAGPTGRTVLGSIATPALATAGTGDVLAGQCVGLMAQGLSPLNAAAAALHVGGAAAERYGATHDPRSMVATDLLDMIPRVAAERFGEGRRQR

SEQ ID NO: 32385 - protein, 1177 aa, Zea mays
  misc_feature (9)..(9): Xaa can be any naturally occurring amino acid
SPTISRREXIQQEVINVLERKQSSEGTYDGFNNAIEEVTHLDIDQISPLRMVLTASVAFHDQSVKPGSPLLVSVSLLSHLPSPVVVDQLEVQFNQSDCNFVMHSAQEDSLPSYSNLHGQVIQDTSSLTLFTNRWMRLTHEVKSGKSGKLECLSVKATISKHLVICCHAESPASMEDFPLWKFENQVETLPTKDTTLAFSGQKLIQVDEPDAQVDLVLNSAGPALVGELFTLPVIIESKGHAVHSGELKINLIDARGGGLLLSPREAEDSESHHVELLGVSTVSEDKESKEEADSIRKIQYSFGVVSVPTLSVGDSWSCKLEIKWHRAKSVMLYVSLGYSLGSSEEEALHRLNVHRSLQIEGQIPLLVSHQFLRSFRREPLLLSGIRSLGSDDKKCSLAMNESNMLIVTAKNCTEVPLCLHSMTIQPDGDGEQLCSVQQISGISNRHAIVAPSEEYKGIFSVNPRAISTNFRLGEICLNWSRDSSLGEDQDRLIIMKVQLPEVNIEEPPLVVGMECPPYAILGIPFTIYVKIHNSTSLLQEIKYSLVDSQNFVFSGAHNHAAFILPKSEHTVSHKFVPLGSGSQQLPRITVTSVRYSAALTPSASAATIFVYPSDHDGGGDQRRLLTIPKEGERIIAPTRRPDGTLRKAIRIRAGYVPQEEVAIYQSKGALMRKSGPDVPPGYDPALVADAKPKTKAAKRNERRKEKRQQLIRLCKLAECSGYLTFLFRNFTLHSVYQTNFLSNLSSQPLDVETGPKLDENYGRKPLGEDVDEMRSGRDAENATNTDSDTLTDEVEVVLHVLRALMLHGIGGDVDHVDVVAIDKGHTHDGAVELLEQLTKPGRLGHAIGHNAILGLNVEAGDDGLPLRGPRDVVGAQEHSVARGVLAHVRAVDPISDSASAALGGSVGNLQKIRAFLRVRLRDQGVLDFDATDLRRQPPVDTTWQQIYFCLRTRYYDEARQVAQSSRTAYNFAPLLADWISTNGAVSPETALAASEECDKMLRMGDRPGRPGYDRKKLLLYAIICGCRRQIERMLKDLPTLFNTIEDFLWFKLSALREYTNASSSNLMNEGLVPYTLDDLQSYLNKFEPSYYTKNGKDPLVYPYILFLSIQLLPAILYLSKEVGEDGYHVDAVHISIALADHSVLPDGIGSGQKIGVMDACAEAASIIRQYGSIYLRN

SEQ ID NO: 32386 - protein, 1420 aa, Arabidopsis thaliana
METKTENKEHQWKDSVSSRSSSRSSSITSASSDGHFDIRHFPLPKPSLSASEAQKLRESHQAYNSSVSSYTSSSWSSNHQNHLIDLPGYDPTRIPSSVFSSKPGNSTEWSLASNESLFSIHDGNFSISTALRLAEIPRFEETVHVITEINSVPLPPPVKKPNEYEKETIAEKEPYQVENSNSDIEDNEEEEKMSEVESDDEHEEEQTDMIEAEALVEKEVIETVKENKPEDSNSIVSHSPSISCRSDTSNNSIGSFAFPLVELGIVSHGKRKDLLLVNCYISRPCEMPSDVVFSLCLLCFASCLAGKITVLADSDKSVLLRFKKTVSDPGSILASWVEESEDYCSWFGVSCDSSSRVMALNISGSGSSEISRNRFTCGDIGKFPLYGFGVRRDCTGNHGALAGNLPSVIMSLTGLRVLSLPFNSFSGEIPVGIWGMEKLEVLDLEGNLMTGSLPDQFTGLRNLRVMNLGFNRVSGEIPNSLQNLTKLEILNLGGNKLNGTVPGFVGRFRVLHLPLNWLQGSLPKDIGDSCGKLEHLDLSGNFLTGRIPESLGKCAGLRSLLLYMNTLEETIPLEFGSLQKLEVLDVSRNTLSGPLPVELGNCSSLSVLVLSNLYNVYEDINSVRGEADLPPGADLTSMTEDFNFYQGGIPEEITRLPKLKILWVPRATLEGRFPGDWGSCQNLEMVNLGQNFFKGEIPVGLSKCKNLRLLDLSSNRLTGELLKEISVPCMSVFDVGGNSLSGVIPDFLNNTTSHCPPVVYFDRFSIESYSDPSSVYLSFFTEKAQVGTSLIDLGSDGGPAVFHNFADNNFTGTLKSIPLAQERLGKRVSYIFSAGGNRLYGQFPGNLFDNCDELKAVYVNVSFNKLSGRIPQGLNNMCTSLKILDASVNQIFGPIPTSLGDLASLVALNLSWNQLQGQIPGSLGKKMAALTYLSIANNNLTGQIPQSFGQLHSLDVLDLSSNHLSGGIPHDFVNLKNLTVLLLNNNNLSGPIPSGFATFAVFNVSSNNLSGPVPSTNGLTKCSTVSGNPYLRPCHVFSLTTPSSDSRDSTGDSITQDYASSPVENAPSQSPGKGGFNSLEIASIASASAIVSVLIALVILFFYTRKWHPKSKIMATTKREVTMFMDIGVPITFDNVVRATGNFNASNLIGNGGFGATYKAEISQDVVVAIKRLSIGRFQGVQQFHAEIKTLGRLRHPNLVTLIGYHASETEMFLVYNYLPGGNLEKFIQERSTRDWRVLHKIALDIARALAYLHDQCVPRVLHRDVKPSNILLDDDCNAYLSDFGLARLLGTSETHATTGVAGTFGYVAPEYAMTCRVSDKADVYSYGVVLLELLSDKKALDPSFVSYGNGFNIVQWACMLLRQGRAKEFFTAGLWDAGPHDDLVEVLHLAVVCTVDSLSTRPTMKQVVRRLKQLQPPSC

SEQ ID NO: 32387 - protein, 130 aa, Brassica napus
MMSRGGAKAASSLLKAARPRLFSTATTSTIRSISHETSHLLRPAVADLASPSGMSGWIWTTRAPAMGGVRFASTVTLGEKTTTTDANPKKAENESSTGGDAGGNKGGKGIASYWGVEPSKITKEDGTEWK

SEQ ID NO: 32388 - protein, 369 aa, Nostoc sp. PCC 7120
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSINGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVNVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 32389 - protein, 439 aa, Xylella fastidiosa Dixon
MFELLIVIALIFLNGFFAMSEMSLMTSRKSRLKQMAHSSKHAAKALTLAQNPESFLSTVQIGITLIGILTGLFGGDAIGTAIGQWLTALTPQLGEYTSIIGKTLSVALITFLTLIFGELVPKRLALTHSENIASTIAVPMSVLARIAAPGVWVLAKSTQLVLRVFGFGKIPSSAVTEEEIRLLVAESHEAGVIDDYERNMMNRVMRLGDRTADSLMTPRNRIAWLDNSADLEHNLEIMREHQFSRYPVYRSSDQDIVGILEVKSVITRIDSQTQTTLSLFQELCEPVFVSESTHALKLLEIFREEQQSMALVVDEYGEILGLVTISDLMGAVIGRLQNVENTDEDALMVTREDGSFLIDGTLPIEELREVLGAELPDGEENNYHTLAGMCISYFGRIPHVGEYFDWAGWRIEIVDLDGARIDKLLLQRLNKEKNHVPHK

SEQ ID NO: 32390 - protein, 376 aa, Bacillus cereus ATCC 10987
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 32391 - protein, 588 aa, Hordeum vulgare
MVMGSTDRFDKSPLLDGGSSSQESTTEYTGDGSVCTSGHPASKKHTGNWKASSLTIVCSFCCYLAYSSIGKNLVSYLTKVLHETNLDAARHVATWRGTSYLAPLVGAFVADSYLGKYRTALIACTIFIMGMMMLLLSAALPLISAGPHAWTLWADPVSSRYIMFLVRLYMVGLGYGAQSPCVTSFGADQFDDTDEVEKTRKSSFFNWHYFSINAGSLIAGTVIVWVQEHEGWLWGFTISTLFVTLGISVFSLGSIVYRFQKPGGSPLARIWQVVVAASRNFDKVLPCDSSALYEFSGQGSAIEGSRKLVHTSGLEFFDKAAIVTLPDCESPGQLNEWKICTVTQVEELKILIRMFPIWSAMVLFAAVQEQMFSTFVEQGMTMEKHIGSFEIPAASFQSIDTITVIMLVPIYEKVLVPVIRKFTGRANGITSPQRIGIGLCFSMFSMLLAALVESNRLQIAQAEGLVHSKVVVPMSILWQGPQYFLLGVAEVFSNIGLTEFFYDESPDAMRSLGMAFSLLNISVGNYLSSFILSLVPVFTARGGSPGWIPDNLNEGHLDRFYLMMAGLSLLNIFVFAFYARRYKCKKAS

SEQ ID NO: 32392 - protein, 334 aa, Streptomyces coelicolor A3(2)
MTTVAVKPATMAQALTRALRDAMAADPGVHVLGEDVGTLGGVFRVTDGLAAEFGEDRCTDTPLAEAGILGTAVGMAMYGLRPVVEMQFDAFAYPAFEQVVSHVTKMRNRTRGKMPLPLTIRVPYGGGIGGVEHHSDSSEAYYMATPGLHVVTPATVADAYGLLRASIASDDPVVFLEPKRLYWSKDSWNPEEPASVEPMGRAVVRRSGRSATLITYGPSLAVCMEAAEAARAEGWDLEVVDLRSLVPFDDETVCASVRRTGRAVVVHESGSFGGPGGEIAARVTERCFHHLEAPVLRVAGFDIPYPPPMLERHHLPGVDRILDAVGRLQWEAES

SEQ ID NO: 32393 - protein, 557 aa, Burkholderia xenovorans LB400
MDKIWLKSYPPGVPAEIDPSRYSSVGELLEEAFRDHRAKPAFVCMGKEISYGELDVLSRKLAAWLQSKGLARGARIAIMMPNVLQYPVAIAAILRAGYVVVNVNPLYTPRELEHQLKDSGAEAIILLENFAVTLQAIVRNTSVKHVVVAAMGDLMGLKGTLVNFVVRKVKKMVPAWSLPGHVRFNTAIAQGGRQNFEPVQQGPNDVAFLQYTGGTTGVAKGATLLHRNLIANVLQSEVWLDPVRANRTDIDQFITVVALPLYHVFALTVCGLLTIRTGGLGVLIPNPRDIPGMIKALEGYAITTIPAVNTLYNAMLNSPDFHKLDFSKLIAANGGGMAVQEAVARRWYEQTHTPIIEGYGLSETSPCVTCNPVTVTEYSGTIGLPLPSTEISIRDDEGNEVPLGQPGEICIRGPQVMAGYWNRPDETAKVMTEDGFFKSGDVGLMNERGFVKIVDRKKDMILVSGFNVYPNEIEDVVAKLPGVFEVAAVGVPDQHSGEAVKLFVVKKDQALTDADIFAYCKQQLTGYKRPKIVEFRTELPKSNVGKILRRELRDGRA

SEQ ID NO: 32394 - protein, 586 aa, Xylella fastidiosa 9a5c
MSPQTSLSILLHPGSPAPMSSSSIEDIKGKSHRLRGSLLESLANPTTGALHESDQTLIKYHGSYQQDDRDLREERRRQKLEPAYQFMIRTRTPGGVITPQQWLQLDAIATRYANHSLRVTTRQAFQFHGVIKRELKATMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVAIGGGMGTTHGDPDTWPRVGNIIGFITRADLIAISTAIVTTQRDFGNRTLRKRARFKYTIDDRGLDCIVGEIQQRAGITLQPARPFVFEHNGDRYGWIEGEDRHWHLTLSLPAGRIADTESSPLLSGFRAIAQLGIGQFRMTPNQNVVIAGISPGQRATIDALVTQYGLDTGNRAPTALARHAMACVALPTCGLAMAEAERYLPDFNVKLQPILEKYGLAEKPILLRISGCPNGCSRPYLAEIALVGKAPGRYNLMLGGDQRGQRLNTLYRENITETEILAALEPLLGRYQQKRLPGEGFGDFLHRTGIIALPPYPTHRHVISSTLQA

SEQ ID NO: 32395 - protein, 654 aa, Sulfolobus tokodaii str. 7
METVKSICPFCGVGCGVELYVESSTIIRLSPVKEHVVSRGHLCGKGTLAYEPIFAWDRLTYPLKKVKGEHIRISWEIAIKEIASKLKEIIQQYGSDAIAFYGGCQNTLEEDYLMQKLARAMGTNNIDSCARVCHDPSATALKEMVGIGASSVSVEMIPRMKVVVITGESITESHPVLSQYLTEAKKNGTKLIVIDPRVTGTAKFSDLHLRLRPGTDIALFNAVGNYLIENSLIDEKFIKERVIGFEEYAKGVSKYTLEYAEKVTGVRKENIKKFAELIAQKGVIFSWGLGLTQSSGVNGVRAYINLALLTGNIGKNGGLLVFRGQTNVQGSGDLLKPDKFPNGTMDEENAKKLAEIWNFLPPTKPGLSVTEALLRDNNIRAIIFMGFNPLISLPNREKVERKLKSLDLLVVIDAFMTETASLAHYVLPAAVWAEKEGSVTNLDRLAKWRFKAIDPPGEAKPDYEILKKLAEELGYNFSSDPKEIFEEMKKVVPLYSNLTLDEIMDYSSSSRYPNHEIYLYDEKFYTETNKAKLILVEQPEVKNGIILITVRNVTRYNTDVITGRIPGYGKYESLIYVSQEDALELKIRDNEEVLVTSECGKMNFRVMISKDVQKGTAIMYMHDPKVNYIICDELDEITKTPKYKYTEIKIMKLN

SEQ ID NO: 32396 - protein, 146 aa, Thermus thermophilus HB8
MNRGALIKLVESRYVRTDLPEFRPGDTVRVSYKVKEGNRTRIQDFEGIVIRIRRNGFNTTFTVRKVSYGVGVERIFPLHSPLIQKIDIVQRGRARRAKLYFIRNLSDREIRRKLRADRKRIDQDRAAERAAKEEAQKAQEPKASQE

SEQ ID NO: 32397 - protein, 601 aa, Catharanthus roseus
MDSRRRSPTVTAKAAAGELPLAPHEGQNQQPSIPRSSDVLPLPLYLANGVFFTLFFSVMYFLLTRWREKIRNATPLHVVTLSELAALASLIASVIYLVSFFGLDFVQSLIYKPNNEGWEIEEEILMVEDSRNGTNCTTLGCAVPPPSVPKIAPVVPQQPSKMVIIEKPAPLITPQNSEEDEDIIKAVVAGKIPSYSLESKLGDCKRAAGIRREALQRITGKSLEGLPLEGFDYASILGQCCEMPVGYVQLPVGIAGPLLLDGREYMLPMATTEGCLVASTNRGCKAILASGGANSVLLRDGMTRAPVVRFGTAKRAAELKFYMEDTQNFETISVVFNKSSRFAKLQSVQCAIAGKNLYIRFSCSTGDAMGMNMVSKGVQNVLEFLQTDYPDMDVLGISGNFCADKKPAAVNWIEGRGKSVVCEAIIKEEIVKTVLKTEVAALIELNMVKNLAGSAIAGALGGFNAHASNIVSAIFIATGQDPAQNVESSQCITMMEAVNDGKDLHISVTMPSIEVGTVGGGTQLASQSACLNLLGVKGASKDSPGANSRLLATIVAGSVLAGELSLMSAISAGQLVRSHMKYNRSSKDITNIASSQLESDS

SEQ ID NO: 32398 - protein, 383 aa, Salinibacter ruber DSM 13855
MKENLTRRPHLSRWRRATGPPWIRAEFSVPNLTLLQPMRAAVFHEPGDIRVEDVPDPSIEAPTDAILRITRTAICGSDLWFYRGHRDYEAGWRTGHEPMGVVEDVGSEVRSLEPGDRVLAPFAISDGTCEFCRQGLHTSCVHGNVWAAEHDGAQGEAVRAPQADGTLVKIPERAEGDASLLRALFPLTDVMGTGHHAAVSAGVEAGSTCVVVGDGAVGLCAVLAAQRLGAERIIAMGHHEERLEKARGFGATDIVSSRGEEAVEEVREMTRGGARHVMECVGAASAIETAISVCRPGGTIGYVGVPFGAEDGGLDMFRLFRENITLQGGIAPVRAYIPELMDDVLDGTLDPSPVFDTTIGLEEVPDGYAAMDERESIKVMVEL

SEQ ID NO: 32399 - protein, 246 aa, Brassica napus
MLFTMASSSSHRLVFFCLACLLFTFSYNFVAGESDKVKLNLYYESLCPYCQSFIADGLVKIFDSDLHTITDLKLVPFGNAHVSDKLTVTCQHGEEECKLNAIEACAIRTWPDPNVHYWFIRCIENDTTNWESSCFTKYGGKKAIKDCYTSDLSKTLILGYANQTLSLKPKHIYVPWVTVNGKPQYQHLDDFVAQVCKAYKGKASLPKICHSSALSKSPQSKVVKLQVSYADEVFNHQAKKLKLRWI

SEQ ID NO: 32400 - protein, 279 aa, Schizosaccharomyces pombe 972h-
MNDLMKRGLPKGKYAFTGTGLLLALGLAGFAVQTSLFNVDGGHRAIKYSRIGGIKNLIYPEGTHFLIPWIETAIDYDVRAKPRNISSLTGTKDLQMVNINCRVLSRPDVHALPKIYRTLGGDYDERVLPSIVNEVLKSVVAQFNASQLITQRERVSRLVRENLMKRAARFNILLDDVSLTHVQFSPEFTAAVEAKQIAQQDAQRATFYVDRARMEKQGFIVRAQGEGRAAQLIGEAIKNKPGFIELRKLETAREIANILSKSNNKVMLNASTLLLDDIK

SEQ ID NO: 32401 - protein, 159 aa, Codonopsis lanceolata
MAGYGDSFQTGRDQARQTDDYGNLVRQTDEHGNPIHPTTGGTIGDHISTGGYGTGTGEHNAGHQGQQHHGDTGGVTGVLHRSGSSSSSSSEDDGMGGRRKKGIKEKIKEKLPGGRKEEQRTSTTTPGTGAVYGGHEVEPEKKGLVEKIKEKLPGAHAHH

SEQ ID NO: 32402 - protein, 332 aa, Schizosaccharomyces pombe 972h-
MVKNTVKHVDSSKHLEKVASLIKEGKVKKICVMVGAGISTAAGIPDFRSPETGIYNNLQRFNLPYAEAVFDLSYFRKNPRPFYELAHELMPEKYRPTYTHYFIRLLHDKRLLQKCYTQNIDTLERLAGVPDKALIEAHGSFQYSRCIECYEMAETEYVRACIMQKQVPKCNSCKGLIKPMIVFYGEGLPMRFFEHMEKDTKVCDMALVIGTSLLVHPFADLPEIVPNKCQRVLINREPAGDFGERKKDIMILGDCDSQVRALCKLLGWSDELEKLIDTSVETLTEEISLLSVDSTIEKNASEQKKDDNSVNPFTKIEEKKKDEVTLLVSDDE

SEQ ID NO: 32403 - protein, 148 aa, Codonopsis lanceolata
MEQTFIMIKPDGVQRGLVGEIISRFEKKGFLLKGLKLLNVEQSFAEKHYADLSAKPFFGGLVEYIVSGPVVAMVWEGKGVVKTGRTIIGATNPAASAPGTIRGDFAIDIGRNVIHGSDAVESATKEIALWFPEGVANWQSSLHSWIYE

SEQ ID NO: 32404 - protein, 799 aa, Xylella fastidiosa Dixon
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRRLGSKLVRMVYSDAPGERVKIEDTPTELRHCFAISDADVQELARQALIIEQHYGRPMDIEWAKDGVSGKLFIVQARPETVKSRSHTTQIERFALQQRGEILTEGRAIGQKIGSGIARVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNAAVKKLLSMAIKAARSKGKYIGICGQGPSDHPDLAEWLMQEGIESLSLNPDTVVDTWLRLAKLKTVH

SEQ ID NO: 32405 - protein, 337 aa, Xylella fastidiosa Dixon
MKFTRKLATAAILALASTSCQAAGSPGVEHRTQAFLEDLAKGGGAPIETLSPANARQVLVNAQKGAKLPPADVSEKTITIDGKQIVLNIVRPAGVKGILPGFMFVHGGGWVLGDFQTHERLVRDLVSDSGAVAIFVNYTPSPEARYPVAINEIYAATQWVAEHGAQINVDGQRLAIVGNSVGGNMATVVAQMAKEKGTPALRAQVLFWPVTNANFENTSYNEFANGHFLTKNMMKWFWDTYTTDSKQRQDIYASPLLATAEQLKGLPPTLIQTAEKDVLRDEGEAYARKLDAAGVNVVITRYNGMIHDFGLLNVLADLPATRAALHQASEELKVHLR

SEQ ID NO: 32406 - protein, 456 aa, Arabidopsis thaliana
MENLDEIRTDIVESTAPLLQESSSESNGGGEFNGASFSGAVFNLATTIIGAGIMALPATMKILGLIPGITIIVLMAFLTDASIEFLLRFSNIGNQRSYGGVMDDSFGKCGRIMLQVSILVSNIGVLIVYMIIIGDVLAGKNEYGIHHAGMLEGWFGISWWNRRTFVLLVTTLTVFAPLTCFKRIDSLRFTSAISVALAVVFLVITAGITIIKLFTDGLMMPRLLPNVTDLSSFWKLFTVVPVLVNAYICHYNVHSIQNELEDPSRIKPVVRSALAMCSSVYVMTSLFGYLLFGDGTLDDVLANFDTDLGIPFGSVLNDAVRFSYAAHLMLVFPVVFYPLRINIDGLIFPTAPPLTSSESDLRFGSITAGLIAVIFLGANFIPSIWDAFQFTGATAAVCIGFIFPAAVILKDRHNQATKRDKTIAICMIVLAVFSNAIAIYSDAYALFKKHTYVYPI

SEQ ID NO: 32407 - protein, 252 aa, Synechococcus sp. RS9916
MSTSPNHGWFDAVATAYQSCRPRYPDSLFRWLAEQAPARHCCWDVACGSGQASEGLALWFNRVEASDLSPAQIAAAPSHPRIHYRVAAAEHSGLEDGSVDAVVVAAAIHWLDVPQFNQEVRRVLRPGGLLAWLGYDPIQGAPPALQRWLDDLYHQRLNPWWPAERAHVDRRYQDLPFPTHSQAIPGALQIDLHWSCNELLGFISTWSALRRAGGQAPALLHDFRAELLELWPADTPQLKLHLPLMGRWGRLS

SEQ ID NO: 32408 - protein, 1309 aa, Burkholderia thailandensis E264
MASTTLGVKVDDLLRARLKDAASRLERTPHWLIKQAIFAYLERIEHGQLPPELSGHTGMADLSDGHADGDEDGAPHPFLEFAQNVQPQSVLRAAITAAYRRPEPECVPFLIGEARLPASLAPDVQSMAAGLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGKGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQERTMNELLPRVRSLALLARRYDIGLNIDAEEADRLELSLDLLEALCFDSELAGWNGIGFVVQAYQKRCPFVIDYLVDLARRSRHRLMIRLVKGAYWDSEVKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVEEAAKVVPLGAPHAKIALPRELYGASRVNSMGLDLSNEHRLASLSSALLASAHHPWRAAPMLADDALAHAEPRDVRNPADLRDVVGTVSEATPEEVGAALAHAVAAAPIWQATPVDARADCLARAADLLEAQMHTLMGLIVREAGKSLPNAIAEIREAVDFLRYYSAQIRDEFSNDTHRPLGPVVCISPWNFPLAIFMGQVAAALAAGNTVLAKPAEQTPLIAAQAVRLLRDAGVPAGAVQLLPGNGETVGAALVADPRTRAVMFTGSTEVARLINKTLSSRLDPDGKPIPLIAETGGQNAMIVDSSALAEQVVADVLQSSFDSAGQRCSALRVLCLQDDVADRTLTMLKGAMRELALGNPDRLSVDVGPVIDADAKRTIDAHIAAMKDKGHAVTQLEMPEACAQGTFVPPTIIEIGNVDELKREVFGPVLHVVRYRRSGLDKLLEQIRATGYGLTLGIHTRIDETIAHVISRAHVGNIYVNRNVIGAVVGVQPFGGEGLSGTGPKAGGALYLQRLLATRPAGLPRSLEASLVADAPQEGETRDNPSAALTALRDWLIEQREPALAARCDGYLSHVLAGATAVLSGPTGERNTYTLGARGTVLCIAATASGARAQFAAVLATGNRALFASAAGEALAAALPAPLKAHAAVRKQADAAFDAVLFEGDSDELLALVKEVAQRPGPIVSVQGVAAGAFENGGDEDYALERLLTERSVSVNTAAAGGNANLMTIG

SEQ ID NO: 32409 - protein, 181 aa, Synechococcus sp. CC9311
MSIFVGNLPFRAEQEDIIELFSTYGEVTNCALPLERDTGRKRGFAFVEMSDEAAEASAIEALQGAELMGRPLRINKAEPRGSAPRRDFGGGGGGNYGGGGGGNYGGGGGGNYGGGGGGNYGGGGGGNYGGGGERRSGASGWEDRSYGSGAPPAGGSAYDDGRTRRRRGGADDNSGYGGAEG

SEQ ID NO: 32410 - protein, 549 aa, Shewanella sp. ANA-3
MTQKLPRQAIASEDSLMRIFTVPEDAESTLSIIEQKLSEDLAGFLGDSIAALEKPLSEIETDFQAFEIPSQPRFVSDYTDEIMQNLVAHSVHTAAPSFIGHMTSALPYFVLPLSKMMVGLNQNLVKIETSKAFTPLERQVLGMMHHLIYAQDDDFYRNWMHSANHSLGAFCSGGTVANITALWIARNQLLKADGDFKGVTREGLIKALRHYGFDDLAILVSERGHYSLGKAVDLLGIGRDNIISIPTDGNNKVDVAKMREVAAELANKRIKVMAIVGVAGTTETGNIDPLRELAALASELNCHFHVDAAWGGASLLSNKYRHLLDGIELADSVTIDAHKQMYVPMGAGMVLFKNPEFAHAIAHHAEYILRRGSKDLGSQTLEGSRPGMAMLVHACLQIIGRDGYEILINNSLEKARYFAEQIDAHPDFELVTAPELCLLTYRYVPAEVQAAMQVAIDQGDKVKLARFNELLDGLTQFIQKHQREQGKSFVSRTRIQPARYFRQPTVVFRVVLANPLTSHEILNRVLIEQGEIAALDKEFLPALLAMANE

SEQ ID NO: 32411 - protein, 500 aa, Oryza sativa (indica cultivar-group)
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 32412 - protein, 338 aa, uncultured archaeon GZfos34H10
MATYAHNLFLDSNLGDSGLFPGTKAMEDELIRMIGSLLGNENAHGYISTGGTESNIQAIRAIRNRKRKEGLQEMNIIVPKTAHFSFDKIESLLCLEVKKAGLDDELRVDVNLVKELIDDNTISIVGIAGTTEFGQIDPIKELADIAHNSDIFLHVDAAFGGFVIPFLDAEYQFDFSLDAVSSISVDPHKMGMSTIPAGCILFRDESYLADLAVNTPYLTTNEQCSLIGTRSGAPVAATYAVLKYLGRNGLRAIVDECMLLTRMLVRGAKAMDIYPVIEPVMNVVTLRFPDVDRVAKALEARGWQVSTTRAPKALRLVIMPHVTEDTIEMFLNDLACVT

SEQ ID NO: 32413 - protein, 392 aa, Zea mays
  misc_feature (315)..(315): Xaa can be any naturally occurring amino acid
MRMEGAGGGAGGGGAGAGGCLGMGHGGEAQIKGTHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHPKQQFRVRFPTMSXSGAMDLLERMLVFDPSKRITVDEALCHPYLASLHEVNDEPVCPAPFSFDFEQPSLTEEAIKELIWKESLKFNPDPIH

SEQ ID NO: 32414 - protein, 521 aa, Oceanobacillus iheyensis HTE831
MLPLMITLFYPPACYTPLFLYKMFIIIHIGNIYLCTQSQDKGACNDMYNNVKHFINGEWVESTGNETIDVINPATEEKMGTISAGTEEDLDKAVQAARKAFPSFSNTTREERVKLLDRIADEYEKRKDDFIKVITQELGSPVTFTEKTQYEMGLRHFRETAKILRDFEFTEQREGSFIQKDAIGVSGLITPWNFPTNQLSTKLASAIAAGSTVILKPASQTPYAAMLVAEVFEAAGVPKGVFNLVNGSGSKIGNAISSHPDIDFVSFTGSGGVGTKIMENAAQDITKVSLELGGKSPIIILDDADVKYAARNAITNIAANTGQVCTAGTRALVPASMHDEFIEAIKELLPEFPVGDPQDKNTFTGPQVSEEQWNTVQDYIQKGIDSGATLVAGGTGKPDGLETGFYSKLTVFTDVNRDDTIAQEEIFGPVLSVITYNDLDEAIEIANDTIYGLAGYVVGENPETLTKAAKGIRAGRITVNDGKADFSAPFGGFGQSGIGREWGDYGIEEFLEPKTILGLPN

SEQ ID NO: 32415 - protein, 263 aa, Thermus thermophilus HB8
MLRFAVLGHPVAHSLSPAMHAFALESLGLEGSYEAWDTPLEALPGRLKEVRRAFRGVNLTLPLKEAALAHLDWVSPEAQRIGAVNTVLQVEGRLFGFNTDAPGFLEALKAGGIPLKGPALVLGAGGAGRAVAFALREAGLEVWVWNRTPQRALALAEEFGLRAVPLEKAREARLLVNATRVGLEDPSASPLPAELFPEEGAAVDLVYRPLWTRFLREAKAKGLKVQTGLPMLAWQGALAFRLWTGLLPDPSGMEEAARRALGV

SEQ ID NO: 32416 - protein, 164 aa, Brassica napus
IEIFKNTTFPRICRTSFTRVPNRITKHDRVIWLGDLNYRIALSYTETKTLLDKNAWDTLLNKDQLKIERDAGRVFKGWHEGKIFFAPTYKYSYNSDAYAGDTTKEKKNKRRTPAWCDRILWHGDGIRQLSYVRGESRFSDHRPVCSVFVVNVEVCEGRTGARRQ

SEQ ID NO: 32417 - protein, 84 aa, Oryza sativa
  misc_feature (6)..(6): Xaa can be any naturally occurring amino acid
MSLGYXEKLSYREDEGNVGMPEIFDSPELLHKKIEELASHGARGISTSSGIPDFRGPKGVWTLQRSGKGVPGASLPFKRAVPTL

SEQ ID NO: 32418 - protein, 1306 aa, Mycobacterium tuberculosis CDC1551
MSFVIATPEMLTTAATDLAKIGSTITAANTAAAAVAKVLPASADEVSVAVAALFGTHAQEYQTVSAQVATFHDRFVQTLSAAASSYVAAEAVNVEQSLLAAVNAPTQALFGRPLIGNGADGSPGTGQAGGPGGILYGNGGNGGSGAPGQRGGAGGAAGLIGNGGNGGAGGVGTTGGAGGHGGAGGWLYGNGGAGGFGGAGAVGGNGGAGGTAGLFGVGGAGGAGGNGIAGVTGTSASTPGGSGTAGGAGGIGGNGGAGGAGGVLMGNGGNGGAGGEGGPGGAGGAGASGAHATNLGADGQAGGNGGNGGAGGTGGVGGPGGGHGLLGLGGSHGAGGAGGSGGDGGAPGDGGNGATGTWGHNLRAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIGFNASAPGAAGSPGGNGGNGGPGGAGGEGGAGGLALAASGQNGSQGAGGDGGAGGNGGTPGNGGHGAAGALGVNGGVGGAGGHGGDPGVGGAGGQGGSGSTPGANGAPGNTPTSGGNGGNGGRGADATGFGQTGASGGRGGDGGLVGNGGAGGAGGNGSKGLPGLGRLGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSVFTNNGIGGNGGNGGNAGPSGAGGSGGAGSTFGATGSSSSIHVNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGGTGGDGGRGAHGTLFSSLAGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGGLFPIPGAGGKGGTGGTGGTAHLGPLAIIGQSGQPGQFGSPGADGRGGAGGAGGGGGAGGSF

SEQ ID NO: 32419 - protein, 346 aa, Anabaena variabilis ATCC 29413
MTTVLAIETSCDETAVAIVNNRQVCSSIIASQIPVHQQYGGVVPEVASRAHLETINDAIAQAMDQAQLGWDKIDGIAATCAPGLVGALLVGLTAAKTLAILHNKPFLGVHHLEGHIYATYLSEPTLDPPFLSLLVSGGHTSLIYVKECGRYESLGETRDDAAGEAFDKVARLLKLGYPGGPVIDKLAQTGNSQAFALPEGKVSLAGGGYHPYDGSFSGLKTAVLRLVQQLERDGDPLPIEDISASFQATVAKALTKRAIACALDYGLDTIAVGGGVAANSGLRQHLQAAATANNLRVLFPPLKFCTDNAAMIACAAADHLSRGHLSPITLGVESRLSLSQVMKLYQ

SEQ ID NO: 32420 - protein, 121 aa, Glycine max
  misc_feature (51)..(51): Xaa can be any naturally occurring amino acid
  misc_feature (94)..(94): Xaa can be any naturally occurring amino acid
  misc_feature (103)..(103): Xaa can be any naturally occurring amino acid
MKPNTFIIFIIFFFTITTCSSSTDSVEIIPFKEAYKVQVTVYYESLCPYCXNFIVNYLIDVFNECIHSIAYVKLFPYGNSKVNSNCNITCQHFXQNCLLNTFXACSINTCPDVHDHFPFIF

SEQ ID NO: 32421 - protein, 295 aa, uncultured archaeon GZfos19A5
MLKIEGVYPALITPFTKDDEVDKEGLRRLVEYVIEGGVAGIVPCGTTGESATLSHKEHEKVIDVVVDCSKVPVIAGTGSNNTKEAVEFTKHAADAGADACLLITPYYNKPNVKGLKEHFKRIGDSVEIPLILYNIPSRTGQNVSAGTMVELASEIANIKGVKEASGDLKQVGAIIRSVAERGLDFTVVAGDDFLTLPIMSLGGKGVISVAANVAPREMTEMVDAMLKGEVEKAKEINIRLFSLFEAMFLETNPIPVKKAAEMMGLSAGHVRLPLGALSEGNEVKLRKVLEGLGMV

SEQ ID NO: 32422 - protein, 272 aa, Frankia sp. EAN1pec
MARIIDKDTRLCMSLAGRPGNFGTRFHNFLYDELGLNFVYKAFTTDDLCSAIGGIRALGIRGCAVSMPFKEASIELVDELADSAAAIQSINTIVNETGRLLAYNTDYIAVSRLLAQYQVSPDHTFALRGSGGMAKAVACAIRDAGFRSGCVVARNEATGRALAEMYGYEWRADLGSLRPALLVNVTPIGMSGGPEAADLAFELAAVDKAEVVFDVVAVPAETPLIRCARERGRTVITGVEVIALQALEQFVLYTGVRPDDDLVRRAAAFARS

SEQ ID NO: 32423 - protein, 336 aa, Sulfolobus tokodaii str. 7
MNVLGIESTAHTFGVGIVSDDDSEIRILSNERDTFVPKQGGMKPSDLGRHHSEVAPEVLQKALIKANLSIRDINYIAVSLGPGIGPALRVGATIARALSLKYDIKLVPVNHGIAHIEIGRFTTRSKDPLILYLSGGNTIITTYLDGKYRIFGETLDIALGNMLDTFVREVGLAPPYIVNGVHQIDLCANKGGNFIELPYIVKGQDMSYSGLLTAALRATKNNRLEDVCYSVREVAFDMLLEATERALALTGKKEILVVGGVAASVSLKTKLYNLAKDWNVEVKIVPPEYSGDNGAMIAFTGLLEARHGVTIPVEKSIIRPRWRVDQVDVTWRLSEN

SEQ ID NO: 32424 - protein, 572 aa, Zea mays
MTRALQRSGSNSLASLLRAEPADDVLPDWKPTERDGRRRLRRRRSCLRLPLGAAGGCRVCACDEMDSSAAAPRRRTPGNDEDEDGAAVQCFAWKKGDAAAARGPSSGAGGAGAVVVTEAAAAAAAASLAVLPDDVMEMVLCRLPFASLLAARCVCRRWKDLTVAPQFLRMRREEETGERRAPWLFLFSVDGDVGWGAAPAPAVHALDVAAHRWRRVGAAGLKGRFLFSVAGVGDDLYVVGGRSGGSDASKVKTHKGVLVFSPPTGSWRKAAPMRSPRSRPVLGVFEMSASCSILHTRVEKNVRRGKSRLGGASAVYEDPHRLSLRRLRIRDMLDEDTDSTERASYHHGRSAGHEEGKEGQPRLAIVAVGGRGRWDEPLVSGEIYDPVDDKWVEIAGFPTDVGLACSGVVCGRTFYVYCESDTLVAYHLDKGSWAVIQTLRSPPRLRDYAPTLVCCASRLFMLCVSWCDRHEPVSRREKVVRKLFELDLGSLQWTDASAHPDAPMDPHAAFAVGQDRIYAVEMFRIFGKVLDFVTACRVSDAEQKWSRVGRENAATEADSMSCRLKSMAVLHL

SEQ ID NO: 32425 - protein, 2300 aa, Neurospora crassa
MTRNDGGSRYSSIDSAQSSITAKPFPLTPTSSLGSSMTRPLSPSLQAGSSSSNGGHNVSRSASQGARRPAPTRLKTDDGTQFASRSSRDFESSQSQSQPSHTQTRSHSLSQATLQSCSQPQLSLNSQQSQSPSQYHSQQTPTQQQPQQQVSPTGGSRLTQSPTTPSNASIREHRMSELGGYRREMAAMLDTTGGALSRTSSHSQQQPQQPQQQQQQQQQQQGHAAGSVSGTFSNLSQYAPYLGGNNGGGMSMGSFLNDSTDNLSVISQLSPGIRPMTARPSQASAGSMEFPDSAYYDDERRPSIASITTTASSQGSRTSKTRGGLQKLQQFFGDRDDWPGRDSSEISLPQPSHSGPMSTGKEHRSHSYSLPGSGRSHRDRNYSNATDHHPSTFGSVSTVGGRDRDASPVPSRPRTPVPAPEVVPFLYQEADDIARYGEAPVRTSLTGPDRDRYIDSSQNPPKTSSSARSGHSIVHLPGHHKHNKSNEDPRALKPSLSREDSAASFARDFRNGSSSMMGTRSRAQSPAPSWTGTSRGLKANSISDGTSSPAPSHKKGILGRFRRHNKDKEDGSSLRSGSNHTLVHRPSRQDLTRAAESTYPASVYVSDPSEQREVPVRPGYVRQTTAPGFTTKLFTSKKSSSAKQPQDDMDEDIGPTDMHMGGGTVYHLDTNLNDMEGILTKPQPMTPLDNSISMRRESEKMIVPITTDPEGAWAAPDSWAVRDNKKSLAPQVNEDLCSRQPSEEKEKKSNYYIRVFRSDSTWTTLTLPLTATAEDVIMGVAKKTYLPPGAQDSYSLLIKKHDLFRVLNSAEQPLRIQKRLFQQIGYQEKDGIDEIGREDNSYICRWVFLKEKEADMHLLSPDINFRNQKLNHVDLSGRNLITIPVPLYRKAAEIVSLNLSRNLSLDVPRDFIQACTALRDIKYNNNEAQALPKSFATASKLTYLDVSNNRLQDLDHSELSKLTGLLKVNLANNCLRSLPPTLGAYKSLRTLNISSNFLDVFPSFICELETIVDLDLSFNSINNLPDNLMKLRNLEKFVITNNRLSGPISESVRDLVSLRELDIRYNQISTIDVLSDLPRLEILSADHNQISKFSGSFERLRSLKLNSNPIVKFEVKAPVPIPQILNLSNAQLASIDESIDNLMNLERLILDSNYFVSLPNQIGNLKKLDHLSMANNHLGELPPEIGCLTELRTLDVHGNNMRKLPNEIWWANKLEHLNASSNILTEFPKPASRAPQAPGEASPSPGAYPFPNANKNGLLSRTPSMDDLNGDASRRPSQASSTLLGVAVSPVPSGPDNRKSSMVSLYGKGGRKTSVVSRSTTQSSTGVITPSNGPRKDSSLSYRFTHTFSGSLKNLYLADNQLDDDVFEELKHLPELRVLNLSCNDLSDMPQGTIRSWPQLVELYLSGNELTSLPAEDFLEEHCLLQTLHINGNKFINLPAEISRAKKLQVLDCSSNNLKYNVTNVPYDWNWNFNRDLRYLNLSGNKRLEIKNNYRQPQSYRDDDFADTDFSKLTNLRVLGLMEVTHTLPNIPDQTEDRRVRTSEMKAGAYLPYGMADTLGKNEHLSLFDLVVPRLGSVETDTLVALFDGKELSTGGSKIAKFLYEEFSRLFILELEKVKGKPNENPADALRRTFLSVNKLLMSLSNSADERGLDSHPSRNYAHTVLTKEDLNSGCVATVAYLSELKLYVANVGDVQGMLIQANGSFKMLTKKHDPADPVERSRIRNAGGWVSRNGRLNDVLNVSRAFGYTELLPAVQAAPDITEHTIDDKDETVLIASKELWEHLRPELIVDVARECRSDLMKASQKLRDLAIAYGSTNKLLIMMIGVANLKQRQAQQFKGQLNATFSMPQDDPSHVPPSGNKRRKVRAEGPLDSNLMRLNAEVPPPTGQLSIVFTDIKNSTQLWENYPEAMRLAIKLHNEVMRRQLRMIGGFEVKTEGDAFMVSFPTATSALLWCFAVQMKLLTVDWPPEVLSNSSCQPIYDRNNNLITRGLSVRMGAHWGEPLAERDPVTRRMDYYGPMVNKASRISAVADGGQITASSDFITEIHRCLETYKESVDVDEDSLEDDATAKAIRAELRALSSQGFEVKDMGEKKLKGLENPELVYSVYPHALVGRTEQHHAHTESTQNQAALQPYGALATPKPATMDPDSEIQFEPETIWALWRVALRLEMLCSTLEEPNARGLQAPETELLERMKQRAGEVTDHFLLNFMEHQISRIETCITSLAVRHIAIGSGPITKLNDLRAPMNDVLSTLKEQMDELARYKAKYGSLDQAETDDATDNNSSGDVDTLDGSDTEQE

SEQ ID NO: 32426 - protein, 203 aa, Coccidioides immitis RS
MASRGGSRGRGFGTGANRGGFSARGGRGGMQQSFGPPTTVLEMGSFMHACEGEMVCESINPKIPYFNAPIYLENKTPVGKVDEVLGPINQVYFTIKPQEGIVATSFKPGDKFYIGGDKLLPLEKFLPKPKPPPGVSKPKKAAGTGRGGVRGGRGGARGGRGAPRGRGGFGGRGGGGARGGRGGGFSSRGGPRGGSRGGFRGRG

SEQ ID NO: 32427 - protein, 759 aa, Oryza sativa (indica cultivar-group)
MESMADGSLILCCNAHTTDVSTALRFDYATLTLGSLKLLGDAHLKNGTIRLSRDLPVPNSGAGRALYATPVALRGGFSTQFAFTVATLNADSVGGGLAFVLASDGVTLGDAGPYIGVSAASDVAAVEFDTLMDVQFGDVNGNHVGLDLRSMVSAAVADLDGVGVELTSGRTVNAWIEYSPKSGMEVFVSYSPKRPAEPVLSAPLDLGEYVKGDAFVGFSASTQGSTEMHAVEWWTFSTPTSSSSSPSKPSPRMATPSSPPPEAPVSSAAPPPVSLNPMLPSPPQLPGVSTTTPSPPASTVSMPPTSSVAVASAPANSTAGISNAGSPHPPAHAAVAGAATAGAFVAVSFAGFALWALARRARARRRGTTALAAVADKRDSLASAAALARSPREFTYKELSAATRGFDASRVIGNGAFGTVYKGIIPDTGAMVAVKRCTNASADGAQARSEFLSELSIIAGLRHRNLLRLQGWCHEKGEILLVYDYMRNGSLDKALFDASSPVLPWSHRREILAGVASALAYLHHECERRVIHRDVKSSNVMLDDAYRARLGDFGLARQAEHGESPDATAAAGTMGYLAPEYLLTGRATEATDVFSFGALVLEVACGRRPIGATEGRCNNLVEWVWSLHGAGQVLDAVDARLRGEYDEAEMRRAMLVGLACSSPEPALRPGMRAVVQMLGGEADPPFVPAARPSMSFSANHQLLLSLQDSVSDYNALGLNDLSDDSSSDSLSSSSLTSTLRKGGHDIASFSSAAAGDAAR

SEQ ID NO: 32428 - protein, 570 aa, Corynebacterium efficiens YS-314
MANVADVSHDTSFKGTGVVGGVRYARAVWITPRPALPTAGAEIPEDGRENEQSRFTVAADTVSSRLLARSESVTGAASEVLKATAGMVDDRGWRRAVAKNIKGGHPAEYATVLATDKFIEMFEKAGGIIAERITDLRDIRDRVIAELRGEPEPGLPAVDGQVILFAEDLSPADTAALDTDLFIGLVTELGGPTSHTAIIARQLNVPCIVAAGAGIKRISSGTKVLIDGSLGTVLVNPDEDMALAQVEESRARAAKIAQWTGPAQTRDGHRVQLLANVQDGATARTASTTVAEGIGLFRTELCFLSSTEEPSVEEQADIYARVLEAFPESKVVVRTLDAGSDKPVPFTSMPEEMNPSLGVRGLRIAFDNEGLLTRQLDAIARAATELGRDDTAPTWVMAPMVATVGEAKWFARLCRERGLIPGAMIEVPAAALMADKIMPHLDFVSIGTNDLTQYAMAADRMAPSLASLTDPWQPAVLRLIKMTCDEGQRQDVPVGICGEAAADPLLAVVLTGLGVNSLSAASTALAGVGAQLAEVDLATCRQAAVAALDAEDALRAREAVRAAIAAGQPG

SEQ ID NO: 32429 - protein, 150 aa, Brassica napus
MVECSVCRSKLVSRAYDDHKIRVTSKQRVLNVLLVVGDCMFVGLQPILVYMSKVDGKFNFSPISVNFLTEIAKAVFAIVMLLIQAKHQKVGEKPLLSVSTFVQAARNNVLLAVPALLYAINNYLKFTMQLYFNPATVKMLSNLKVLVIAL

SEQ ID NO: 32430 - protein, 431 aa, Corynebacterium efficiens YS-314
MLVTSTWGWTVHGDGRKIEPGAVVAPRERLSWGRTIGIGMQHVVAMFGATLLVPTLTGFPVNTTLLFSGLGTIFFLLITRNRLPSYLGSSFAFIAPLTATQAQGISVQIGGVLVSGLVLMGIGFLVKAAGRRVIDAVMPPTVTGAIVALIGLNLAPTAASNYQAQPFVATVTLMVILLATVAGRGMVARLGILIGVVVGWVFAALTDNLAEGSVEAISSASWIGLPQFHTPEFQLSAILVTLPVVIVLVAENIGHVKAVSEMTGENLDDLAGNALIADGLATSVAGGFGGSGTTTYAENIGVMAATRVYSTAAYWVAAFTAIALAFIPKFGALIFTIPVGVLGGATLVLYGLIGMLGIRIWQDNRVNFNNPVNLTMAAVALVAGIGNLTLTIFGVTLEGIAWGSVGIIVLYPLMKKLYVTLGEGKGAKFYN

SEQ ID NO: 32431 - protein, 345 aa, Oryza sativa (japonica cultivar-group)
MGSRAAGSVLLRHLCPRVSSSTSAAAHAHAQRPPLAGAGGGGVALWARLLSTSAAAAKEETAASKENTGSTAAAKAEATKAAKEGPASATASPVASSYWGIEASKLASKDGVEWKWSCFRPWETYSPDTTIDLKKHHEPKVLLDKVAYWTVKALRVPTDIFFQRRYGCRAMMLETVAAVPGMVGGMLLHLRSLRRFEHSGGWIRALLEEAENERMHLMTFMEVAKPRWYERALVLAVQGVFFNAYFLGYLLSPKLAHRVVGYLEEEAIHSYTEYLKDIEAGKIENVPAPPIAIDYWRLPAGATLKDVVVVVRADEAHHRDVNHFASDVHFQGMDLKDIPAPLDYH

SEQ ID NO: 32432 - protein, 549 aa, Bacteroides fragilis YCH46
MQLYERTLGQWLEHWAETTPDKEYIVYSDRNLRFTWKQFNKRVDDMAKGLIAIGVERGTHVGIWAANVPDWLTLLYACAKIGAVYVTVNTNYKQAELEYLCENSDMHTLCIVNGEKDSDFVQMTYTMLPELKTCERGHLKSERFPYMKNVIYVGQEKHRGMYNTQEILLLGDNIEDTELNELKSQVDCHDVVNMQYTSGTTGFPKGVMLTHYNISNNGFLTGEHMKFTGNDKLCCCVPLFHCFGVVLATMNCLTHGCTQVMVERFDPLIVLASIHKEKCTALYGVPTMFIAELNHPMFDMFDMSSLRTGIMAGSLCPVELMKQVEEKMYMKVTSVYGLTEAAPGMTATRIDDPFDVRCNTVGRDFEFTEVKVLDPETGEECPVGVQGEMCNRGYNTMKGYYKNPQATAEVIDKNNFLHSGDLGIKDEDGNYRITGRIKDMIIRGGENIYPREIEEFLYKLDGVKDVQVSGIPSKKYGEAVGAFIILHEGVTMQASDVQDFCRNKISRYKIPKYIFFIDEFPMTGSGKIQKFKLKDLGLKLCEEQGIQII

SEQ ID NO: 32433 - protein, 168 aa, Triticum aestivum
MKGGRKNLRRACEEGTAVTLAEGESIMQVVTLRGSNLIEVTDGEGVKSLALFPAKFQKSFWIKNGNFVVVDASGRDEALESGSKIACVVSRVLFHDQVRALEKSGQWPAIFKSTPNGWATGPQGTTSQAEEEQNSDEDVDDDMPPLEANTNRNRPFDVHSDTESDSDS

SEQ ID NO: 32434 - protein, 327 aa, Anabaena variabilis ATCC 29413
MAETLFFNALREAIDEEMARDSSVFVLGEDVGHYGGSYKVTKDLYKKYGELRILDTPIAENSFTGMAVGAAMTGLRPIIEGMNMGFLLLAFNQISNNAGMLRYTSGGNFKIPLVIRGPGGVGRQLGAEHSQRLETYFQAVPGLKIVTCSTPYNAKGLLKSAIRDDNPVLFFEHVLLYNLKEDLPEKEYYLPLDKAEIVRSGKDVTILTYSRMRHHVTQAVKALEKQGYDPEVIDLISLKPLDLETIGASIRKTHKVIIVEEAMRTGGIAAELIASINDRFFDELDAPVLRLSSQDIPTPYNGTLERLTIVQPEQIVEAVQKMIALRV

SEQ ID NO: 32435 - protein, 540 aa, Nostoc sp. PCC 7120; identical to SEQ ID NO: 1492

SEQ ID NO: 32436 - protein, 691 aa, Frankia sp. EAN1pec
MACRTATVNSRGGLHARPAALFVRAAAQQAVPVRIRKGDGPAVNAASMLSVLALGAMYGTVVTLEADGERAEEALDALAAILAHDQDAADSGQGDGRVGSASASDKALDETGGTGRSRATADVFVGLGVSPGLVTGPAFRMARQPRLPDPRLVLDPDEEAAAAARVLRNVASDLRAHAAATRLSAASDIVTAQAMMAEDPVLLDEVGMRVRSGLDAVHAIDAALADQRRQLEGAGGYHAERAADIDDIRHRAVAALLGLPAPGLPAPGFPFVLVAEDLAPADTATLDTDLVLALVTERGGPTSHTAILARALGLPAVVSCPGAMALDDGTPVRVDGTTGEVHVGVGVDVEADGAGHGEAIAQDTADVRQPGLWRTTSRAAKAGPARGGPGRTADGRPVQLLLNIGSAKDLRGDVAATAEGVGLFRTEFLFLNRRVAPTPDEQRDAYQAVFRAAGSRKVVVRTLDAGADKPLPFLSLPDEPNPALGVRGYRTVWLRPEVLDTQLGAIADAAAACDADVWVMAPMVSTPPEAEAFAAAARGHGLATTGVMVEVPAAALRAGRMLDTVDFLSVGTNDLGQYTLAADRQSGHLADLLSPWQPALLRLVADCAAAGEASGKPVGVCGEAAADPLLAAVLVGLGVTSLSMSGRSIAAVRDSLAAHTIKECRALAEIVIDADDAERARELATKNARQT

SEQ ID NO: 32437 - protein, 515 aa, Zea mays
MSSHDAKVLQHLVLNLASSVETGAFNIRSFLEEAFRHLGDEHYLLNALLAIRKEVDLMEQDALESKARSDPDKERMEEQINLAEPVKPVPRQITFTPPPSSPELYEASDNDSYDSDRSTRMADNNSNTPFRPTGASPNSGNQSFPPPMWDPQMWQGQGFDPTHPSTFSTPTNHMSNPTWSQGANDPSTYTFRSPWNPFFGMINPGGPPLQPSFGQPQFAPPIPSPQGSTQVPNQTDPITFESEAEHSVQEVNSPTKPSDTPITFRRTKEQNFKPAEDLLLCKTWLEISSDPVISTGQRKEGLWARIEKRYNELRGEFPMRLNRALSSRWDKIRAETGKFAGFYARVLRENQSGLTDNDKTSKAATLYATSQKKPFHFMHCWTRLKNEPKWDAMVHGSPWRGNAGTEPVRSLTPTGSVNEVHTDEGGSKGKRPLGRDSTKASRKKSMSSASESTDYLSRIHDIQIARLKQSEEKTELKQQNIEFMKEVELKKLEVQSKEIEVQEKKIDDGRQEAKG

SEQ ID NO: 32438 - protein, 346 aa, Frankia sp. EAN1pec
MKVARFYAPGDIRIEEASEPVAGPDEVKVRVRNCSTCGTDVKISKFGHHHIRPPRVMGHEVAGEIVDVGDRVEGWQVGDRVQVIAAIPCGRCDECRRGRMTVCPNQESIGYHYDGGFAEYVTVPGKVLAVDGLNRIPEGVGFAEASVAEPLACVLNGQELARVGAGDDVVIIGSGPIGCLHVRLARSRGAGRVFLVELNRERLDRAAALVEPDASICAAETDAVDAVSKLTDGRGADVVITAAASGAAQEQALLMAARQGRISFFGGLPKDNPVIACDSNLVHYRELTIVGANGSSPAHNARALQHIATGDVPVSDLITHRLALTDVLAGIDIVSRGQGIKITIEP

SEQ ID NO: 32439 - protein, 1118 aa, Cyrtosia septentrionalis
  misc_feature (1003)..(1003): Xaa can be any naturally occurring amino acid
MSFSRPSQSSSASSRSRQSARIIAQTTVDAKLDAEFDAMGTCFDYSQSIRAPPDEQRSEKVTAYLQHIQRGKLIQPFGCLLALDEKTFKVLAFSENAPEMLTMVSFTVPSVGDHPTIVIGTDVRNLFTSPSTAALQKALGFAEVSLLNPILVHCKSSGRPFYAIVHRVTGCLIVDFEPVKPNDVPMTAAGALQSYKLAAKAISKLQSLPSGSMEKLCNTVIEEVFELTGYDRVMVYKFHEDDHGEVFAEITKPGLESYFGLHYPATDIPQAARFLFMKNKVRMICDCHAKHVKVYQDKKLPFDISFCGSTLRAPHSCHLQYMENMNSIASLVMAVVVNEGEEDGGNEAEENSPPHRRKRLWGLVVCHNESPRFVPFPLRYACEFLMQVFAIHVNKEFELENLVKEKKIMRTQTMLCDMLLREFVPLGIITQTPNIMDLVKCDGAAFLYQDKIWRLGVTPSEPQIYDIVHWLSACHMDSTGLSTDNLHEAGYPGISSLGDVVCGMAVARITSKDMLFWFRSPAAASIRWGGAKHDAADKDDGRRMHPRSSFKAFLEVAKVRSLPWGDHEMNAIHSLQLILRDTLNGIENKAIIDPQLNELKLEGMVEVVTNEMVRLIETATVPILAVDADGLINGWNMKIAQLTGLSDDEARGKHLLTIVEDSSIDVVKRMLLLALQGIEEQNVQFQVKTSGVRRDDGPLILVVNACVSRDIHSNVVGACFVAQDVTGQKFILDKFTKIEGDYKAIVQNPCPLIPPIFGTDEFGWCSEWNLAMTKLSGWKRDEVMDKMLLGEVFGINTSCCRMKSQDALVNFSILISNAFSGQETEKSPFSFMNRSGKHVDCLLSVSRKVDVEGNLTGIFCFVLATGHELQQSQPLVQQETVKRMKALAYIRNEIRNPLSGIMYTRKMLVGTNLDEEQSLLLSTGAKCHNQLNRILEDLNLEDIMNSCLELEMNEFNLKDVVLTAVSQVMLPSEGKGVNVVYDLPDGLLSEYVYGDSLRLQQIXADFLLVCVKYSPDGAQVEITANLKKNTLGKSLQLIHVEIRITHAGNGVAEELLSEMFGSKEETSEEGMSLMVCRKLLRLMNGDVCYLREANKSVFILSAELACASKQPKDVKAAV

SEQ ID NO: 32440 - protein, 1676 aa, Streptomyces coelicolor A3(2)
MEALSFDSGARTAFAERLALLYREAGNPPLKRVSEAVVRLQRVDERGRPVRVSAQRISDWRRAKNVPAQFPALAAVLHVLIPQARRARPVPVSAGLYDLVQWQRLWERALADPSGERPGAAAVEEQTPAEAPAALGGVCPYRGLAAYRRQDADWFFGRERSTRALLAQLDATRDTGGLVMLVGASGAGKSSLLNAGLVPALRAGSRDAGCGPPRRVLQLVPGADPLGELTRLVPQLAPVVVAIRETAGRDPGSPGTWNPGDPETEDAVRAAFAAWAASTEAPSGQEGQEEQEEREGRESRSGRKGFAGQNGPESQDGPGRRHGLDRQSEPDRHRPGPADPADPGRRTNQAAGADRARQDDQTERADEAGKTGRTDRDGSTSPSGPDISACRNGETGRTARVSQAVGPDPGDRTDPVAPAGQADGGDRADADDQPGNTGQVDQTEQTGREGQGQENRGGQGGQGGQTDQSGRSGQTGREIRHAPIAPARRPDGDGRADPYGEAGQDGQTGQDAQVGQDAQDRQDAQDRQAGLSDRARQADLGAQDGPASPARQLGRTPSDGETRPDGPPGQANPTARAIRTRPPGTAPPDGREDHAGGPDDPAAARPVVIVDQFEELFTLCADEADRRVFIQLLQAACLPGAHGDPPPVLVTLGVRADFYDRCLRYPELADALQHRHMVLGPLTTAELREAVTAPARAVGMELEPGLAELIIREVSTDGPRGGCDSHAFRAVGEHDAGVLPLLSHALLATWQRRKAGRLTLAGYRAAGGIQGAVAATAERAWSGLDPAARTAARLLLLRLIRLSEDTQATRRRSTRRRLAEEARDPDKTEESLEALVRARLVTLDADTVEITHEALLHAWPRLRDWIDEDRAGNLLRQRLEEDGLAWEESDRDSALLYRGSRLAQADGWAKSADDTFLTRSAVEFLAAAVRLRRRTVMISRAAVSALVVLALLAVGSAVLAWQQRNDAVFEQVVAEADRVQDTDPSLSAQLDLAAHRLRPDDEDVRNRLISIVNAPLATPLLGHTGAVYLTSFSPDGRILATASYDRTVRLWDVSDPGRPQQLGKPLTGHTSWVSTAVFSPDGRTLASASDDGTIRLWDVTDPGRPRPLGAPLDGHGGTVYLLAFSPDGRTLASAHDDHAVRLWNVADRRAPEALDTLTGSTGAVRSVAFSPDGDTLASGGDDDKVRLWDVSDPRRPEPAGAPLAGHSGLVHSVAFSPDGHTLASGSADDTVQLWDVTDPAGAKPVGAPLTGHSGPVWAVAFSPDGAMLAVSSADSTASLWNVSDPAYPSQVGVPLAGGSGEMYALGFSPDGHTLATGSGDSKVRLWSLPTSEMIGRIGAFRPDGHVLATAARDGRVRLWDVTDPGRPVSLSAPFEPGDGDIRSLVFSPDGGTLAVLVGGRALQLWDVTDPAGPTAHGPPVALSTRYAGPDTLAFSPDGRTLATAHDDRTIQLWNADDPSRPRRLGKPLAGHSGYVNTLAFSPDGRTLASGGADDAVRLWDVTDPAHATRLGAARTGHLGPVNVLAYSPDGHTLASGSDDGTVRLWDVTEPGEGSGGGTTLAGHTDSVVSLTFSQDGDTLASGANDNTVRLWSVTDPAEAAPIGRAMSPNAKTGNFLSFSPVSHMLGVSSGTDTVRLWSLGVDDAIDRICSATRGVLTEEKWHEYLPRLDYEPPCHQ

SEQ ID NO: 32441 - protein, 388 aa, Petunia axillaris subsp. axillaris
MPNGILKKLPEDLVFLILLTFSVKSLMRFKCISKAFSILIQSTTFINRHVNHEINKEDEFILFKRAIKDEEEEFINILSFFSGHDDVLNPLFPDIDVSYMTSKFNCTFNPLIGPCDGLIALTDSIITIILNPATRNFRVLPPSPFGCPKGYHRSVEGVGFGLDTISNYYKVVRISEVYCEEAGGYPGPKDSKIDVFDLRTDTWKELDHVQLPLIYWLPCSGMLYKQMVHWFATTDMMVILCFDISTEMFRNMKMPDTCCLITHELYYGLVILCESFTLIGYSNPISSIDPARDKMHIWVMMEYGVSESWIMKYTIRPISIKSPLAIWKNNILLLQNRSGILISYDLNSGEAKEFNLHGFPGSLSVIVYKECLTSIPKGSEFSTKVQKF

SEQ ID NO: 32442 - protein, 375 aa, Schizosaccharomyces pombe
MEEEIAALVIDNGSGMCKAGFAGDDAPRAVFPSIVGRPRHHGIMVGMGQKDSYVGDEAQSKRGILTLKYPIEHGIVNNWDDMEKIWHHTFYNELRVAPEEHPCLLTEAPLNPKSNREKMTQIIFETFNAPAFYVAIQAVLSLYASGRTTGIVLDSGDGVTHTVPIYEGYALPHAIMRLDLAGRDLTDYLMKILMERGYTFSTTAEREIVRDIKEKLCYVALDFEQELQTAAQSSSLEKSYELPDGQVITIGNERFRAPEALFQPSALGLENADIHEATYNSIMKCDVDIRKDLYGNVVMSGGTTMYPGIADRMQKEIQALAPSSMKVKIVAPPERKYSVWIGGSILASLSTFQQMWISKQEYDESGPGIVYRKCF

SEQ ID NO: 32443 - protein, 244 aa, Oryza sativa (indica cultivar-group)
MLQTPLLVIGFVVLLVSLAGFVGACFHVAWALWLYLLAMMLLIAFLLGLTAFGFAVTAGGGGTQVPGRPYREYHTSDYSSWLQKHIQDAKYWRPALACVVGSKACPKIANWSPMDYLQHDLTPIQSGCCKPPTACAYSGGVAVGAQDEDCFRWNNAAGILCYGCESCRAGVMEKVREDWHKISVLNVMVLVVLICICACGCCAFRNARRSVSEYPYGVNRMHKIHPRWDYYWWRWWRDRREQLY

SEQ ID NO: 32444 - protein, 389 aa, Petunia axillaris subsp. axillaris
MANGILKKLPEDLVFLILLTFPVKSLLRFKCISKAWSILIQSTTFINRHINRKTNTKAEFILFKRSIKDEEEEFINILSFFSGNDDVLNPLFPDIDVSYMTSKCDCTFTPLIGPCDGLIALTDTIITIVLNPATRNFRVLPPSPFGCPKGYHRSVEGVGFGFDTISYYYKVVRISEVYCEEADGYPGPKDSKIDVCDLSTDSWRELDHVQLPSIYWVPCAGMLYKEMVHWFATTDTSMVILCFDMSTEMFHDMKMPDTCSRITHELYYGLVILCESFTLIGYSNPISSIDPVEDKMHIWVMMEYGVSESWIMKYTIRPLSIESPLAVWKNHILLLQSRSGLLISYDLNSGEAKDLNLHGFPDSLSVKVYKECLTSIPKGSEYSTKVQKF

SEQ ID NO: 32445 - protein, 389 aa, Petunia axillaris subsp. axillaris
MANGILKKLPEDLVFLILLTFPVKSLMRFKCISKSWSFLIQSTGFINRHVNRKTNTKDEFILFKRAIKDEEEEFINILSFFSGYDDVLNPLFPDIDVSYMTSNCNCTFNPLIGPCDGLIALTDTIITILLNPATRNFRLLPPSPFACPKGYHRSIEGVGFGLDTISNYYKVVRISEVYCEEADGYPGPKDSKIDVCDLVTDSWRELDHIQLPLIYWVPCSGMLYMEMVHWFATTDISMVILCFDMSTEVFRNMKMPDTCTRITHELYYGLVILCDSFTLIGYSNPIGSIDSARDKMHIWVMMEYGVSESWIMKYTIKPLSIESPLAVWKNNILLLQSRSGLLISYDLNSGEAKELNLHGFPDSLSVIVYKECLTSIPKGSEFSTEVQIF

SEQ ID NO: 32446 - protein, 479 aa, Schizosaccharomyces pombe 972h-
MTAPSATAFSSATTQPTTEGNASMRKRTIPVVPSVPERKWDPKAPKHIQEQPWTMQNWWRHLNWLHCMLIFGLPMIAIYGVFTTPLQTKTLIFAIIYYAYSGLGITAGYHRLWSHRAYKAKKPLEYFLAAGGAAAFEGSIRWWSRDHRAHHRYTDTDKDPYNVKKGFWYAHVGWMIILQNPRRIGRSDVSDLNSDPFVMFNHRHFLPIASFMAFIFPSLFCGLLWGDYRGGYFYAGVCRLVFVHHATFCVNSLAHLIGSQPFDDTNSARNHFITALVTLGEGNHNYHHAFPNDYRNGLRWYEYDPTKIFIYIASLFGLAYNLNTFPDNEIQKGIVQQKQKVLDRWRAKLNWGIPLEQLPVMEFEDFLEQSKTRPLVLINGVVHDMTGFEHPGGQGLLRSAFGKDATAAFNGGVYDHTNGAHNLLSTYRVAVVRGGMEVEVWKSGAGAQLPMKDTQGQKIVRVGEQITRIQPPIEAAAAN

SEQ ID NO: 32447 - protein, 379 aa, Salinibacter ruber DSM 13855
MPSDSLRVGVLTGGGDCPGINAALRAVTKSLTLQHDAEVLGFLDGFRGVVDRNVEPLHYRDVSGILTRGGTILGASNKADPFNYLPRGGADVSAQVMRTYRTLDLDALVAIGGDGTMSIAHRLTDLGVDIVGVPKTIDNDLVGTDRTVGFDTAVSTATDAIDRIHTTAQSHHRVMIVETMGRYSGWIALHAGVASGTDVILLPEIEYEVETVADVCRDRERSGQRFTIVAVAEGARRKEGDYVVQERGDEYTDSIRLGGISRVLADQLREHLDTSIRTTVLGHMQRGGSPTAYDRTLATTLGTRAATLVAEGTTGVMVAVQNDAFTQVPLDEIAGKTRTVPLDDPLIASGLDVGTSFGVAVSDLSEAASHSKPASPIQP

SEQ ID NO: 32448 - protein, 371 aa, Yersinia pestis KIM
MDYDLIVIGSGSVGSAAGYYASQAGLNVLMIDSAMPPHQAGSHHGETRIMRHAYGEGEKYVPLVLRAQALWDQLAAQTGEKLFQACGVINLGPDNSTFLQNVQRSAQQYDLPVETLNSTQIREKWPVFTVPDNYIAVFEPQSGYLRSELAVKTLIKAVTEAGCGILFNCPVTAIESHQAGVDVVTIDGTYSATKVVVTAGTWVKELLPTLPVTPVRKVFSWHQADGRYSEANHFPAFTVEMPDNILYYGFPAQNDALKLGKHHGGQLIESAAQRKPFGRYAEDGTEVFSFLRHFLPGVGVCLRGEACSYDMSPDEDFIIDTLPEDERVMVVSGLSGHGFKFATALGEVTALFAQDKPSPIDISAFSLARFR

SEQ ID NO: 32449 - protein, 473 aa, Pseudomonas fluorescens Pf-5
MSGQNSHSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYVHYWWPDVPTWASAAVFFVMINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVVLLSLTPWDTLLVTLNASGDAYSGSPFVQVFSMLGSNTAAHILNFVVLTAALSVYNSGTYCNSRMLLGMAEQGDAPKALAKIDKRGVPVMSILASALVTFVAVVLNYLIPQHALELLMSLVVATLVINWAMISYSHFKFRQHMERTGQTSLFKALWYPYGNYVCLAFVVFILGIMLMIPGIQISVYAIPVWVVFMWVCYCIKNKRSAQHALQAASASLK

SEQ ID NO: 32450 - protein, 125 aa, Glycine max
MEIESVKCECCGLKEDCTQDYISEVKSKFDGKWLCGLCSEAVRDEVSHGGKKASSAMDEAVKAHMSFCRKFKSNPAVRVAEGMRQMLRRRSDLSSSSSSSSPSSSKKYTRSTSTSQVGDSSSFHL

SEQ ID NO: 32451 - protein, 91 aa, Triticum aestivum
  misc_feature (62)..(62): Xaa can be any naturally occurring amino acid
MPTVSVCRYRLFSALRTVYTQDEFWALCFDYCLELYDVTSENAIIRKEKHLEEDVEADGYDXVMYKIEVDSNRYDLLCIEGITRSILILTG

SEQ ID NO: 32452 - protein, 335 aa, Oryza sativa (japonica cultivar-group)
MGNCASFTPKWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGGIIGRKKGAVAMYINFSGIRMVFVSCHLAAHENKVEKRNSECQHISHSLFSKNDIQYTKSADITVWLGDLNYRLQGISSIPARKLIEENRQSLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 32453 - protein, 103 aa, Burkholderia xenovorans LB400
MDTQQRIKQIVDDNAVVLFMKGTAQFPMCGFSGRAIQILKACGVGEIKTVNVLEDDEVRQGIKQFSNWPTIPQLYVKGEFIGGSDIMMEMYESGELQQLFAAA

SEQ ID NO: 32454 - protein, 467 aa, Saccharomyces cerevisiae
MGHHHHHHHHHHSSGHIEGRHMGKNVLLLGSGFVAQPVIDTLAANDDINVTVACRTLANAQALAKPSGSKAISLDVTDDSALDKVLADNDVVISLIPYTFHPNVVKSAIRTKTDVVTSSYISPALRELEPEIVKAGITVMNEIGLDPGIDHLYAVKTIDEVHRAGGKLKSFLSYCGGLPAPEDSDNPLGYKFSWSSRGVLLALRNSAKYWKDGKIETVSSEDLMATAKPYFIYPGYAFVCYPNRDSTLFKDLYHIPEAETVIRGTLRYQGFPEFVKALVDMGMLKDDANEIFSKPIAWNEALKQYLGAKSTSKEDLIASIDSKATWKDDEDRERILSGFAWLGLFSDAKITPRGNALDTLCARLEELMQYEDNERDMVVLQHKFGIEWADGTTETRTSTLVDYGKVGGYSSMAATVGYPVAIATKFVLDGTIKGPGLLAPYSPEINDPIMKELKDKYGIYLKEKTVA

SEQ ID NO: 32455 - protein, 352 aa, Cucumis sativus
MGSGNGFYSTSEFNLDAKWLIDPKHLFVGPKIGEGAHAKVYEGKYKNQIVAIKMVGKGDTPERMARREARFAREVAMLSKVRHKNLVKFIGACKEPMMVIVTELLTGGTLRKFLLNLRPRSLELDVAIGFALDIARAMECLHSHGIIHRDLKPENLILTADHKTIKLADFGLAREESVTEMMTAETGTYRWMAPELYSTVTLKHGDKKHYNHKVDAYSFAIVLWELILNRLPFEGMSNLQPAYAAAFKNMRPSAENLPEDLALIVTSCWREDPNTRPNFSQIIQMLLQSLSRISPRSPVIPPRICASENVVMPPESPCTNSLMAVRHGSGEAPHGMIEETPTTSFFCFNKCY

SEQ ID NO: 32456 - protein, 350 aa, Oryza sativa (japonica cultivar-group)
MADESWRTPAIVQELAAAGVEEPPSRYVLGEKDRSDELVAAELPEPIPVVDLSRLAGADEAAKLRAALQNWGFFLLTNHGVETSLMDDVLNLAREFFNQPIERKRKFSNLIDGKNFQVEGYGTDRVVTQDQILDWSDRLFLRVEPKEERNLAFWPDHPESFRDVLNEYASRTKRIRDDIVQAMSKLLGLDEDYFFDRLNKAPALARFNYYPPCPRPDLVFGVRPHSDGSLFTILLVDEDVGGLQIQRDGKWYNVQVTPNTLLINLGDTMEVLCNGIFRSPVHRVVTNAERERISLAMFYSVNDEKDIGPAAGLLDENRPARYRKVSVGEFRAGIIGKFSRRERYIDSLKI

SEQ ID NO: 32457 - protein, 837 aa, Xanthomonas oryzae pv. oryzae KACC10331
MSKTSGSCLCIFRCALHHSGFFLRTRPSSPLGRWPYGASRLNENILWLHELRLADLARVGGKNSSLGEMIGNLAGLGVSVPGGYATTAEAFKDFIAHNDLSKRIFDKLATLDVEDVNALTLAGKEIRGWVIDAPLQPELDRDIRTAYEQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFSLEAKDAKILVEGRAVGAKIGGGVARVVRSLDDMNRVQAGDVLIADMTDPDWEPVMKRASAIVTNRGGRTCHAAIIARELGVPAVVGSGNATDVLSDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGDGADGKPGLKIIMMCELPSNALLADEFLDIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSES

SEQ ID NO: 32458 - protein, 207 aa, Brassica napus
MQVHGNSLFFLSPPPPSLSSNHSRAKPTFPAKMAVSADCRISLSAPSCLRGSSGLTRHIKLGTFCNGELMGKKLNLSQLRSSSTNLSKKKIQMSLTSVAGETKVQETESEKRDPRTVASIILGGGAGTRLFPLTKRRAKPAVPIGGAYRLIDVPMSNCINSGINKVYILTQYNSASLNRHLARAYNSHGVFGDGFVEVLICFPLYPL

SEQ ID NO: 32459 - protein, 478 aa, Synechococcus sp. CC9311
MARSFMPKKSAELMGNEQGNRRVQFILRIAISAALGGFLFGYDTAVINGAVSAIQSTFNASAVNLGLAVSSALLGSAAGALGAGWLADGIGRRRSMWLAAILFVVSALGSALAPHLIDLVIWRVIGGVAVGFASVLAPAYIAEISPSEMRGRTGSLLQLAIVLGIFIALLSDYLLVLSTPDQTSLSALGPMAAWRWMLMSELVPAVIYGAMVLRIPESPRYLVQKGRIEQARLVICQTLGEPTQPVIDRIQFSLGNHKGSSIADLFSRRSLLLPIVWTGILLAIFQQFVGINVIFYYSSSLWESVGFSTTDSLVITVVTSVTNVVTTILAILTIDRLGRRPLLLIGSVVITISLGLMSWAFAGAPIVNGAPVLAGASSWVALMSANVFVFAFGFSWGPVMWVLLGEMFNNRIRALALGLSATVNWLANFVISTTFPVFLETSGPSFAYALYATAAAISFFFVLFMVRETKGLELEDMV

SEQ ID NO: 32460 - protein, 579 aa, Mycobacterium avium 104
MAAVLTPRGPDAGGAWSQGRVALGHRRLKIIDLTEAGAQPMVDSELGLSIAWNGCIYNYKELRSELSGYGYRFFSHSDTEVLIKAYHRWGDDFVSHLFGMFAFAIVERDSGRVLLGRDRLGIKPLYLTEDSHRVRFASTLPALLAGGGVDTRIDPVALHHYMSFHSVVPAPATILRGVRKVPPASLVAIEPDGKRTVTTYWAPDFTRHADRADWSERDWEDAVLSTLRLAVKRRLVADVPVGCLLSGGVDSSLIVGLLAEAGQHGLSTFSIGFESAGGVKGDEFQYSDIVAQRFETNHHQIRIDSARMLPALDGAIGAMSEPMVSHDCVAFYLLSQEVARHVKVVQSGQGADEVFAGYHWYPPMGDPAAATLDGAVAQYRRAFFDRDTAGVAQLVGPGILAPGDPSLRFVTEHFAQAGAETGIDRALRLDTTVMLIDDPVKRVDNMTMAWGLEGRVPFLDHELVELAATCPPEYKIAHEGKGVLKQAARRVIPSEVIDRPKGYFPVPALTHLEGPYLDMVRDALYAPTAKERGLFNTDAVDALLANPNGKLTPLRGNELWQIALLELWLQRHGVTGPVA

SEQ ID NO: 32461 - protein, 295 aa, Glycine max
FGSRQVIKNEDLEELRELGSGTFGTVYHGKWRGTDVAIKRIKKSCFTGRSSEQERLTVEFWREADILSKLHHPNVVAFYGVVQHGPGGTMATVAEYMVDGSLRHVLLRKDRYLDRRKRLIIAMDAAFGMEYLHSKNIVHFDLKCDNLLVNLKDPLRPICKVGDFGLSKIKRNTLVTGGVRGTLPWMAPELLNGSSNKVSEKVDVFSFGIVLWEILTGEEPYANMHYGAIIGGIVNNTLRPIIPSNCDHEWRALMEQCWAPNPAARPSFTEIASRLRIMSAAAASQTKTQGNKASK

SEQ ID NO: 32462 - protein, 208 aa, Wolbachia endosymbiont of Drosophila ananassae
MLGHRGCRLAISHPEIYSMQIRAILSAASELKKEKKIEVEPEIMIPFIMSEKEFILICELAKKESSVISQTQIPASRAGMTSDKAYSIGTMIELPRAALIADKLAKHAEFFSFGTNDLTQTTMGLSRDDSVNFLDSYKKNNIFDNDPFEVLDIEGVGELIKMAIERGKKTRKEIKLGICGEHGADPKSIEFLIESGVDYVSCSPYRVP

SEQ ID NO: 32463 - protein, 623 aa, Coccidioides immitis RS
MDLQPEKGGESPRPEEGEEMKPEGAKAIYDIERRGSDGKLNAIFENPLAQVSRHQLMADVERFCTRYNLMDHIDTFKKGALVSQNPDGALDLPELTEEDKVALRREKTHKWSQPMALFHLTIMCSIAAAVQGMDETVNNGAQRLYLERFNIKPFSDGGRFSQAMTDNLTGLIVGAPYLACAILGCWLTEPMNRYTARRGTIFITCMIAALASVWEGLANSWVNLFLARFFLGLGIGSKSSTVPIYAAECAPAPIRGALVMMWQMWTAFGIMLGNIMGVAFGGLEPDLAWRLMLGSTVVLPLIVCAQVYYCPESPRWLIEHNKIEKAFESFLILRPTELQAARDLYYAYVGVEIERKINRGKGFFSMLWELFTVPRNARATLASTIVMWLQQFCGVNIIAYYSTTIFVDSGYSMSSALLASMGTGILNWVFAIPAFLTIDTWGRRNLLLFTLPWLALFLFWSGFSFWIEPDDPQSKTRLGMVTAGMYLFEVFYSPGEGPVPFTYSAEAFPLHVREVGMSWATAVTWCFNFIISFTWPHLRSAFKPQGAFAWYAAWCLVGWVLVLLFLPETKALTLEELDQVFSVPTGKHAMYQLKNCVWHFRTWVLRQKLEPLPKFYTHADKLG

SEQ ID NO: 32464 - protein, 182 aa, Coccidioides immitis RS
MAERPGILAPFHIISYGTLLGTQTFQTFVGGIIAFKTLPRPQFAALQSSIFPVYFGLQTLLPLVVAATYPGEQSFGGFGPSSISGVLAEGNRLSTLLPIAVTFVSGLANMLALEPAASKIKTERQRQESIDGKKYYDPGPHSKEMMRLNKSFGRIHGISTLVNLAGLAATLYYGKTLAGRLV

SEQ ID NO: 32465 - protein, 465 aa, Synechococcus sp. CC9311
MRTEWVSARKGQANVSQMHYARKGVVTEEMAYVAKIENLPESLVMEEVARGRMIIPANVNHTNLEPMAIGIASKCKVNANIGASPNASDAAEEVNKLKLAVKYGADTVMDLSTGGVNLDEVRTSIIGASSVPIGTVPVYQALESVHGSIEKLDEDDFLHIIEKHCQQGVDYQTIHAGLLIEHLPKVKGRLTGIVSRGGGILAQWMLYHHRQNPLFTRFDDICEIFKRYDCTFSLGDSLRPGCQHDASDAAQLAELKTLGDLTRRAWKHDVQVMVEGPGHVPLDQIEFNVKKQMEECNEAPFYVLGPLVTDIAPGYDHITSAIGAAMAGWHGTAMLCYVTPKEHLGLPNAEDVREGLIAYKIAAHAADIARHRPGARDRDDELSRARYAFDWNKQFELSLDPERAKEYHDETLPADIYKQAEFCSMCGPKHCPMQTKITDADLDGLEQVLKSQGAAELVGVKQDKL

SEQ ID NO: 32466 - protein, 439 aa, Staphylococcus epidermidis ATCC 12228
MDIKMPKLGESVHEGTIEQWLVSVGDHVDEYEPLCEVITDKVTAEVPSTISGTITELVVEEGQTVNINTVICKIDSENGQNQTESANEFKEEQNQHSQSNVNVSQFENNPKTHESEVHTTSSRANNNGRFSPVVFKLASEHDIDLTQVKGTGFEGRVTKKDIQNIINNPNDQEKEKEFKQTDKKDHSMNHGDFLHQSSTKNEDSPLSNERVVPVKGIRKAIAQNMVTSVSEIPHGWMMVEADATNLVQTRNYHKAQFKKNEGYNLTFFAFFVKAVAEALKANPLLNSTWQGDEIVIHKDINISIAVADDDKLYVPVIKNADEKSIKGIAREINDLATKARLGKLAQSDMQNGTFTVNNTGSFGSVSSMGIINHPQAAILQVESVVKKPVVIDDMIAIRNMVNLCISIDHRILDGVQTGKFMNLVKKKIEQYSIENTSIY

SEQ ID NO: 32467 - protein, 327 aa, Staphylococcus epidermidis ATCC 12228
MTKLSYLEAIQNAQDLALNHFSNAFILGEDVGKKGGVFGTTKGLQSKYGDERVIDTPLAESNIIGTAIGAAMLGKRPIAEIQFADFILPATNQIISEAAKMRYRSNNDWNCPLTIRAPFGGGVHGGLYHSQSVESIFASTPGLTIVIPSSPYDAKGLLLSSIESNDPVLYFEHKKAYRFLKEEVPETYYTVPLGKADVKRPGEDITVFCYGLMVNYCLQAADILANDGIDAEVVDLRTVYPLDKATIIERSQRTGKVLLVTEDNLEGSIMSEVSAIIAENCLFDLDAPIMRLAAPDVPSMPFSPTLENEIMMNPEKIQDKMRELAQF

SEQ ID NO: 32468 - protein, 129 aa, Shigella flexneri 2a str. 2457T
MKKIIETQRAPGAIGPYVQGVDLGSMVFTSGQIPVCPQTGEIPADVQDQARLSLENVKAIVVAAGLSVGDIIKMTVFITDLNDFATINEVYKQFFDEHQATYPTRSCVQVARLPKDVKLEIEAIAVRSA

SEQ ID NO: 32469 - protein, 410 aa, Neurospora crassa
MPSWVTNMGRRTLGIVLLLVVVFLWTVSNFLASVMFADGSYNKPFFLLYVNISMFALALIPMGIRHVMQYGWPASKRQLVEAWYEIRQGRSYQKVAMVDDEDARAGESLLIDDTGSLKSNKCEQLSLAETFWLSLEFSMLWFAANYFASACLEYTSVGSVTILSSTSSIWTLIFCALAGVEGFTVRKLLGVLASLAGVVLISSLDMSGASDEMRGDFPEKSRTEIAIGDAMAFFSAIVYGVYVTVMKKRAVDEDRMNMTLFFGIVGVLNLVFLWPLFIILHVTGIETFELPPNGTTWAIIWINTISSFFSDIIWAYAMLLTTPLVVTVGLSLTIPLSLIGEMIQYHQYSSWIYWVGAGIVVFSFVFVNNESHEEGNGNGECKANDKEQPTTTEVRNVVGGSSSSDAAIAV

SEQ ID NO: 32470 - protein, 473 aa, Staphylococcus epidermidis ATCC 12228
MSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNAYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEISLLQFMNGSSLELGLTTHAHPSLSEVVMELGLKANGQAIHV

SEQ ID NO: 32471 - protein, 583 aa, Oryza sativa (japonica cultivar-group)
MEEERSRAGGAAVAVDGESLRRPEEEGGRRKKGGWITFPFMAVSLLAFGLSSAGAMGNLVVYLVKEYHVPSVDAAQISTIVSGCISVAPVAGAIVADAFFGCFPVVAVAMVFSVLALVVFTLTASVRGLRPAACVPGATACEAATAGQMAVLYAGVFLLCVSSAGARFNQATMGADQFDAAADRDVFFNWYFIFFYGSAVLGSTVLVYVQDAVSWELGFGLAATIAAAGLAALLLGARYYRRPAARGSPFTGIARVVVAAARKRKIDVAAAAAASGDLKFYYGPRSGDGDDDGGKPSDDNNFAPSDSFSFLNRAAVITDGDVDAADAAAPLRPWRVCTVRQVEDLKAVLRILPLWSSSIFLSISIGVQLNFTVLQALAMDRAIGRFHVPAASMVVSSFVAVVVSLGLIDRALLPLWRALTGGRRAPTPLQRIGVGHVLTVLSMAASAAVERRRLATVRAHGEAARDDPAWVSPLPAAWLVLPFALSGAGEAFHFPAQVTLYYQEFPPSLKNTASGMVAMIVALGFYLSTALVDAVRRATAWLPDNMNASRLENLYWLLAVLVAINFGYYLACAKLYKYQNFGK

SEQ ID NO: 32472 - protein, 451 aa, Schizosaccharomyces pombe 972h-
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAVGDWW

SEQ ID NO: 32473 - protein, 309 aa, Schizosaccharomyces pombe 972h-
MSYKLDQLTRLPENKKCFDCDAPNPQWASCNLGIFICLDCSGQHRGLGVEKSFVRSITMDNWSERQVKMMEVGGNSNAKTFLSTDPMFSAAGSIREKYNTDIAEDLRQKIRAEVDGVEWVKVDRPKSVSSHASVTSSSTVPTIPSVSKEANDKYFAKLGSINSQRPDDLPPSQGGRYQGFGSSNSVNPNSSARNNGGSFLDQLSSNPVSALSHGWNMFSRSVSQQIQDVQDPETRKDYMNAINNFSSNVQEGAKQSFTQLKSFLDENVYSENPQNTRGTYDAEIDSPYSALAASPPPEDYSKKNFDKHD

SEQ ID NO: 32474 - protein, 664 aa, Sinorhizobium meliloti 1021
MSDRRALANAIRFLTVDVVQKANSGHPGTAMGMADIAEVLWNDFLRHNPANPKWINRDRFVQSNGHGSMLTYSLLHLSGYGLTVQDLKDHRKLHSRTPGHPEYGITAGVETTTGPLGQGFATAAGMALAEKKLAQEFNRDGFPVVDHFTYVFVGDGCLMEGVAQEAASLAGTLKLNKLIAVYDDNRISIDGETPGWFADDTAARFRALGWNVIADVDGHDAEAITAAFDAARRSTDKPTMICCKTIIGYGSPNKQGREEVHGAPLGVEEVARTREHLGWKHEAFVVPDTVMRAWDARPRGERAEAEWNALFTAYEAKHPELAAELTRRTAGRLPDDFDAVVASEAERILAQEPVRQPIRKASNRVLGNLLASVPEVIGGSADVSMSTLAWTGAARSITPDDFSGNFVHYGVREFGMSAMMNGMAAHGGLIPYGACYLVFSDYSRNAVRLSALMGLKTIFLYTHDSIGVGEDGPTHQPCEQLVALRAIPNMSLWRPGSELEALVAWESALKREGPSVIVAARQDGAVFAHRSGDLDGIRRGGYVLQDAGGKPDIVLVATGSEIGLVLEAAAVLEGQGKAVRLVSIPNGNLFAAQDRDYQESVLAFGTPTVFVEAASPLYWYQFLKGPGTVVGVDRFGESAPGPEIYRVMNLTAERIVSEAGQFLC

SEQ ID NO: 32475 - protein, 271 aa, uncultured archaeon GZfos19C7
MKVEDVMTPKVITEDEDVSVTLISRDMDLSGIGSVVITKEDKPVGIVTDRDISIKICATRRTGKVKVKEIMSSPLITIAPEALVEEACELMAANDIRRLSVMRNDELVGIVSVRNILTRAPEHVKKFYPAEGEVVAELLEVGDVMTLKVITEDEATPITKITKDMEVSGIGSVVITSEDKPVGIVTDRDIASKVIMKDKKASEIKAKEIMSSPLITIAPEASVEKGCELLAENNIRRMPVMENNELVGIISVRNILTRAPEHVKKFYPAQG

SEQ ID NO: 32476 - protein, 505 aa, Staphylococcus aureus subsp. aureus MW2
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 32477 - protein, 316 aa, Solibacter usitatus Ellin6076
MSAMDVVILGRIGYDLYSEEPHVPLPQVRRFSRYLGGSSANMAVGLSRLGARAGMVSCLGDDSLSRFLVDFLQAEKVETSHVKTAPGFLPSLCLTEVSPPDRFPQVFYRRDPVDTMLDATDDDLDYAASGTMFVTNGTTLCGSPSRESAYRALERAKNAGCRVVLDVDYRSMSWRKPEEAGLAARLALPFVDVLIGNQLELKLVANVDDLDEATGKLQAAGVPMLVSKLGELGTRVLAGGESVYLPPYSVDVCTTIGAGDGFASGFLYAMLKGLPVAECLHYGNAAAAIVVSRLSCSEAMPVLAEVEEMIRQQRKA

SEQ ID NO: 32478 - protein, 294 aa, Coprinopsis cinerea okayama7#130
MSRYPSNRTENRPNDLAGMEYSKLEYWDDNGKPYLKEYAGSGKLQGKTAIITGGDSGIGRAAAIMFAREGASGITITYLPEEETDAKDAQRLVEESGAKVNLFKADLMDESACEQLVQSHMKVFGKLNILVNNASKQIICKDFAQIDLKKVESTFRSNILQMFAVTKFALPHLKRGAAIINTTSVTAYRGSAGLVDYASTKGAILTFTRSLAQQLAPKGIRVNGVAPGPIITALQAASRPAENMEGLGVGEPLHGRAGQPAECGPSYVFLASSDSNIMTGQVIHINSGEHFGGS

SEQ ID NO: 32479 - protein, 376 aa, Staphylococcus epidermidis ATCC 12228
MMSYLFNNYKRDNIEFVDANQNELIDKDNNVYLDFSSGIGVTNLGFNMEIYQAVYNQLNLIWHSPNLYLSSIQEEVAQKLIGQRDYLAFFCNSGTEANEAAIKLARKATGKSEIIAFKKSFHGRTYGAMSATGQKKITDQFGPVVPGFKFAIFNDFNSFKSLTSNNTAAVIIEIIQGESGVLPADPLFMKQLNEYCKQKDILIIVDEVQTGIGRTGKLYAHEHYQLSPDIITLAKGLGNGLPIGAMLGKKNLGHAFGYGSHGTTFGGNRLSLAAANQTLSIINDADLLNDVQSKGQFLIENLRKSLVNKRNVIEVRGVGLMVGIEVTNDPSQVVREAKRMGLIILTAGKNVIRLLPPLTITKKQLEKGIEILTEII

SEQ ID NO: 32480 - protein, 327 aa, Schizosaccharomyces pombe 972h-
MTSGSPKITNLLTRVKRIIPPLLDTFHKGQAGRVGVFGGCQHYTGAPYYSSMSSMLFGSDQSHIFCEKEAANVIKSYSPDLIVHPFLREKDKAGPEDSVDKCFELIKPMMGRLHAIVIGPGLGRDEWMQEIMAKVIEYARKNDMPMVIDADGLWLIQQRPELVSGYHNVILTPNVIEFKRLCDKLDIKSDGPDACNQLAGKLNLLIIQKGQSDIISDGATAYACSVPGGLKRCGGQGDILTGILATFLAWRHAYLSKEWDTEGNMDAKECLFLAAFGASACTRWCSRLAFKECGRATQSTDLVRHVGKAYNALMEDEIPSVEEKIKD

SEQ ID NO: 32481 - protein, 321 aa, Lyngbya majuscula
MSMPMDVSKKSFKPAKTQKSKTISNDYIKGLQTKHFLLYNVIPTIGTITAIALLWWYPISSVEIGLLIGMWALSMIGMSVGLHRYFAHRAFKTSQTMSVILAILGCMGAQGPVVSWVAVHRRHHEYSDLPGDPHSPNPELLGEGIFGTLRGLWHAHVGWLTNHEYPNPMYYAPELMRDKTISKINRNYVVWIVLGLLIPTILGGIIHGSWIGAVEGLLWGGFVRMFVVDNSILSINSFSHAFGTHPFDSKDQSRNNIWVAIPTFGESWQNNHHTFENSAAIGLKWWQIDLGYCLIWGLEKLGLVWDVKLPTAKMIEAKKLA

SEQ ID NO: 32482 - protein, 400 aa, Oryza sativa (japonica cultivar-group)
LVWILCYEVKRPLLGPKDLPLCINKLPPMIDREPAGSSRHGSNMDPSINIPVNRDAITEEVAAAFAESEVIPERYCRPDEVHDGIVVGHDDDEAYELPVVDMEKLLDPELAEAEIAKLGSACQDWGFFQLVNHGVDEQVVNEMKDSTVKFFSLPLESKRTVEIQDNGFEGFGHHYRRASGKLDWAESVILLTQPIQERNPEMWPTNPSSFRDALDKYSAEMTKLAMRIASIMATDLGVDQEALVGAFRDKQQSMAIHHYPPCRHPDKVIGITPHSDGLGLTLLLQLDDTPGLQIRKDGRWLPVRPRPGTFIINVADILEVLTNGAYKSVEHRVLADAEKGRTTIVTFHEAYVDGMVKPIPEVLKLNGAEARYKSIERIEYIKGNFVALSEGTRFLESLKI

SEQ ID NO: 32483 - protein, 176 aa, Oryza sativa
MRRTTSMTEFSPPDVLAAVVEEEGEDLEAMMMVGQPGGGGGDGAQDWLASFGREGGGGGGGGGAPGQDWLAAYRARAAPARAGLRRNSADYCSVETASFLRSCGLCRRRLGPGRDTFMYKGEAAFCSLECRQQHMTQEEWQDKCGVTSMKKEAPAPPNGRRRSSKTTTSGGTVAAA

SEQ ID NO: 32484 - protein, 825 aa, Chondrus crispus
MIPRSKPDVARPSARIEAYLSTHAFKVLFFAFYGAAVTLMFAWGFKAEFTFEDNFDMPHFNTVRWFIGIARGMGYTLNLNTAFVILLASRLLFTKLRDSPLQLVLPFDAAFPALHIVVGYTIFFAVLVHGSFHFVWLITWDAWTWGLWSFNMSVITGFLLAIVFGTMLVLARPSVRKNNFRLFYAVHIIGATLFFGLLIIHGMFRQVPYTYKWVIPPLILYAIDRFLRRRKVSAVELFLSAENAVLKDGDILELRVPKAFSYQAGQYAEVQVPFINREWHPFTIASAPQDKTMCFYIKALGDWTKELRGAFQARVDGAVTDSLQVNIRGPYGAPAQHVGLYERVVLISGGIGSTPFTSICKDLHHRKVKENATSATGFEPSTSTLLKRIESRVSTAISTLYGVDISNAKDINQEEEEKRVYLANMLNLTAPGSGSSSGETTELEVEMVDASKQADESSSDSDRSTSMESYNVKNMLRKEQDEEYILDDIKNSANARRGNRERLSHLYEGRSKVLEFLHTSRVNLLLLFVLIARIFFICISSIIKADYIMINAEPHAIESGLWIVIVDTVLSIIFAIVLPLTIFLELSYMGSRFFRTVGRTLDFFVFLPLTITSASLGIKALVTERTDEQIVLFLHYIVFLPTLFVLLAVRMYRALGKRTLLTDAPCHCSHRDIVPNVDFVWTVPHENDDEWLRSELEPLADGTELKLHRYVTRAKEVDMEAGSEFITSSNTGRPEWDEIFGKIAAEAPSNSVVGVFFCGPHKMGDSVQSAMRRAEINSNLRGAYLRSTKEKTLMKDLGLPQRGLIKMLMGTGCSVRFVFREENFG

SEQ ID NO: 32485 - protein, 335 aa, Nostoc sp. PCC 7120
MMQVGQKEAEAAALADELRAKAFGITAANVEEMIQERSQLLQGVLPAFNQFCQNNLKIPPEQMFPVLWDLWLPLGMKIAAQHQQLKRPFIQGILGSQGTGKTTMSLVIQLILQHLGYRTLSLSLDDLYKTYSDRLVLLQQDPRLIWRGPPGTHDIDLGLNVLEQIRQGKSPVIVPRFDKSAHAGAGDRTKPDVITGVDILIFEGWFVGVRPIDPSLFNFPPSPILTDEDKAFARDMNLRLNHYLPLWEKLDSLILLYPTDYRCSLEWRKQAEQKMIAAGKTGMSNTQIEEFVNYFWRSLHPELFIQPLSQCAALVDLVVEIHPDHTFGQVYQPNW

SEQ ID NO: 32486 - protein, 197 aa, Aspergillus oryzae
MAEIRRKLVIVGDGACGKTCLLIVFSKGTFPEVYVPTVFENYVADVEVDGKRVELALWDTAGQEDYDRLRPLSYPDSHVILICFAVDSPDSLDNVQEKWISEVLHFCQGLPIILVGCKKDLRNDPKTIEELTKTSQKPVTAEQPCFQGEEVRKKIGAYKYLECSARTNEGVREVFEAATRAALLTKTHKKKKGCTIL

SEQ ID NO: 32487 - protein, 364 aa, Picrophilus torridus DSM 9790
MIETDINDIYGRPLVFPIYQTGSYEIPGGEKFRYSREYNPTVENLNNVIKRLEHGDLANSFSSGMGAITTTLLSILRPGDEAVTHIDTFARSYHFFSEFLRSFGIKTRISRPGTENILEEINKRTKLVFIETLSNPVLRVYDIDEISKACSENGALLICDSTFATPYNLKTLDHGADVVIHSASKFLSGHNDVIAGVAAGSYDLIKRIDDTRRSLGTSMDPNTAFLVERGIKTLDLRMERINENAMKIARFLNESPRVSDVIYPGLESHPDHGIASRLLRGYSGVILFKLKKDFNDFIDKLSNIKAANTLGGLNTIVSNPYTMSHRSLNNDELKILGIDKDYVRLSAGIENPENIIEELNTAIS

SEQ ID NO: 32488 - protein, 1817 aa, Nostoc sp. PCC 7120
MNRQHKHHRCNSVNLLSKQNLLPFLLGIVILLVVVMLWLRLQAEEEIKIQQLIKQQAIATQTELVTQLNTRILALKRIGKHWEMHGNIPQAQWELEAKAYLEDYGGYQAIKLVDPSWQVLRAVSVANNKAAENLEMIPKFPQWTGATSHETTVTRTVNLNQGDRVFFACVPLWMGDKFGGAVLGVFQVKQLFESVLHIAPGYKIRVFDGQELIYDQDRQSSTLPLWQQAVNIDFYGMTWQLQIYPTPELLKDLFSPLPTVVLVAGIFNAGAVTLLIYFAQATKLSNHKIGRINQELADRIEKQTQVEIALRASETRLRELVETVRVIPWEFDLKTQHFTYVGPQVETLLAYPVAQWYEENFWDNHLHTLDRDWAVRFCQEAANKGQNHELEYRMLAADGRVVWLRDVVNVVQVDGTPVMLRGFMFDITDLKRVEETLRLRERALAASSNGIVISDAKLPHYPVIYVNSAFEQITGYKATEVVGRNCRFLLGNDTQQSAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKNHICGQSISTLHKVDEDAALNSAIIAEITKQGRWSGEINFVRQDGSQGICETTIVALQDDQGQSMATISVNRDITERKHAELLLRRSEERFQAFMNHSPTPAWITDIDGTIVYVSETYRRTFQLPTQELIGKNIVDIYPPELTQTFRETIQIVARTRQVMETVESAPCSDGTGRDFLVYKFPISSKPDECLIGCIAIDITERKQAEAALRKSEERWQLVIEGNQDAIWDWNIITNETFRSARWAELIKEQNYQPIADHADCVSRIHPDDYERVMAVKQDCLSRKIPNYVVEYRLRCNDDSYRWVLVHATGQWDEQGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNQHILKMMSQDKAIASANVYTDPLLQTAVPSCCEIGVKSMLAVRTSYQGEPSGAICLHQCGYFRQWTNEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKNKNCCEIIFTIKDTGIGIAPETMDLLFQPFVQADASMTRKYGGTGLGLVISKRLGEMMGGYLWVESRGCVGGNPPPGWQTKNSISSASVATGSTFYFSMTVPVVAHADLETPITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLYDVLASTLGNQPIRASVVPDRSTEINSCLAQQIPLRILLAEDIVVNQKVALLILKKMGYRADVVANGLEVLEALQRQFYDVVLMDVNMPEMDGLKASQIICQTWSPSSRPYIIAMTANAMRGDREACLAAGMDHYISKPLQLEELAKALGKCHPSGSAIEKALEKTSSQNQTFTDISDLKFATIDTKILQALRDMLGGDKVAFAELINCYLTESPKLIQNIDVAINTKDTQGIWKTAHKFKSSSGSVGAVFLAQLCKLLETKGRNNNLEGCVELGSQLRQEYELVQTALHREVNKETS

SEQ ID NO: 32489 - protein, 309 aa, Zea mays
MADAKQQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACFGSPADLALIRMQADSTLPAAQRRNYKNAFHALYRISADEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 32490 - protein, 460 aa, Zea mays
HASAALVTYRPKWEGGEYEGDDDSRFEALLLAMELGAEYVDVELKVADKFMKLISGRKPDNCKLIVSSHNYETTPSSEELANLVAQIQATGADIVKIATTATEIVDVAKMFQILVHCQEKQVPIIGLLMNDRGFISRVLCPKYGGFLTFGSLKKGKESAPAQPTAADLINLYNIRQIGPDTKVFGIIGKPVGHSKSPILHNEAFRSVGFNAVYVPFLVDDLAKFLDTYSSPDFAGFSCTIPHKEAAVRCCDEVDPIARDIGAVNTIVRRPDGKLVGYNTDYVGAISAIEDGIKASESEPTDPDKSPLAGRLFVVIGAGGAGKALAYGAKEKGARVVIANRTFARAQELANLIGGPALTLADLENYHPEEGMILANTTAIGMHPNVNETPLSKQALRSYAVVFDAVYTPKETRLLREAAECGATVVSGLEMFIRQAMGQFEHFTGMPAPDSLMRDIVLTKT

SEQ ID NO: 32491 - protein, 519 aa, Mycobacterium avium 104
MRPFYVTTAITYPNGDPHVGHAYEYIATDAIARFKRLDGFDVRFLTGTDEHGLKMVETAAAEGIGTAELARRNSDVFQRLQERLNISFDRFIRTTDPDHHEASKAIWRRMQAAGDIYLDSYSGWYSVRDERFFVESETKVLDDGTRVAAETGAPLTWTEEQTYFFRLSAYTDKLLAHYEANPDFIAPEVRRNEVVSFVSGGLRDLSISRTSFDWGVKVPDHPDHVMYVWVDALTNYLTGVGYPDTESEMFRRYWPADLHMIGKDIIRFHTVYWPAFLMSAGIELPRRVFAHGFLLNRGEKMSKSVGNIVDPITLVDTFGVDQLRYFLLREVPFGQDGSYTKDAIITRINTDLANELGNLAQRSLSMIAKNLHSVVPEPGDFTGDDRELLQTADGLLPRVRASFDSQAMHLGLEAIWLMLGEANKYFSAQQPWVLRKSESEADQTRFRTVLYVTCEVVRIAALLVQPVMPDSAGKLLDLLGQGQDRRAFDALGARLAPGTVLPPPTGVFPRYQAESEKVD

SEQ ID NO: 32492 - protein, 320 aa, Coprinopsis cinerea okayama7#130
MPGIIRKKCQLKSSDRPYLALGLEGSANKLGAGIIRHEPDGTATVLSNVRHTYITPPGEGFQPRDTALHHREWALKVINDSLEKAGVSMHDLDCICYTKGPGMGAPLQSVALVARTISLLYDKPLVGVNHCVGQMGREITGAKNPIVLYVSGGNTQVIAYSRQCYRIFGETLDIAVGNCLDRFARVINLSNDPSPGYNIEQEAKRGKRLVPLPYATKGMDVSLSGILSSVEALTYDKRYRPDGKPRGPDDTDTITPADLCFSLQETVFAMLVEITERAMAHVGSKEVLIVGGVGCNERLQEMMGIMAEERGGQVFATDER

SEQ ID NO: 32493 - protein, 373 aa, Coprinopsis cinerea okayama7#130
MDSSKAPVKLAKVIKVLGRTGSRGGVTQVRVEFMDDTTRTIIRNVKGPVRENDILALLESEREARQFAYATLLTKSKYLPGVLVLNHGLREVKSKYPLVVVAPATLPEEARNALKALNIPVREIDYLNPKEASTEELDERFADTWTKLRVFELFEYKRVVLLDCDMVVKKNMDDLFDALELLPGHIAAAHVCACNPRKIPSYPKDWIPENCAHTAVKSPTSPPPDVTPSSPRPYHLLNSGLVVLQPSKDTFQIILDHLFYAPAVPTYRFPDQDLLAAVFKGKWKTLPWYYNALRPLRNIHPAMWSDDEVRCVHYILADKPWQSRLMIHDKAFARVNQWWWDSYDAAHKILKESDPAIADFIETYVDYDKEWRP

SEQ ID NO: 32494 - protein, 176 aa, Triticum aestivum
  misc_feature (72)..(72): Xaa can be any naturally occurring amino acid
MAPAVMASSATTVAPFQGLKSTAGLPISCRSGSTGLSSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 32495 - protein, 358 aa, Oryza sativa
  misc_feature (294)..(294): Xaa can be any naturally occurring amino acid
MAGCLWPCVTGGGAAADGAGSLFRSKARGPVEVVRHARELLAFLAENHDACGDKRDVKREHKMVDLAKSIGEMKSILYGNGEADPVDEACSQLTKEFFKENTNSLHLLVVCLPYMDLETQKDVTQVTANLLRQKVDYRMVASDYLEENQDLLDVLMSGYDNMDIAIHYSAILRDCIRHQVAARYVLESQHMKKFFDYIQYPDFNIASDAFKTFKELLTRHRSSAAEFFSNNYDWFFPEFNSKLLSSSNYIIRRQATQLLGDILLDKSNTTAMVRYVSSKDNLIILMNLLREQSXAIQVEAFRVFKLFTCNPKKPPEIVGILVTNKSKILRFLADFTIEKEDQQFEADKAQVVTEISAM

SEQ ID NO: 32496 - protein, 654 aa, Bacteroides fragilis YCH46
MAGVYVPADIYVRYLRLKKEDVLFIGGSDEHGVPITIRAKKEGITPQDVVDRYHFLIKKSFEEFGISFDVYSRTSSKTHHELASDFFKKLYEKGEFIEKTSEQYYDEEAHQFLADRYITGECPHCHSEGAYGDQCEKCGTSLSPTDLINPKSAISGSKPVMKETKHWYLPLDKHETWLRQWILEEHKEWRPNVYGQCKSWLDMGLQPRAVSRDLDWGIPVPVEGAEGKVLYVWFDAPIGYISNTKELLPDSWETWWKDPETRLVHFIGKDNIVFHCIVFPAMLKAEGSYILPDNVPSNEFLNLEGDKISTSRNWAVWLHEYLEDFPGKQDVLRYVLTANAPETKDNDFTWKDFQARNNNELVAVYGNFVNRAMVLTQKYFEGKVPAAGELTDYDKETLKEFSDVKAEVEKLLNVFKFRDAQKEAMNLARIGNKYLADTEPWKLAKTDMERVGTILNISLQLVANLAIAFEPFLPFSSERLRQMLNMDSFDWAELGRNDLLPAGHQLNKPELLFEKIEDATIEAQVQKLLDTKKANEEANYKAKPIRANIEFDDFMKLDIRVGTVLECQKVPKADKLLQFKIDDGLETRTIVSGIAQHYKPEELVGKQVCFIANLAPRKLKGIVSEGMILSAENNDGSLAVVMPGREVKPGSEVK

SEQ ID NO: 32497 - protein, 127 aa, Candidatus Kuenenia stuttgartiensis
MQLLEKLHFNEKGLIPAVIADATDGKALTLCYMNKDAVVKTIETGKIHVFRRSQNRLMLKGETSGHIQSVKRIYFDCEGNSLVFMVEQHVAACHAGYKSCYYREYIPQTNSIQVVEEKVFDPENVYK

SEQ ID NO: 32498 - protein, 534 aa, Aspergillus oryzae
MSVILRRLVHNEAMREDPKEIYGWRVYMLACSACFGGMLFGMETGIIGGVLTMDPFQVKYGLKNLGDIGEANLSANIVSTLQAGCFFGALIASPVADKWGRKTGLISASLIAIVGVIMQVAASGHLEAMYIGRLINGFGVGFASMINPLYVSENAPRAIRGGLTGLYQLFITMGIMLAFWINYGSSLHIKGTAQYMVPLAMQALPALLMLVGMLLCNESPRWLAKQDRWEDARKTLSRVRNLPSTHQYIENEFQDIVNQLEHERQLIGGSGFWDLMKEMWLIPGNRKRAMISIFLMVCQQMTGTNAINYYAPQIFENLGITGTTTGLFATGVYGIVKVVACAVFLVFVADSLGRRRSLLWTSVAQGLAMLYIGLYIRIAPPVEGQPVIPAGYVALVCIFLFAACFQFGWGPVCWIYVSEIPTARLRSLNVAMAAATQWLFNFVVSRAVPNMLATVGANGYGTYIIFACFCFSMGVWVWFFIPETKGLSLEKMDELFGATSSDTHLKTEDVERSASQVEGDHKDEVATETRVERV

SEQ ID NO: 32499 - protein, 111 aa, Anabaena variabilis ATCC 29413
MRHLIKLVLITLLFLISTLTSPASAVDTANGEQIFSVHCAGCHINGSNIIRRGKNLQKKALKKYGMDSLEAVAAIVTNGKNNMSAYKDRLSEQEIQNVAAYVLEQAEKGWR

SEQ ID NO: 32500 - protein, 249 aa, Arabidopsis thaliana
MYPCGYVAQVTNLSPQATEKDVHRFFSHCGIVELVEITGCQGDALTAYVTFRDAYALDMAVLLSGATIVDQTVWISVYGVYLHESNNLRQEEDYSVTVTRSDAFASSPGEAITVAQQVVQTMLAKGYVLSKDAIGKAKALDESQRFSSLVATKLAEISHYLGLTQNIQSSMELVRSADEKYHFSDFTKSAVLVTGTAAVAAATITGKVAAAAATSVVNSRYFANGALWFSDALGRAAKAAAHIGGGGSN

SEQ ID NO: 32501 - protein, 121 aa, Burkholderia xenovorans LB400
MSHDPNCLFCKIAAGAIPSTKVHEDDEFVAFRDIRPAAETHVLVIPRRHIATLSNCTGSDAPLLGRMLVLTARLADQLGVAYTGGETGFRTVINTGPGGGQEVYHLHAHILAGPRPWQRMG

SEQ ID NO: 32502 - protein, 131 aa, Burkholderia xenovorans LB400
MTQSTQTTPSNAASTTDTLLRLAAIIDSRKGGDPEVSYVSRLFHKGDDAVLKKIGEEATEVVLAAKDARHGGAPKALVGEVADLWFHCLVMLSHFDLSPADVLAELERREGMSGIEEKALRKSRDREQNGD

SEQ ID NO: 32503 - protein, 130 aa, Glycine max
  misc_feature (93)..(93): Xaa can be any naturally occurring amino acid
  misc_feature (102)..(102): Xaa can be any naturally occurring amino acid
IADADATIDYRAGALVHTSFTGLKAMAGFPTMRTNNDITSIASNRGRVQCMQDWPPFGKKMSVTLSYLPDLDDAQLAKEVQYLLMNGWILWLXEFGAEHGFXYRERNRSPGIYHGRYWTMCTLTMTGCTD

SEQ ID NO: 32504 - protein, 136 aa, Burkholderia xenovorans LB400
MVNPSAVNWLDKVRWDANGLVPVIAQEASTNDVLMFAWMNREALAKTVETGRAVYFSRSRQRLWFKGEESGHVQHVHEVRLDCDEDVVLLKVEQVSGIACHTGRHSCFFQKFEGSVEDGDWVAVDAVLKDPEQIYK

SEQ ID NO: 32505 - protein, 340 aa, Agrobacterium tumefaciens str. C58
MPKTSDTEYLSFPILLGDIGGTNARFSILIDSFAEPVHLTTVKTAEYPGIDDAIQQAVLDKTSLQPVSTILAIAGPIEGDEIPLTNCHWVVKPKDMLAKLGLKDVIVINDFEAQALAIAALDDDNREPIGSGKKDMLASRVVLGPGTGLGVAGLVYARHMWFPVPGEGGHIDIGPRSARDYVVFPHIETIEGRVAGEQILCGRGLVNLYRAICKADGIEPVFSDPADITSQGLSGQNAQAKETLSLFSTYLGRVAGDLALIFMAKGGVYLAGGISQKIIPALKSPEFRAAFEDKAPHSALMRTIPTFVVTHPQAALSGLATYARTPADFGLALDGRRWRA

SEQ ID NO: 32506 - protein, 226 aa, Oryza sativa (japonica cultivar-group)
MKLEVMPKQRAMEAEQREEAMEMSGLELWKHEKPASMVVFLPPPPPPPPLVPAAAAAAAAACGEEATLVPPLNFAMVDDGIFRSGFPAAANFRFLKSLNLRSIVYLCPEPYPETNAEFLAKNGIKLHQFGIEGRKEPFVNIPDDKIREALKVVLDVKNQPLLIHCKRGKHRTGCVVGCLRKLQKWCLSSVFDEYQGFAAAKARSTDQRFMELFDISSLKHLTASHC

SEQ ID NO: 32507 - protein, 514 aa, Triticum aestivum
MLVTLTTLLLSLIQQWELILLALVSVVTLLLLTRSRSRCSQKEMKLPPGPAPVPFLGNLHQLGRLPHRTLRDLARLHGPVMQLQLGKAPTVVLSSPDAAWEGLKVHDLDCCTRPVSPGPKRLTYDLKNVAFAPFGSYWRNIRKLLVVELLSGRRVKAAWYARQEQVDKLISTLMRAGGKPVALDEHILSLSDGIIGTVAFGNIYGSDKFTQNNNFQHALDEAAEVLSSSSAEDFFPKAIGRLIDHITGAFARRERIFKQLDAFFEMVIEQHLDPKRTKPDNGGDLVDVLITHWKEHRGKLNFTRDHVKALIFDTFIAGVDTSSVTILWAMSELIRSPRVLSKVQAEIWAVVGRNDRVRSEDVSKLEYLKLVVKETLRLHPPAPLLVPRETMRHIQIGGYDVPAKTRIYVNAWAIGRDPTSWPNHPEEFNPERFEGNEIDFKGEHPQMLPFGTGRRICPGISMGIATVEFTLANMLCCFQWALPDGMEPEDVSMEEEGKINFHRKTPLVLVPTIR

SEQ ID NO: 32508 - protein, 179 aa, Brassica napus
RTRGAGDSRCVISRKGQAYNLSRDHKPDLEAERERILKAGGFIHAGRVNGSLNLARAIGDMEFKQNKFLPTEKQIVTASPDVNTVELCDDDDFLVLACDGIWDCMSSQQFVDFIHEQMNTETKLSVVCEKVLDRCLAPNTAGGEGCDNMTMILVQFKKPVQSTEPSQAEASYNEPSSSN

SEQ ID NO: 32509 - protein, 195 aa, Burkholderia xenovorans LB400
MRLAEVVRNTSETQIRVKINLDGTGQQKLATGVPFLDHMLDQIARHGLFDLEIEAHGDLHIDDHHTVEDTGITLGQAVAKAIGDKKGIRRYGHSYVPLDEALSRVVIDFSGRPGLEFHVPFTRARIGTFDVDLSIEFFRGFVNHAGVTLHIDNLRGLNAHHQMETVFKAFGRALRMATELDERAAGQIPSTKGSL

SEQ ID NO: 32510 - protein, 590 aa, Xanthomonas oryzae pv. oryzae KACC10331
MRFLCLRMLPGDPGPIRTGDLPLRRGTLYPAELRGHGWHCRTIVAIAKPGGGRRSLLKSRATRVVAGLAAARPPLFPGDPMSADLLKTLDLAASNSGTYLGEATWSQASGAGVLQPLNPTTNAVIADVQATTPDDYELIIQRAQAAFKVWRTTPAPRRGEAVRLCGEALRAHKDALGSLVALEMGKSKPEGDGEVQEMIDIADFAVGQSRMLYGYTMHSERPGHRMYEQYQPLGLVGIISAFNFPVAVWAWNAFLAAICGDICIWKPSNKTPLTAIATMKICNAALKDAGFPDIFFLINDAGTSLSEKLVEDTRVPLISFTGSTQVGRVVAEKVAHRLGRCLLELGGNNAIILDETADLKLAIPGIVFGAVGTAGQRCTTTRRLIVHDSIYDNVLATLAKAYKQLDSKIGDPTDPANLMGPLNSQGAVAQFLDSIAQAKAAGGTVEVGGTAIDRPGNFVLPAIVTGLQNSDAVVQHETFAPILYVMKYSTLDEAIELQNGVPQGLSSSIFTQNLKAAEKFLSAAGSDCGIANVNIGTSGAEIGGAFGGEKETGGGRESGSDAWKVYMRRQTNTINYSDSLPLAQGIKFDL

SEQ ID NO: 32511 - protein, 525 aa, Photobacterium sp. SKA34
MTTNIHEQRILILDFGSQYTQLIARRIREIGVYCELWSWDVDEADIREFAPNGIILSGGPESVTEAGSPRAPQYVFEAGVPVFGVCYGMQTMAEQLGGKVAGSNEREFGYAQVKIVEPTHFLEGIQDATAEDGTPLMDVWMSHGDKVVEIPSDFIKVAETETCPFAAMANEEKRFYGVQFHPEVTHTRQGMKLIENFVMNICGCEKLWTSANIIEDAIARIKEQVGDDEVILGLSGGVDSSVVAMLIHRAIGDKLTCVFVDNGLLRLNEGQQVMDMFGDKFGLNIVHVQAEDRFLSALAGIDEPEAKRKKIGHVFVDVFDEESKKLKNAKWLAQGTIYPDVIESAASKTGKAHVIKSHHNVGGLPDDMEMGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 32512 - protein, 825 aa, Caldicellulosiruptor saccharolyticus
MIVKAYIDDFNEITVVLAQMVHSVKKEDFKVFLDDQEIDIEKVEKLMPHSENPFEAETRGYEICEQKGKIRFVLKEGHFDFHRKSTVRPVFVIGDMNNWTISPEWELTYSKLRGRYELIKDLKDIKIGQKFKFAEGASRKLWYPPGYGNDIVIEDYFDREAAFTNMVKITTTKRLWANLKYKVVYKNEYKYARPREILTRNEYFYAGELGARYEPYGTYFRLWAPTAYKVKIQIFDEHENFKFGKEMSRAENGTWDVYLPGDLKNHFYLYEIWHYNYEDDEGYIVYHVPDPYSKASSSNSGKSYIFDPADGLIDGWQADSFVDNIEKQDDAIIYEMHVRDFTIDQSSGIGENLRGKFLGFCQEGYYKEGISTGLLHLKELGVTHVHLLPISDFGSVDDKNPDKRYNWGYDPVLYQCPEYWYSTKSGGIEALKELRTMIKKLHENGIGVVMDVVFNHTYHTKGGKFSIFDKIVPEYFYRVDDYGDYSNATGCGNELATEKPMVRKFILDTIIYWTEEFHIDGFRFDLMGLLTVKQSRQVANEVRKRNPKALVYGEGWVMGNSTCLVEEMATILSSCHQGYSIGLFNDRIRDAIRGDLDGYKTGYVHGNLSDVGRLKQGIKAAIDDFAKEPDECVNYVSCHDNLTLFDKLQKTMVGEDIFWIDRATRLANAIVLTSQGVAFLHGGVEFNRSKGGHPNTYNAGDNINKIDWSLKEKFFDTFKFYCDLINLRRKHIAFRMRSSGEIKKYLRFIPAPDGVVAFIITYPYDEWKKIIVAYNPFKEKKILQLPEGSWYVKANDGIVFPDSFEKEAIGSFEIAPVSLFIAYQK

SEQ ID NO: 32513 - protein, 376 aa, Photobacterium sp. SKA34
MTDKFIKSKAAIAWGPNQPLSVEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPEISLAKISKEAPLEEVCLLGCGVTTGMGAVLNTAKVEEGSTVAVFGLGGIGLAAIIGATMAKASRIIAVDINEEKFELARKLGATDCINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 32514 - protein, 147 aa, Brassica napus
  misc_feature (146)..(146): Xaa can be any naturally occurring amino acid
MCLIMEAAEDHVDGGVLAAPSNFSMVEDGIYRSGFPKPENFGFLTTLNLRSIIYLCPEPYPEENLKFLEANNIKLFQFGIEGKTDPPTLMPKDTVLDALKVLVDVRNHPILIHCKAGKHRTGCLVGCLRKVQRWCLSSVLEEYQKXA

SEQ ID NO: 32515 - protein, 396 aa, Coprinopsis cinerea okayama7#130
MPQGLTCAPPSSNVAGFGTATVTQSDDEQQVHKKDHPHQSISQVPHRPSPGDDYQLLHAIGEGAYGTVAAALHKPTGRQVAIKKVLPFDHTLFCLRTLRELKLLKFFSETCVNENIISILDIIKPPSLEEFKEIYFIQELMQTDLHRVIRTQHLTDDHCQYFVYQTLRALKSIHSADIVHRDLKPANLLLNANCDLKVCDFGLARSVKTSVPAGKEVGLMTEYVATRWYRAPEIMLSFKMYTKAIDIWAVGCILAELLTGRPLFPGRDYSHQLDLILDVIGTPSLDEFYAITSRRSRDYIRALPIRKKRPFPTLFPHASQEAIDFLTKTLTFDPKKRMTVDEALEHPYLAAYHDPEDEPVVTPLSPDYFEFDMHKDDLSKDQLKGAREFDIPSTAA

SEQ ID NO: 32516 - protein, 366 aa, Oryza sativa
  misc_feature (59)..(59): Xaa can be any naturally occurring amino acid
  misc_feature (61)..(61): Xaa can be any naturally occurring amino acid
  misc_feature (77)..(77): Xaa can be any naturally occurring amino acid
MAAVTRAARSRALLLLPRASAAAPHFSTTASSGAAAAAAAPGGRRSARAFDARGGGGVXAXEPAAPPPKRWGLRKLXAFRGVCGALGAAGYSSYAYTLEEVDQKTREFRKAMTTPRPVAEDASEFEKFQAMIYSTAMKAPVAAIEFYMDVRHTIEDGIRGFAEPTSDKLLPDLDPLNQHIFTLVLDLNETLVYSDWLRERGWRTFKRPGVDAFIEHMGKFYEVVVYSDQMPMYVDPVLERLDTKGFITGRLSRPATKYQDGKHYRDLSKLNRNPAQVIYISSHALESCLQPENCVQIKPWKLETDDTQLLDLIPFLEYVAMVRPSDIRTVLASYQGRDVAAEFIERSKEHQRRMQEQKQHGRIWRQ

SEQ ID NO: 32517 - protein, 389 aa, Arabidopsis thaliana
MGGSGNWIRSLISNRKPVNDQQEKLSDKSSKKKWKLWRISSESLASSSFKSRGSYAASSLGSELPSFSADEAFTTAMAALIRAPPRDFLMVKREWASTRIQAAFRAFLARQAFRALKAVVRIQAIFRGRQVRKQAAVTLRCMQALVRVQSRVRAHRRAPSDSLELKDPVKQTEKGWCGSPRSIKEVKTKLQMKQEGAIKRERAMVYALTHQKFRVLSLIVIMSHELFWQSRTCPSPSGRAITHHGLRKSSPGWNWYDDVGTFSRKSSESSVLSEYETVTVRKNNLSSTRVLARPPLLLPPVSSGMSYDSLHDETSTSSTSQSPVAFSSSVLDGGGYYRKPSYMSLTQSTQAKQRQSGLSCNGDARRSAGSDQCTDLYPPGNVWAKSQRS

SEQ ID NO: 32518 - protein, 851 aa, Arabidopsis thaliana
MLSRFNIHQPFKRCKFRFFLRSIGNPDTILVESCSSSSCSSPEPSLVRSDYLTKPSDQDQIFPLNKIIARCVRSGDIDGALRVFHGMRAKNTITWNSLLIGISKDPSRMMEAHQLFDEIPEPDTFSYNIMLSCYVRNVNFEKAQSFFDRMPFKDAASWNTMITGYARRGEMEKARELFYSMMEKNEVSWNAMISGYIECGDLEKASHFFKVAPVRGVVAWTAMITGYMKAKKVELAEAMFKDMTVNKNLVTWNAMISGYVENSRPEDGLKLFRAMLEEGIRPNSSGLSSALLGCTLTSLISMYCKCGELGDAWKLFEVMKKKDVVAWNAMISGYAQHGNADKALCLFREMIDNKIRPDWITFVAVLLACNHAGLVNIGMAYFESMVRDYKVEPQPDHYTCMVDLLGRAGKLEEALKLIRSMPFRPHAAVFGTLLGACRVHKNVELAEFAAEKLLQLNSQNAAGYVQLANIYASKNRWEDVARVRKRMKESNVVKVERVKVPGYSWIEIRNKVHHFRSSDRIHPELDSIHKKLKELEKKMKLAGYKPELEFALHNVEEEQKEKLLLWHSEKLAVAFGCIKLPQGSQIQVFKNLRICASGSRVLDHFPATSRSPPRSQSVTAMEDDVELLLPRYDPNSQAGKREKSRFRFSENVIHLIPLILLLCVAILWLSSYSVNISQSSFFNFACSLSYTANRCFRSFQPSFLPRCLNYKIGAKRKRKYAFLLECSCHSDMLFILLLIWKLMNYLSLLSRYGHNEWSRSTGMVVFNYKDCNNTLQRTEGNRGLGYPEATELAGQFEMTSNIPPAIAHSSLDAGAKVILTTEAVVPATKTRKLSAERSEARRFVHHDTPSS

SEQ ID NO: 32519 - protein, 1499 aa, Candida albicans SC5314
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISLNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 32520 - protein, 305 aa, Arabidopsis thaliana
MEIDFMVELSKSIRDLKLILYGNSEAEPVAEACAQLTQEFFKADTLRRLLTSLPNLNLEARKDATQVVANLQRQQVNSRLIAADYLESNIDLMDFLVDGFENTDMALHYGTMFRECIRHQIVAKYVLDSEHVKKFFYYIQLPNFDIAADAAATFKELLTRHKSTVAEFLIKNEDWFFADYNSKLLESTNYITRRQAIKLLGDILLDRSNSAVMTKYVSSMDNLRILMNLLRESSKTIQIEAFHVFKLFVANQNKPSDIANILVANRNKLLRLLADIKPDKEDERFDADKAQVVREIANLKLRELA

SEQ ID NO: 32521 - protein, 258 aa, Nostoc sp. PCC 7120
MSTALITGASGGIGKAFAQELAARQTNLVLVARSQHKLHQLAQELQQQHKIQVDVIAKDLTEIDAVADVFDITKSKGLTIDCLINNAGFGDYGDFAQSDRTRQIKIIQLNVLALVDLTHRFLPLMRQNRSGSIINVASIAGFQPIPYLSVYAASKAFIVSFSEALWAENRQYGVRVLVTCPGPTETDFFAEANFPQALVETTNKVMSSEEVVLKSLKALENWEPTVIISDTSTQLRSNVARLVPRKTLLSLLAKHFKA

SEQ ID NO: 32522 - protein, 233 aa, Arabidopsis thaliana
MAPNLRIKKACDAMKLLGISETKTRAFLRKLLKTYENNWDFIEEDAYKVLLDAIFDEADAQSTEKNKKEEEKKKKEEEKKSRSVATSRGRRKAPEPLVQDEEDDMDEDEFPLKRRLRSRRGRASSSSSSSSSYNNEDLKTQPEEEDEDDGVTELPPLKRYVRRNGERGLAMTVYNNASPSSSSRLSMEPEEVPPMVLLPAHPMETKVSEASALVILNDEPNIDHKPVISGIVT

SEQ ID NO: 32523 - protein, 147 aa, Oryza sativa (japonica cultivar-group)
MDFKVASFLLLLLIVTCGAAQGQGNDFVVLDLKTTEIGEDASPMYKEQIASTKIPVTLLRSKHSSLCSACENITSEAVNFLSEKQIQDKIRTILHDTCSQTFSFEQKCLETMDSYATLVFAKIAEIKPAAFCKHARGWFCSTYRWFW

SEQ ID NO: 32524 - protein, 910 aa, Oryza sativa (indica cultivar-group)
MSLRRLRIGGGVVVGVPAARTEVVDEPEIGGSARGGSNEYLIFTLGLWGVHLSQNVSAHTSSGKTVVALYAIAMSLRNQQRVIYTSPIKALSNQKYREFKEEFSDVGLMTGDVTIEPMHLVWYERGVVWEESIVMAPKNSRFVFLSATVPNAKEFADWVAKVHKQPCHIVYTDYRPTPLQHYVFPSGGDGLYLVVDEKSKFREDSFQKGLNALVPASENDKKRENGKWQKGLLTGKPSEDSDIFKMVKMIIQRQYDPVILFSFSKRECEFLAMQMAKMDLNDDDEKANIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGSADSLNSAFHLSYNMLLNQIRCEDGDPEKLLRHSFYQFQADRALPDLEKQVKELELERNSMIIEEEENLKSYYDLLQQYKNLKKDVRDIVHSPKYVLPFLQPGRLARVQYSTDEQSTFSIDENITWGVTINFEKVKTHSEDRRPEDSDYTVDVLTRCSVSKDKSGKKTMKIIPLKDRGEPVVISLPLSQIDGLSSIRMHIPKDLLPVEARENTLRKVDEVISRFAKDGIPLLDPEEDMKVQSSSFRKASRRIEALESLFEKHDVHNSPHIKQKLKVLHAKQELSAKIKAIKKTMRSSTALAFKDELKARKRVLRRLGYITSEDVVEVKGKVACEISSADELTLTELMFSGTLKDATVEQMEKLQDAPKPREELDLLFFQLQETARRVANLQLECKIQIDVESFVNSFRPDIMEAVYSWAKGSKFYQIMEMTQVFEGSLIRAIRRLEEVLQQLILASKSIGETQLEAKLEEAVSKIKRDIVFAASLYL

SEQ ID NO: 32525 - protein, 371 aa, Arabidopsis thaliana
MNKNKIDVKIETKKGSMDEWPEPIVRVQSLAESNLSSLPDRYIKPASLRPTTTEDAPTATNIPIIDLEGLFSEEGLSDDVIMARISEACRGWGFFQVVNHGVKPELMDAARENWREFFHMPVNAKETYSNSPRTYEGYGSRLGVEKGASLDWSDYYFLHLLPHHLKDFNKWPSFPPTIREVIDEYGEELVKLSGRIMRVLSTNLGLKEDKFQEAFGGENIGACLRVNYYPKCPRPELALGLSPHSDPGGMTILLPDDQVFGLQVRKDDTWITVKPHPHAFIVNIGDQIQILSNSTYKSVEHRVIVNSDKERVSLAFFYNPKSDIPIQPLQELVSTHNPPLYPPMTFDQYRLFIRTQGPQGKSHVESHISPR

SEQ ID NO: 32526 - protein, 151 aa, Thermus thermophilus HB8
MELLANAVFWTAVLANLTAQTLKLLLYYFLEGRFQWHRFLDTGGMPSTHSATVSALAVSVGLREGFDTSLFAVAAVFAFIVMYDAAGIRRAAGLHAQLLNQLMEELGQVIRLGPQRGPLKELLGHTYLEVAVGALIGGLVALGAYRLFPAA

SEQ ID NO: 32527 - protein, 81 aa, Brassica napus
AGWLGGLGYCENLKTLKLVSCKKIDCGFGLGECLSRSCPALERLHLEKCQLREKDAVKALFKMCEAAREVVFQDCWGLDDD

SEQ ID NO: 32528 - protein, 482 aa, Brucella melitensis 16M
MTTFAELGLSPKVIAAVEAAGYTAPTPIQAGAIPPALERKDVLGIAQTGTGKTASFVLPMLTLLEKGRARARMPRTLILEPTRELAAQVEENFVKYGINHRLNVALLIGGVSFEEQERKLERGADVLIATPGRMLDHFERGKLLLTGVEILVIDEADRMLDMGFIPDIERICKLIPFTRQTLFFSATMPPEITKLTEQFLHSPVRIEVAKASSTAKTVTQRLVKSGKKDWDKRAVLRDLIQSEGDSLKNAIIFCNRKKDVSELFRSLTRHEFDAGALHGDMDQRARMAMLSSFKDGKLRLLVASDVAARGLDIPDVSHVFNFDVPIHAEDYVHRIGRTGRAGRSGKAFTIVTSSDTKYLAAIESMIGEKIEWHDGDLSTLAVSEEADEQPRKGRNARGKGKEKPKEKASKPVAAKTVDPAGQPQPVIENQHRREAIRSSNEERRGKPQTEQHKRRRDRDDDGPAPVGFGNDIPAFMLIPTGV

SEQ ID NO: 32529 - protein, 173 aa, Oryza sativa
  misc_feature (172)..(172): Xaa can be any naturally occurring amino acid
MQAKKQRREAAARRRREQQQQGREQRHHHHHRRRPLLLQPRDERCVSCTTFNILAPIYKRMDSENCRESQYRAYWFSRNEKIIDRLLADCSSIICLQEVWLGNDELVDMYEKRLGDANYSLFKLARTNNRGDGLLTAVNKNYFHVLNYRELLFNDFGDRVAQLLHVESAMPXW

SEQ ID NO: 32530 - protein, 387 aa, Arabidopsis thaliana
MKSRRQNVSVARQTILGRDENFEPIPIDLVIEIFSRSPVKSIARCRCVSKLWASILRLPYFTELYLTKSCARPRLLFACQKHRELFFFSTPQPHNPNESSSPLAASFHMKIPFDGRFNIISPIGGLVFVRYEQILKGRKTPEFVSAICNPSTGQSLTLPKPKTRKRIWGTSHFGYDPIEKQFKVLSMNIGDGVYKEHYVLTLGTENLSWRRIECSIPHVHGSKGICINGVLYYRAKADMFSGTLMIVCFDVRFEKFSYIKILKPTTTLISYNGKLASLVWEGPSYICGKRFEMWVLGDPEKHEWLKHTYELRPRWQNVLGEDLLIFAGMTGTNEIVLSPKYPSHPFYVFYYNLERNTIRRVEIQGMGAFKVNEDYIFLDHVEDVKLI

SEQ ID NO: 32531 - protein, 173 aa, Zea mays
  misc_feature (22)..(22): Xaa can be any naturally occurring amino acid
  misc_feature (117)..(117): Xaa can be any naturally occurring amino acid
  misc_feature (136)..(136): Xaa can be any naturally occurring amino acid
MKCRSDSSGGGDDHRAPAPAAXGVGGGSPVGEPSKKQRTEEPSSSSSMAGECSSSTSSSQALPPPLPEQLPQDAGVGEQPPPGPEAAGGEQARVPDLGEDLVFEVLMRAEARTLAAXACVSRGWRLLARDERLWEXACVREWACTGFSEQMLRSVVLPLGGFRRLHEMYIRPV

SEQ ID NO: 32532 - protein, 498 aa, Anabaena variabilis ATCC 29413
MKTPLNCQNYINGQWLNAATETTLNSHNPANKSEIVATFPRSQADDTDRAVTAARQAYGSWRKVPAPARAEYIFRVGELLLQHKEELAQLISREMGKPITEARGDVQEGVDCAFYSAGEGRRLFGQTTPSEMPNKFAMTVRMPIGVCALITPWNFPVAIPCWKAMPALVCGNTVILKPAEDTPACATKLIEIFAAAGLPPGVINLVHGVGEEAGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIVTEGQLKQGYFFQPTILDNVTPQMRVAREEIFGPVVALIEVSTFEEAIAILNDTKYGLSSSVYTRDINRAFVAMRDIEVGITYINGPTIGAEVHLPFGGVKQTGNGHREAGTTALDVFTEWKSVYVDFSGSLQRAQIDNRS

SEQ ID NO: 32533 - protein, 70 aa, Glycine max
MGFLVTTLIFVVIGIIACLCTRICCNRGPSANLFHLTLVITATICCWMMWAIVYLAQMKPLIVPILNEGE

SEQ ID NO: 32534 - protein, 298 aa, Triticum urartu
FSLKPLVPRLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 32535 - protein, 555 aa, Oryza sativa (japonica cultivar-group)
MERESSTPASSWLGIDEAAPFAGKKATKDAAAADAFVRRWPKVVNATLVAFIMTMPPLLILLGGGRPGAPAVWIKSTVASLAARGEPKKDVLLGGLLLPGFDEQSCVSRYQSVYYRKNMTRPPSPHLLRRLRQQEALQRRCGPGTEPYRRASERLRSGQNAGDDFVATVDGCGYLVLISYRGLGNRILAITSAFLYAMLTGRVLLLDPGKTMADLFCEPFQATSWMLPGDFPLEHFRDLGEDAPESYGNVAVNRSGSVAGLRFVYAHLDHAATPANRLLYCDDHRQFLHRVQWVILRTDSYIAPGIFLNPAYKEELDMMFPNKDAVFYLLSRYLLHPTNDVWGMVTRFYHSYLKNADERLGVQIRVFDGDEPFQHILDQILECTSQEHLLPGVVPPIARSKAVLTTGLNSWYHDSIRDMYWRSPSATGEVVSVHQPSHELHQHFFRSTHDMKALAEMYLLSLTDKIVTSGWSTFGYVGAGLGGLTPYIMIKPENHTVPNPPCVRAMSMEPCDHGPPYFECTKKEIDKIIDTGNLVPHVRSCEDVPWGRKLADPIS

SEQ ID NO: 32536 - protein, 325 aa, Rhodobacter capsulatus
MAIDFKQDILAPVAQDFAAMDQFINEGISSKVALVMSVSKHVVEAGGKRMRPIMCLLAAYACGETNLKHAQKLAAIIEMLHTATLVHDDVVDESGLRRGRPTANATWNNQTAVLVGDFLIARAFDLLVDLDNMILLKDFSTGTCEIAEGEVLQLQAQHQPDTTEDIYLQIIHGKTSRLFELATEGAAILAGKPEYREPLRRFAGHFGNAFQIIDDILDYTSDADTLGKNIGDDLMEGKPTLPLIAAMQNTQGEQRDLIRRSIATGGTSQLEQVIAIVQNSGALDYCHKRATEETERALQALEILPESTYRQALVNLTRLALDRIQ

SEQ ID NO: 32537 - protein, 553 aa, Oryza sativa (japonica cultivar-group)
MATRGKKLGGVAGGGGAAVRVVGVVCVMAVPLFALLVLGGWASASTVWQSAARLTAVTAGKMFVICSMRLFRDASGAGFTNASKPSATGDAATGADELFDGLLAAGGCFDRGACLSRHESPRYYKSSPFSPSPYLLQKLRDYEARHRSSEVMECNYLVGLPYNGLGNRMLSLVASFLYALLTDRVFLVHFPDDFADHFCEPFPGGEGETATTWVLPPDFPVADLWRLGVHSNQSYGNLLAAKKITGDPGEGDAGVRAASDLYFVPSLYAIPEFQDELRWMFPEKESVTHLLARYLLHPSNSVWGMVMRYHHAYLAPAAEMIGVQIRMFSWASIPVDDMYKQVMACSSQERILPDTDGGDAPAPARTNTSGGGATTAILVASLQVEYYERLKGKYYEHAATASGGGRRWVGVFQPSHEEKQEMGKRAHNQKALAEIYLLSFADVLLTSGMSTFGYMSSALAGLRPAMLLTAFNHKFGRPLFPGLHGHGPDARRVRHRVVLRLDHDVRREAAEAGADVAERRPAAGDDLVRQAQQLLANLQKRSIFFYSIGCKNN

SEQ ID NO: 32538 - protein, 298 aa, Aegilops tauschii subsp. tauschii
FSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 32539 - protein, 556 aa, Oryza sativa (japonica cultivar-group)
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDDLAALFPERDAVFHHLGRYLFHPTNHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGTSTFGYVAQGLGGLTPWVLPRREVNGTAPPCRRDMSMEPCFHVAPLYDCKRWEDAGKIVPHVRHCHDMPAGLKLVDRTEW

SEQ ID NO: 32540 - protein, 219 aa, Glycine max
  misc_feature (42)..(42): Xaa can be any naturally occurring amino acid
  misc_feature (48)..(48): Xaa can be any naturally occurring amino acid
  misc_feature (89)..(89): Xaa can be any naturally occurring amino acid
  misc_feature (144)..(144): Xaa can be any naturally occurring amino acid
EERGSTSKGASNSRTSASGGVRTRKLAAVGHNKGSGYDLENXSWVQSXQEVAVYIPVRSGIKARSVGYGVGKNRLELGLKGQDPIIDGXELYRSVKRDGWLGNMEDQKMISILLTKQDQMEWWKCFVKGEPEMDARKVEPESSXLADLDPETCSTEEMIMVDQRQKQMGLPGRDEVQKQGFIGEKQVAAPFFGKARVLVILIYNNKTTKKTTRKNQKPQ

SEQ ID NO: 32541 - protein, 438 aa, Mycobacterium avium 104
MSEVATAPLAAVHLPPAVRGPKLLQGIGFAVSRRTMMRRLSRRYGNVFTLRLPMWGPVVMVSDPQLAKQIFTTSPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRQYDGVIERLIAAEQADPNFAERTDVLALLLRSTYDDGAAMSHKEIGDELLTLLAAGHETTASTLAWAFERISRHPELLARLVEEADNGGNELRQAAILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 32542 - protein, 548 aa, Oryza sativa (japonica cultivar-group)
MAKRGGGRPWVIVLFSLPLLLVFLLSADRRVLIASESQVLRLIKGRGDGSILQWPAAAAARDKLLGGLLADGLDDGSCHSRYQSAMYRRNAGREPSPHLVSKLRRHEELQRRCGPGTAAYSDAVERLRSGKSGGIVSPSPEAECRYLVSISYRGLGNRILAAASAFLYAMLTDRVLLVDPSNEMDELFCEPFPGATWLLPPGFPLANYTSFSVETAESYGNMVKNKVITTDAGDAAPTTAQLPAFAYIHLDHTSTVEDKFFFCDEDQRAIRNIPWLVMRTDSYIVPGLFLVTGFQDELDSLFPETDAVFHHLGRYLFHPTNHVWGLVTRYYDAYLATAQQRVGIQVRVFGAQPESPKLLDQITTCTQKEKLLPEVIAAGEPPVVDVAPANSKSKAVLVTSLKSWYYEKMKSMYWEHATATGEAVSVHQPSHEEYQRFGARSHDGKAWAEIYLLSLSDALVTSGWSTFGYVAQGLAGLTPWVMHKPANDTAAAAGDDPPCRRDVSMEPCFHAPPFYDCRLKRGADTGKMVPHVRHCDDVQWGLKLVRRG

SEQ ID NO: 32543 - protein, 134 aa, Synechococcus sp. RS9916
MQAEPPPALTASAQCLLTERSLQRARQAMRCLPFSREFYTVLEQGALSSGELSSRTDWGELCRSRLNRSRTEDELIWLIQLGVLRREVDGQGLTERVRLTPMGRDLLHAWPGAIPAAALPQRLQHWLRRRRPRL

SEQ ID NO: 32544 - protein, 521 aa, Coprinopsis cinerea okayama7#130
MSSLPFQFTPTSASIPPNNIKLRLKDINNLPANHQPLNPLSFILRAALIYPNKLALLHPDTPNPVAYTFSVWAQRIQNLAYALLKAGLKPGDRVAVIAPNSPLIADAHYGVLAARGILLPINTRLKPHEVAYILEHSGASIILVDYEYKHLIGNTNARVIVSNDTGRAGDPYEDFLTEGRAYSNEQGWRGLEAEPDENVGAVLCYTINKESTYLWILPMFHAAGWTYPWATVFAFATQITLRTVNYTHIWNHLLHSGVTHYCGAPTVQIGIINDPLARKLSRPVTAIIAGAAPTAHLIAELEKKGINPVHVYGLTLSLEDRARLMARQGHAFATAEEVRVVKQDEESDVLEDVPADGKTLGEIVTRGNIVMKEYYKDPEATKKAFRGGSFRTGDLAVMHPDGSVAIMDRSKDIIISGGENASSLAIEQELASHPHVLEVSVIARQHLKWGERPMAFVILHPQHAEKWKGRYHEFEKDLKAHAKSRLPGFACPEWVEVVPELPKTSTGKILKTELRKMVAKL

SEQ ID NO: 32545 - protein, 203 aa, Candida albicans SC5314
MSNSNVDDDLVPEKVEGYTVGEKKTIDEYKNLDAEDESLAKWKASLGLTADTKPYPVKPGDKRKVVVTELALEFPEQPDLQPIRINLEDSDGNTIVDKEIKFNIKEKSIYQLVVKFRVQHEIITGLKYLHSVKRGGIRVEKVEEPLGSYAPNTIDKPFYERKFAEVEAPSGMIARGTYSAISKFIDDDDNVHLTVPWSFSITK

SEQ ID NO: 32546 - protein, 277 aa, Glycine max
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHATHHIYNKENTLSPFAGLAFHPLDGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 32547 - protein, 420 aa, Arabidopsis thaliana
MVKALQGAAQNLPADVNQLIDQLERHCLAPDGSLVTKSVYSDLQLAREEMSRERLRYLEAMAIYCEAVAMVEEYQQAISVANHGGIRDVQGLYPQLGLKNSPQVYETLEHRLVVAEAAQKLRLPLISDGGEIHEEEIEKWSILSRSSLDSASTSFTISSTSNSVNYANSSANSVAGGISLSAVDTDVVGGVPNRFLGITPAYLSYVQLQNTISMDMADYQMFLAREIEGRLKEKCDKLADAIVDDTAILLSSLVPMSDRVFLHFRVKFIIEEIERDEAALREDLYSADRKFAEYYNVGPGTNTRGTYKACEGSKNEMQKTWLCKRCETMNAKLRVLENVLLLETYTPDSISALHNIRNYLVEATEEASAAYNKAVTRLREYQGVDPHFDTIARQYHDIVKKLENMQWTIHQVEMDLKSHD

SEQ ID NO: 32548 - protein, 637 aa, Musa balbisiana
MSSPPPSPSATPPSTSPPPPSSLSPPPASNSPPPAPNAPPPPTPPSPPPASSPPPTPPPPADVPPPPVVTSPPPPDPPPPSVSPPPPALSPPPASTPPPPPSASPPPAAAPPPPPFATPPPTNSPPPPPSATPPPTISPPPPGSQSPPARAPSNSTGGTPPAPPKPPSPPSPSPSASHRAPADPISPSSNGSGIPTSDVGQKSGQSSGDGGMKAGPAVAVALVTAVVLLGLVGAITWIVRRKRRKPPANYESGFAMSSPYQSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDNQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDRRLEDAYDDTEMFRMIEAAAACTRHSAAMRPRMGKVVRVLDSLSDVDLHNGVKPGQSEVFNVGQTADIRLFQRLAFGSQEFSSEYSQSNWSRQSDL

SEQ ID NO: 32549 - protein, 305 aa, Picrophilus torridus DSM 9790
MLDPEKFIKDSVSFIEKNVKRGILACSGGQDSTLLAVISSMAKTDILTVFIDTGLLRNNDIKRIKEIFSSYNVNGRILDRSSLFISRLRNVTDPEEKRKIIGRTFIEVFEEEAKNYGAESLLQGTIAPDWIESGGGSRDTIKSHHNVGGLPEKMNLRLVEPLRDLYKDEVREVSRYLGLPEVQPFPGPGLAIRIIGEVTEEKLNILRRATDIVEYESSKLNDKPWQYFPVLLPVRTTGIHGDQRTYGLTIAIRFIDTIDGMSGTFSRPDWSVLENISNRITDEIPEINRVVYDITSKPPATIEWE

SEQ ID NO: 32550 - protein, 302 aa, Musa balbisiana
MDVSLERRDAPPPPPTPPTSSTLSPTRSASNDDKTKLFPRPRPLPPPLPPRLVPHRPDLAVQSPTHPPPPVQSPLFLHLGVGNEVLRKDTLYISNLVPAMRNLQKALQNPGLEKQIKLSAPQAASSILGVTFPPSAGRFEMHLFPVTKQLLQFLSETESPLMVNVNPFDTYVDNPLEVALNYVLFGMNKALFHDDGKAYSNLFDATVDALVAAMQKQGFPKIPAAAYAQGIIDMVGKGVGTPMRPHDTVEVFLSNLFDRNKKEGKEFEKHSGIFNVDHISCSLPTYIINDIWTFEISFVNSK

SEQ ID NO: 32551 - protein, 1550 aa, Anabaena variabilis ATCC 29413
MKAQLPDNEVQRIAALLEYKILDTQSEAAFDDITRLASYICGTPIALISLIDQNRQWFKSKVGLERRETPRDEAFCTYTILESDVFIVPDATTDERFATNPLVISDPKIRFYAGVPLTNPEGYSLGTLCVIDYIPRNLSPEQIEALQILGRQVIKQLELRRNLANLVLVNNQHKQAQKIRHPFFKKIAGGFGLASVILVLLGLASYQSEIELIHSSNQVQITQESINNLEKLLSQIKDAETGQRGYILTGKDLYLQPYQTALTNIDQKFAELKNTTVDQVQQQRLVILKPLITAKITELKQTIKLRQNQGFQTALQVIQSDKGQTLMDDIRKVMREMETEEKVRLQQQLQAVKASGQKVIVILAIAIVSGLIILAVVYYLIYCEVIARQSMENILNEERNFISAVLDTVSALVIVLDSQGRIVRFNQACEVITGYSFDEVRGRHFWNLFLLPEDVESSKASFAKFPTDSRVSGIQESENYWVTKDGSRRLIAWSRTILQNHEGSVEYIIGTGIDITERKRADKHLTIQYAITRVLAESTTITEATPQILQAICETLKWDVCEIWMVNQQGNFLSFFDLWDQTSLEMQEFKTQSQPITFASGIGLPGQIWASGQPIWLTDIADDASFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLAEIQQSHLELLRKFGVKANLVIPILVKDELCGLLIVHQCANSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALGMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNRNFTATQAQNSVSTKTRILLAEDNLVNQKVALKQLQSLGYTADVAANGKEVLQLLKQIPYDLILMDCQMPILDGLETTKEIHRWAESSFASGRRPVIIAMTANAMKEDKQMCLDVGMDDYLSKPVMKEQLATALEYWCQLILNARQAVEFDIHSLPIDWEHLHQLSENDTEFELHLLQIFVEDVRARLELAKEAIANTDFQKMAQQVHQLKGASTNLGATAMYLAAERLEQLANNQERRGSMELITEIEESVNQIQAFLTRSQVV

SEQ ID NO: 32552 - protein, 175 aa, Brassica napus
  misc_feature (67)..(67): Xaa can be any naturally occurring amino acid
  misc_feature (75)..(75): Xaa can be any naturally occurring amino acid
EVVNALGRIDVWINNAAEQYESNSIEEIDEPRLERVFRTNIFSYFFLTRHALKHMKEGSSIINTTSXSRTSGRVXLLDYTATKGAIVAFTRGLALQLAEKGIRVNGVAPGPIWTPLIPASFNEEKIKNFGTEVPMKRAGQPIEVAPSYVFLACNHCSSYFTGQVLHPNGGAVVNA

SEQ ID NO: 32553 - protein, 533 aa, Oryza sativa (japonica cultivar-group)
MDTDKLGEAAAAHPPEAEKRRGVAAPGAATVLVLVALPLMLVSYFFGDLAADTVVRLHRFKESSLSSSSPAAAADRLLGGLLSPEFDEASCLSRYEASSRWKPSPFRVSPYLVERLRRYEANHRRCGPGTARYRDAVARLRSGDGDGDAECRYVVWLPIQGLGNRMLSLVSTFLYALLTGRVVLVHEPPEMEGLFCEPFPGTSWLLPPDFPYKGGFSAASNESYVNMLKNGVVRHDGDGGALPPYVYLHLEQIHLRLQNHTFCEEDHRVLDRFNWMVLRSDSYFAVALFLVPAYRAELDRMFPAKGSVFHHLGRFYDGYLAGADERLGIQVRIVPQMAVPFDVMYEQILRCTREHGLLPQVTSTSESAGGRPPPPPTATATKVKAVLVVSLKREYYDKLHGAYYTNATASGEVVAVYQPSHDGDQHTEARAHNERALAEIYLLSFSDAVVTTAWSTFGYVAHALAGVRPWQLAPLDWGKMRADVACARPASVEPCLHSPPPLVCRARRDRDPAAHLPFLRHCEDVPAGLKLFD

SEQ ID NO: 32554 - protein, 298 aa, Hordeum vulgare subsp. vulgare
FSLKPLVPRLSELLGLEVVMAPDCIGQEVEKLAAALPDGGVLLLENVRFYKEEEKNEPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 32555 - protein, 128 aa, Escherichia coli
  misc_feature (107)..(107): Xaa can be any naturally occurring amino acid
MSKTIATENAPAAIGPYVQGVDLGNMIITSGQIPVNPKTGEVPADVAAQARQSLDNVKAIVEAAGLKVGDIVKTTVFVKDLNDFATVNATYEAFFTEHNATFPARSXVEVARLPKDVKIEIEAIAVRR

SEQ ID NO: 32556 - protein, 299 aa, Zea mays
YSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADK

SEQ ID NO: 32557 - protein, 183 aa, Escherichia coli K12
MTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 32558 - protein, 205 aa, Photobacterium sp. SKA34
MLEPITTTPRVAVCLAPGSEEMEAINTIAILKRAGFEVTIASTAEDGALILEGSRGIKLVADVPLINVADEPFDCVVLPGGLKGAEHLRDSPLVVEFVKQHHYDGKLIAAICATPAVMFIPHQLFTHSIMTCHPAFQHQIPTHQLRVKRVVYDKNTRLLTSQGPGTAQEFALEIVSQLENKAKAAEVAEPMVVWPNMHYDVLPRT

SEQ ID NO: 32559 - protein, 536 aa, Magnaporthe grisea 70-15
MSAIRMHRNACSASRLVARTSAPRRTVPFLSPSYARLASTQVPKLKDPSLFKQNVCYVNGAFVPAKSGATFAVADPTTGEHIGDAPEFDAADTEAAIAAAENAFKTYRLTTGRERSKLLRRWYDLMIANADDIATLITWENGKTIADAKGEVTYAANFFEWFSEEAPRVYGDTIQPTLAANRVVTRKEPVGVCSLITPWNFPAAMGTRKIGPALAAGCTVVCKAPAETPFTSLALAELAHRAGVPAGVVNFVTSHSNTKTVGEVLCTHQAVRKISFTGSTGVGKTLMQQAAGTLKKCSFELGGNAPFIVFDDADLDAAVDGAIACKFRSSGQTCVCANRIYVQRGIYDAFAERLAKRVKETFKIGSGFDPETTHGPLIHDRAVSKVASQVEDAVGKGAKLLAGGKRLPDLGPHFFAPTVLGDMTPEMSIAREETFGPIAGLFKFDTEAEVVKMANDTEVGLAGYFFSKDIHRAYRVAEALEVGMVGVNTGIISDVASPFGGVKESGFGREGSMYGIHEYQVTKTITFGGMGKELQG

SEQ ID NO: 32560 - protein, 230 aa, Pyrus pyrifolia
HKAVAGAIVVGVILHAGNHLACDFPRLIKVPESDYEKYLHHDFGKHKPTYLDLVKGAEGVTGIIMVICMIIAFTLATRWFRRSLIKLPKPFNRLTGFNAFWYSHHLFVIVYILLIIHGVFLYLVHTWYLKTTWMYLSVPVLLYAGERILRIFRSGSYIVRLLKVAIYPGNVLTLQMSKPQQFKYKSGQYMFVQCPAVSPFEWHPFSITSAPGDDYLSVHIRQLGDWTQEL

SEQ ID NO: 32561 - protein, 354 aa, Solibacter usitatus Ellin6076
MKTFTIGVIAGDGVGTEVTPQAKRVLEKSAHKHQVTFSFQDFEWGAEHFFRWGRMMPAGAIDLLQPCDAILLGAVGHPEIPDHTTLNGLLLPIRRAFDQYANVRPAYLYPGVQSPLARPKGGDIDFVVVRENTEGEYAQVGGFVYHLQPEEIAIQTSVFTRRGIDRIVRFAFELAVKRNKKRRVTSITKSNAQGYSMVLWDRAFQEIAAQFPEVETESLLVDAAAMNFIRRPESFDVVVGSNLFADILSDISAIIVGSMGLAASANLDPLRRFPSMFEPVHGSAPDIAGKGIVNPLATILSAGMMLDHLGMTEAAKELDAAVAAILADGKVSTPDIGGKSSTEEVTDAVLEKLG

SEQ ID NO: 32562 - protein, 230 aa, Pyrus pyrifolia
HKAIAGAIVVGVIPHAGNHLACDFPRLIKVSESVYKKYLLHDFGKHKPSYLDLIKGPEGLTGIIMLICMIIAFTLATRWFRRNLVKLPKPFNRLTGFNAFWYSHHLFVIVYVLLIIHGVFLYLVHTWYLKTTWMYLSVPVLLYAGERILRIFRSGFYTVRLLKVAIYPGNVLTLQMSKPQQFKYKSGQYMFVQCPAVSPFEWHPFSITSAPGDDYLSVHIRQLGDWTREL

SEQ ID NO: 32563 - protein, 271 aa, Nicotiana tabacum
MEDYLKQFVEETSFYNRLVLGTFMPESWWGPLPHMLQGWLRNYIGGVLLYFISGFLWCFYIYHLKRNVYIPKDAIPSNKAMLLQISVAMKAMPWYCALPSLSEYMIENGWTKCFARISDVGWLSYVIYAAIYLVIVEFGIYWMHMELHDIKPLYKYLHATHHIYNKQNTLSPFAGLAFHPLDGILQAVPHVVALLLVPMHFSTHIALIFLEALWTANIHDCIHGKVFPVMGAGYHTIHHRTYRHNYGHYTIWMDWMFGTLRDPVEEDAKKM

SEQ ID NO: 32564 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKINPETTLFLVASKTFTTQETMRNAQSARDWLLKAAKNESAVAKHFAALSTNAKDVEKFGIDTN

SEQ ID NO: 32565 - protein, 130 aa, Coprinopsis cinerea okayama7#130
MSQYVHVPKSELDEAQLRQLEEHEISQGPLSVLQQAVRNHAQVLISLRNNKKLLARVKAFDRHSNMVLENVKEERPSPFTTIQEPRLMVNSQMWTETPKGKNKKPVNKDRFISKMFLRGDSVILVLRNQA

SEQ ID NO: 32566 - protein, 104 aa, Arabidopsis thaliana
VSRFLAQNAKNGRNLNAADHCNKEEEICKSQGMYNSTMACCSNKCVDLAYDNDNCGACKNQCKFTQTCCRGECVYLAYDKRHCGECNHSCLVGEFCVYGLCNYA

SEQ ID NO: 32567 - protein, 480 aa, Coprinopsis cinerea okayama7#130
MSNADIVISPSVESIVNSFATVALDMKDATITSTRQSRNALVYPKKRPSPHGITKSHKSPLLPANGVSRVSPRAAKAAFVQQQRQKAAQLLALRRDGAYLEEEYREEIRRYMHDMERNTMSSTQSMDQQPEIRWHMRPCLVDFLVEIHFTFRLRPETLYLTLNIIDRYVSRRVVYIKHYQLVGCAALWIAAKFEDAKERVPTVQDLCHICRDTYEESAFIQMEGHVLSTIQWTLGHPTAEAWLRLFCTGPVPEDNKVQHVARFLMEITLFYREFVKFSPSTIAMASLTLARYICGKQRRFWEETDECLEVVNILDTRLATNVNDLSETLIKKYSYAFYSKAATLVVQYYLEGGRFYQESFPSLPSFPSLPATPKRTTTSGVSTPMSTSSTSTTSSDLSDDMPVTPTTPSSPPLFETAEPFISSYSSDDKENMPSTTVEPIINKPLPDAVPENLLPHGYVTYSRAALHNLNVCSPRTAIVT

SEQ ID NO: 32568 - protein, 303 aa, Candida albicans SC5314
MNDQNWKNLSNELRRRAEQARSSSNMKSPKSPLGIFGGIGGLLLLGGATMFIQNALFNVDGGQRAILYSRLDGVQSKIYPEGTHFVIPWFQRPIIYDVRAKPKEIASLTGTKDLQMVNITCRVLYKPDIWQLPTIYRTLGLKYEEKVLPSIVNEVLKSVVAQFNASQLITQREKVSRLVRENLVRRASKFNVLLDDVSITYMTFSPEFSQAVEAKQIAQQDAQRAAFVVDKAIQEKQQLVVKAQGEAKSAELIGEAIKKSKDYVELKRLDTAREIANILAASPNRIILDNDTLLLNTVTDNRK

SEQ ID NO: 32569 - protein, 591 aa, Bacillus licheniformis ATCC 14580
MKQESVQQKNISIMSSFSGSRKVYVEGSRPDIQVPMREISLSPTTGSFGDEENQPVRVYDTSGPYTDANADVDILKGLKPLRATWIRERGDTEEYEGREIRPEDNGYKGKEKASHSYTGLKRKPLRAKKGQNVTQLHYARKGIITPEMEFIAIREHVSPEFVRDEVASGRAIIPSNINHPESEPMIIGRNFHVKINANIGNSAVTSSIEEEVEKMTWAIRWGADTMMDLSTGKDIHTTREWIIRNCPVPVGTVPIYQALEKVNGVAEDLTWDIYRDTLIEQAEQGVDYFTIHAGVLLRYVPLTAKRVTGIVSRGGAIMAQWCLAHHEESFLYTHFEEICEIMKTYDIAFSLGDGLRPGSIADANDEAQFAELETLGELTEIAWKHDVQVMIEGPGHVPMHKIKENVDKQMEICKEAPFYTLGPLTTDIAPGYDHITSAIGAAMIGWYGTAMLCYVTPKEHLGLPNKDDVREGVITYKIAAHAADLAKGHPGAQIRDDALSKARFEFRWRDQFNLSLDPERALEYHDETLPAEGAKTAHFCSMCGPKFCSMRISQDIRDYAKENNLDEEKAIQKGLEEKAKEFKKAGGSIYS

SEQ ID NO: 32570 - protein, 376 aa, Escherichia coli
MLQRGCDGCKQNQSREPATIDGFMPKAQESIMGQQKQRNRRWVLASRPHGAPVPENFRLEEDDVATPGEGQVLLRTVYLSLDPYMRGRMSDEPSYSPPVDIGGVMVGGTVSRVVESNHPDYQSGDWVLGYSGWQDYDISSGDDLVKLGDHPQNPSWSLGVLGMPGFTAYMGLLDIGQPKEGETLVVAAATGPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQREMGQWVKEDKIHYREEITDGLENAPQTFIGLLKGKNFGKVVIRVAGDD

SEQ ID NO: 32571 - protein, 263 aa, Anabaena variabilis ATCC 29413
MNKTHKQTALITGAASGIGYELVCIFAENGYNLVLVDRTKEKLEEIATKFQDKFGIYVKPIVRDLSKTTSPEEIFQELEQANIKVDVLVNNAGFGTYGLFNDTNLADELEMLQVNLVCTTHLTKLFLKNMVQQGEGKILNVSSAAAFQPGPLMAVYFATKAYVLSFSEALANELDGTGVTVTVLCPGTTQSAFHQRTGMADSKLVKGKRMMDAATVADIGYRGLMQGKTIVIPGLINKIMAKSIRFIPRKLVTKIVRNMQENK

SEQ ID NO: 32572 - protein, 455 aa, Prochlorococcus marinus str. MIT 9303
MISSSPYEPGRDLLSPNCNLAPITTELDAQSRLIVGGCQLSKLAECYGTPLYVLDEATLRAACQSYRGALQRHYPGPSLPIYASKANSSLMMSSLVASEGFGLDVVSAGELLTALKGGVPGDCIVLHGNNKSDQELLLAYRNGVTIVADNQHDLDRLSQLVPVGADPANLMLRFTPGIECHTHEYIRTGHLDSKFGFDPDQLESVLNQLLGCRWARLTGLHAHIGSQIFELEPHQDLADVMAGALQLARRLGHPVMDLNVGGGLGVRYVSSDDPPSIDNWVKVVAEAVNQACRSRNLDLPRLMCEPGRSLVAAAGVTLYRVGSRKTIPGLRTYLSVDGGMSDNPRPITYQSLYTACLADRPLDSPDETITLVGKHCESGDVLLKDLALPYASSGEVLVVFATGAYNVSMSSNYNRIPRPAAVLVHSGHSELVQRREQPEDLLRYDVMPERFVALG

SEQ ID NO: 32573 - protein, 372 aa, Bacillus cereus G9241
MKAEEKFSPGLDGVVAAETKISFLDTVKGEIVIQGYDLIELSKTKEYLDIVHLLLEEHLPNEDEKATLERKLKEEYAVPEGVFNVLKALPKETHPMDGLRTGVSALAGYDNDIENRSLEVNKSRGYKLLSKVPNIVANSYHILNNEEPIEPLKELSYSANFFYMLTGKKPTELEEKIFDRSLVLYSEHEMPNSTFTARVIASTQSDLYGALTGAVASLKGSLHGGANEAVMYMLLEAGNVEKFEELLQKKLYNKEKIMGFGHRVYMKKMDPRALMMKEALKQLCDVKGDYTLYEMCEAGEKIMEKEKGIYPNLDYYAAPVYWMLGIPIQLYTPIFFSSRTVGLCAHVIEQHTNNRLFRPRVNYIGERHVLSQ

SEQ ID NO: 32574 - protein, 216 aa, Yarrowia lipolytica CLIB122
MQRVRDSTWSHINSVVMIGDSGVGKTNILGRFTRDEFNLDSKSTIGVEFATRTVNIDNKIIKAQIWDTAGQERYRAITSAYYRGAVGALLLYDVTSTQSYKNISRWLQELQDHADSNIVLMLVGNKCDLKHLRAVPTEEAKQFASQNKLLFIETSALDGTDVALAFRNILTEIYHRVSAAENVHANLEDSRKPQQGTTISLTPQPGDSDKKSSSCC

SEQ ID NO: 32575 - protein, 402 aa, Oryza sativa
  misc_feature (46)..(46): Xaa can be any naturally occurring amino acid
  misc_feature (64)..(64): Xaa can be any naturally occurring amino acid
MASKRSVGTLTESDLKGKKVFLRADLNVPLDDSQKITDDTRIRASXPTIKFLMGKGAKVILGQXHWGRPKGVTPKYSLKPLVPRLSELLGVDVVMANDCIGEEVQKLAATLPDGGVLLLENVRFYKEEEKNDPEFANKLASVADLYVNDAFGTAHRAHASTEGVTKYLRPSVAGFLMQKELDYLVGAVANPKKPFAAIVGGSKVSTKIGVIESLLAKVDILILGGGMIYTFYKAQGYAVGKSLVEEDKLELATSLIEKAKSKGVSLLLPTDIVVADKFAADAESKTVPASAIPDGWMGLDIGPDSIKTFSETLDTTKTVIWNGPMGVFEFEKFAAGTDAIAKKLADITAKGVTTIIGGGDSVAAVEKAGLADKMSHISTGGGASLELLEGKTLPGVLALNDA

SEQ ID NO: 32576 - protein, 372 aa, Magnaporthe grisea 70-15
MSATNGSAAAAPSKKNIGVFTNPKHDLWINEAEPSLESVQKGSDELKEGQVTIAIRSTGICGSDVHFWHHGCIGPMIVREDHILGHESAGEIIAVHPSVTSLKVGDRVAVEPQVICYECEPCLTGRYNGCEKVDFLSTPPVPGLLRRYVNHPAVWCHKIGDMSWEDGAMLEPLSVALAGIQRAGITLGDPVLVCGAGPIGLITLLCAKAAGACPLVITDIDDGRLKFAKELVPDVITFKVEGRPTAEDAAKSIVEAFGGVEPTLAIECTGVESSIASAIWAVKFGGKVFVIGVGRNEISLPFMRASVREVDLQFQYRYCNTWPRAIRLIQNKVIDLTKLVTHRFPLEDALKAFETAADPKTGAIKVQIQSLE

SEQ ID NO: 32577 - protein, 553 aa, Zea mays
MAISAKERKLSRLGSCKGGAAAGSGSGGGGGSPAARAHRSVAAAPQRRVFAALFAFLCAGVVVLGGVHVIGATFRPVLRTAWPAATLNAISSDARARRGGSSADTTVLPSVQIRHAVAMPDRVLLILKDGPLLPSPERFQCLYSPANSSELRRHRPLLAASSPDGPSLVHCPAEPSCVDVSLSLSLSPPVAPLQWDRLVYAALVDSRDNSTVVFAKGMNLRPGRLGVASRYQCVFGRDLWKPKQRVLTSPVITAAQEVFRCVTPARVHRHLRMTTDPNGSGNGNDKPMLVSIRTKGQRDSTLPSIAEPEPLPPRHNYRHHRRRPKAHSMCVCTMLRNQARFLREWIIYHSRIGVERWIIYDNNIDDSIQHVLGTMDPSTHNTTLPDILRSYSNRPRVGELRTACHSFGPSGRTRIPKQGVTTGYTCRLAAPERHKSIVRPDALNPSLVNVVHHFHLREGARYVNVGQGAMLVNHYKYQVWEVFKDKFSGRVATYVADWRDEENVGSRDRAPGLGTRPVEPEDWPRRFCEVYDTGLKDFVQKAFADPATGSLPW

SEQ ID NO: 32578 - protein, 310 aa, Escherichia coli K12
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENVEQRWQRILHIQQQLAGEQVALSDEVNQSEQTTNFHNRAIAWLLYSAGYLYCDAMEACDVYTRQCSTLLNTIELATLGATLAAGGVNPLTHKRVLQADNVPYILAEMMMEGLYGRSGDWAYRVGLPGKSGVGGGILAVVPGVMGIAAFSPPLDEDGNSVRGQKMVASVAKQLGYNVFKG

SEQ ID NO: 32579 - protein, 356 aa, Brucella melitensis 16M
MQHLCCFPNLAIIRRVAKLCARKFLEAKLTTLSNRSAVEPFHAMDVLAEANRRRAAGHPIISMAVGQPADSTPVVVRQAAERALKDGRIGYTDALGLIELCEAIAAHYADHYGVSVSPERIAVTTGSSAAFNLAFIVYFDPGDRVAITRPGYPAYRNILTALDLEVVEIPTGHGTSSSLTAQALAAAHAEKPLKGVLFASPANPTGAVIDKPELTAIIETARNLGIRVISDEIYHRLSYEADDVTALEVADDVTIINSFSKYYCMTGWRIGWMVLPDNDIRAIERLSQSLYISAPELSQRGAIEAFRATAELERIKDRYRRNRLILLNHLPRMGLDLAAPMDGAFLRLLRCVAFHQ

SEQ ID NO: 32580 - protein, 398 aa, Xanthomonas axonopodis pv. citri str. 306
MSLQIDTAAMLAALPRVRERCDGPICAYVYDLAALDTHAAWMRAQLPAQCELFYAAKANAEPPILRTLAPHVDGFEAASGGELAWLHAQQPQAPLLFGGPGKLDTELAQAAALPDCTVHVESLSELERLAEVASHAGRCVPVFLRMNIAVPGAQSTRLMMGGQPSPFGLDPCDLHAAMQRLQASPSLRLAGFHFHLMSHQRDATAQLHLVAAYLRTVQQWRQAYALGPLRVNAGGGFGVDYLAPEASFDWAGFCAGLPALLREHATDLRLRLEPGRYVSASCGWYLMEVLDLKRSHGAWFAIARGGTHHFRTPAAQGHDHPFRVLRGERAPVLRDTPVTLVGQLCTPKDVLARDQHVAALAPGDCLAFPLAGAYAWNISHQRFLMHPAPQMVFLTEGH

SEQ ID NO: 32581 - protein, 795 aa, Photorhabdus luminescens subsp. laumondii TTO1
MKFSELWLREWVNPAISSETLSDQITMIGLEVDGVEAVAGQFHGVVVGEVVQCAQHPNADKLRVTKVNVGGERLLDIVCGAPNCRLGLKVAVATVGAVLPGDFKIKAAKLRGEPSEGMLCSFSELGISEDHDGIIELPIDAPLGVDLREYLKLDDKVIEISITPNRADCLSIIGVARDVAVANKMPLSEPQIEAVKPTTDAIFPIRVEATEACPRYLGRVIKNINVKAATPQWMREKLRRGGIRSIDPIVDVTNYVLLELGQPLHAFDLERLNGSITVRMAKQDEKLVLLDGTEANLSTDTLVISDEKQAVAMAGIFGGEHSGVNEETQNILLECAFFAPLAIAGRARRYGLHTDASHRYERGVDPQLQHKAIERTTQLLIDICGGEAGPIIDVTDESQLPQSATITLRREKLDRLIGHYIPDEQVGDILTHLGCKVTIQENCWQAVAPSWRFDVEIEEDLVEEVARIYGYNNIPDVPIRADLIMKKHRETDLSLQRVKTVLVDRGYQEAITYSFVDPKIQALLHPQQQALMLPNPISADMSAMRLSLLTGLLTTVVYNQNRQQNRVRLFETGLRFVPDENADQGIRQELMLGGVITGNRFEEHWSLEKQSVDFFDMKGDLEAVLELTGKLSKISFRADVNPALHPGQSAGIYLENEYIGYIGVVHPELERKLDLNGRTVVFEVLWNKLASRVVPDAKEISRFPSNRRDIAIVVPENVAVEDVLAECKKVGVNHIVGINLFDVYCGKGVAEGHKSLAISFILQDTARTLEEEEIAATINKCVAVLKQRFQASLRD

SEQ ID NO: 32582 - protein, 240 aa, Coprinopsis cinerea okayama7#130
MSSSWTKPASRPDLIHDLVSGVDRYNPSNVGILEDYLYHQIRSEEYDCLANLAILKLYQFNPDLYNPDVVINILLKALTATPMPDFNLCISLLDERPPTASLDEPDPLPTLLPLLRNLQNLLYRCRFPAFWQTYNSDEYENLRDNYTVEVVGFENAIRQIAIRAVTATFTHITSQRLGSYLNLDGEDLAEYIQQLGWSIDASTGNVAVPPNPDNQIEATVVQEQIKLPQLTKVISHAIKA

SEQ ID NO: 32583 - protein, 834 aa, Arabidopsis thaliana
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLSVACLVISVVAGVGSIAGVMLDLKSGGNLVMLFKGCRRFVRTTCRVSIPGGSLGNESKAPPRFLRDRKIVPDADPPNMEDIHKLYRLFEQSSRLTILTGAGVSTECGIPDYRSPNGAYSSGFKPITHQEFTRSSRARRRYWARSYAGWRRFTAAQPGPAHTALASLEKAGRINFMITQNVDRLHHRAGSDPLELHGTVYTVMCLECGFSFPRDLFQDQLKAINPKASWAEAIESIDHGDPGSEKSFGMKQRPDGDIEIDEKFWEEGFHIPVCEKCKGVLKPDVIFFGDNIPKERATQAMEVAKQSDAFLVLGSSLMTMSAFRLCRAAHEAGAMTAIVNIGETRADDIVPLKINARVGEILHRVLDVGSLSVPAL

SEQ ID NO: 32584 - protein, 148 aa, Solibacter usitatus Ellin6076
MDMKKPSRPIEILLVEDNAADAQLVERAFRFSRTPVRLYVVEDGVQALDYLRRTAGYTDSVRPDLIMLDLNLPGRDGHQVLKELKNDPDLKEVPVVIYSGSAMQRDVKLAYRLGGNCYIRKPVDLEEFFGVVASIERFWLNTALLPSL

SEQ ID NO: 32585 - protein, 373 aa, Staphylococcus epidermidis ATCC 12228
MAKRDYYEVLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGHGDLFVNIKVVTPTKLNDRQKELLKEFAEINGEDINEQSSNFKDRAKRFFKGE

SEQ ID NO: 32586 - protein, 889 aa, Emericella nidulans
MSSPLRQSTSAANRGLGNLNRRKRSREPDDDASSVVPPSSPPPSSPPMLPFDEDEDEPDEEAELDIDDIEEMAEDEDGIDLFGDTFERDYRGGKDDRYRHDTLTTMSKKKSTLVPDESWRLAWIEEIENLLGRRMPAAFLQDDEDGDIDLTAQPRRRRHAYDEDRDDIEMADDGLEELSLEELVDIKSSNITDWVTQPQVLRSIYREFKAFLTEFTDPTGSSVYGNKIKTLGEVNSASLEVSYTHLSSTKAVLGYFLANEPTEVLKVFDQVALDVTLFHYPQYHDIHNEIHVRITDLPIVYTLRQLRQSHLNCLVRVSGVVTRRTGVFPQLKYVMFICQKCNMTLGPYQQESSSEVKVTMCQNCQSRGPFTVSSEKTVYRNYQKLTLQESPGSVPAGRLPRQREVILLADLIDSAKPGDEIEITGIYRNSYDAQLNNKNGFPVFATIIEANHVIKSHDQQAGFQLTEEDEREIRALSRDPDIVEKIIRSIAPSIYGHQDVKTAVALSLFGGVRKETQGKMSIRGDINVLLLGDPGTAKSQILKYVEKTAHRAVFATGQGASAVGLTASVRRDPLTSEWTLEGGALVLADRGTCLIDEFDKMNDQDRTSIHEAMEQQTISISKAGIVTTLQARCAVVAAANPIGGRYNSSAPFSENVQLTEPILSRFDILCVVRDLVDPSEDERLASFVIESHHRANPSKPLRDEHGNLINADGERIDEEGYRIDDDGIRLPLRPDEIEARNAARDNDDEKEGEIPQELLRKYILYAREHCRPKLYQIDQDKVARLFADMRRESLATGAYPITVRHLEAIMRIAEAFCKMRLSEYCSAQDIDRAIAVTVDSFIGSQKVSAKRALSRAFAKYTLSRPKPQSKRRAGIPAPVSFERRPQAAR

SEQ ID NO: 32587 - protein, 403 aa, Rhodopseudomonas palustris
MDLLESRIVIVGAGQAGARAAEALRAAGHRGAVTLIGDEPHPPYERPQLSKKMLLDQQADATFIRTTQEWSDLGVTLRTGTRAVTIDLNQRKLALSGGDDIGFDRLLIATGTRPRRLAALEGTKVAVHYLRGIDDALTLRPQLIEGHRVALVGGGVIGLEVAAAALSRGCEVTIIERADDLLPQIGSPSLIRFAHDMFVKRGAAILCKAELSGQQTHSLTLADGRVVDADVIVVGIGSEPAGELALQIGLAGVQVFVFDARGATECDHVVAAGDVAEQWSAIPRFAWLRLENWANAQNQAIATARAMAGLDSRYEAPSWFWSDQFDANIQVVGHPACANEIIRGDAGSARFSAISVRDGEVVGAVSVNNAKDMAMVRRLVASRKKVDPAALANPAFDLKRALV

SEQ ID NO: 32588 - protein, 214 aa, Zea mays
MDDQENENEHEKHADAGTDVDEEEEDEDGHKRVVVLGPQVPLKEQLELDKDDESLRRWKEQLLGQVDTEQLGETAEPEVKVLNLTILSPGRPDLVLPIPFEADDKGYAFTLKDGSLYSFRFSFTVSNNIVSGLKYTNTVWKTGVKVENQKMMLGTFSPQQEPYVYEGEEETTPAGIFARGSYSAKLKFFDDDGKCYLETSYYFEIRKEWPGPAT

SEQ ID NO: 32589 - protein, 280 aa, Matricaria chamomilla
MEYISSSNKNIWIGELIKGRDSTKKLQNLLPRKIYNDGVLANDLVVKILGSFSNTLSTLSSLGPGELSPVISPCCNDRALDSDEIEKKPKDRRGCYKRRKTEDSRIKIVDTIEDEFAWRKYGQKEILNAKFPRCYFRCTHKSEGCKALKQVQQLEDGSEKFHVTYLGYHTCQNIHKDTQMFSDTSALKFYLNFKDPNINYSSPSSHSTITNANITHSSEREDDSNAQSDAHHLATSNDDKQSIALWKDIIGNLESPHEDIFKNGISVDDFKFDENVFLHI

SEQ ID NO: 32590 - protein, 221 aa, Photorhabdus luminescens subsp. laumondii TTO1
MSFHLPIKAAIFDMDGLLIDSEPYWTQGEKEVFSELGLDFSLAEKLPDTLGLRIDQVVELWYQASPWQGVSKSDVEQRITDHVIDLVKENRPLLPGVEYALNLCRKQGLKIGLASASPQYMLEQVLEMFSLNHYFDTVVSAAKLPHSKPNPEVYLRAAEQLDVAPINCVALEDSFNGMIATKAARMRSIVVPSAHHFDDPRWVLADIKLHSLEQLTVMNIT

SEQ ID NO: 32591 - protein, 254 aa, Zea mays
  misc_feature (216)..(216): Xaa can be any naturally occurring amino acid
  misc_feature (218)..(218): Xaa can be any naturally occurring amino acid
MASSSLCHRYFNKITVTPFFNTKKLHHSSSRRISLRVNRRSFSISATMSSSTKKVLIPVAHGTEPFEAVVMIDVLRRGGADVTVASVENQVGVDACHGIKMVADTLLSDITDSVFDLIMLPGGLPGGETLKNCKPLERMVKKQDTDGRLNAAICCAPALAFGTWGLLEGKKATCYPVFMEKLAACATAVESRVEIDGKIVTSIGPGTTMEFSVTLXSXLLQKEKAVVFSHILEGRHLQGPEVTITERNQVGTRL

SEQ ID NO: 32592 - protein, 460 aa, Arabidopsis thaliana
MVRSDENSLGLIGSMSLQGTLNRSILLLKIKTFVLFDFSPKLILNLLDVGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 32593 - protein, 465 aa, Musa acuminata
MEVDLGKLFIGGISWDTNEDSLRKYFSAFGEVVEAVIMKDRTTGRARGFGFVVFADPAVTERVVTEKHTIDGRMVEAKKAVPRDDHQFLNKNSSSSIHGSPVPGHTKKIFVGGLSSTITEGDFKKYFDQFGTITDVVVMYDHNTQRPRGFGFITYDSEDAVDKVLLNAFHELNGKMVEVKRAVPKEPSPGPIMRSSIGGYNYGLNRVNSFVNGYTQGYNASSVSGYGMRRLDDSRLGSLAGGRNGFASLSPGLGMGMDYEPPLSSTFVGNPGYDNNLGYGRALNPYHNANSSRYTSLIPYNDVNGNTSSLFSLTSRNVWENVALDHATKSAISNASMVSRSGSLGSLGTGNLNRGSGSSYTSGNLGFGGGGYIGLGRNSFDRRIAPASPNTNLIASSSGYEGSYAKLYGATSVYGDPTWGSSSSEFDATGSFSYKLNNSNSDVTGNGFADYMAGYNVNNNRGIAT

SEQ ID NO: 32594 - protein, 1355 aa, Solanum demissum
MMQDVWTQLGPTIATIMFIWTMYQNYFPHELRGHIRRYTDKLVSYFYPYMHIIFCELETEGWFERSKAYVAIERYLSKNSSTQAKLLKANVVKDGQSLILTMDDHEEITDEYKGEKVWWISSQKPANRQTISFYREDEKRYFKLKFHKKNRDLITNSYLKYVLYEGKAISVKERQRKLYTNNKGDGGGTGKSSMIVAMANFLKYDVYDLELTSVKDNTELRKLLIDTTDSKTVGSQVQELQLIFHDLIAEDMVVNEAFQVAAMIEKLPPSWNDFKNYLKHKRKEMKLEDLVIRLKIEEDNKTAEKKSRKSSTIIGAGHKSSDCRAPRKDKDKDKGKGKSQANIVEEMEDADDLCGMISECNLVGNPKEWFLDSGATRHICSAKEVFATYTHVEVDEDLFMGNTTTTRIAGTGKVMLKMTSGKVLTLNNVLHVPTIRKNLVYVALLVKNGFKCVLVSDKTVISKNEMFLGKGYLTEGLFKLNVMVVDSINKNSASVYLLESNDLWHARLGHVNYKALRKLVTLEVLLDFKCDKSKCEICVENICDMKSTPSRGGKKYFITFIDDCTRFCYVYLLNSKDEAIDAFKQYKNEVENQLNLKIKMIRSDRGGEYESLFAEICLEYGIIHQTTAPYTPQSNGLAERKNRTLKEMMNALIISSGSPRNLWGETILTANKILNRVPRSKTQSIPYELWKGRKPNLKYFKVWGCLAKVEVPLPKRVKIGPKIVDCVFIGYAVNSKACRFLVHKSDNPEIHVNTEKAQPNEDPRRSTRQRKSTSFGPDFVAFLLENEPPTFKATMSSSESIYWKEAVNSEIESILSNHTWELADLPPGNKSLGSKWIFKRKMKVDGTIDKYKARLVVKGYRQKEAFLNGELEEEIYMEQPEGFVVPGKEEKVCRLVKSFYGLKQAPKQWHAKFDQTMLANGFKINECDKCVYIKNVLNHEVIVFLYVDDMLIMSKDIDDINATKRMLSSKFAMKDLGVADVILGIRILKTPQGLALSQSHYIEKILDKFKYLNFNVVKIPIDLSCTFQKNVGESDSQLEYARVLGSLMYIMNCTRPDISCAISKLSRFTSNPNQTHWMAMKHVLGYLKHSQHYALHYNKYPAMIEGYSDANWITGSNEVKSTSGYVFTLGRGAVSWKSSKQTCIARSTMESKFIALDKAGKEAEWLQNFLEDIPFWPKPVGPICIHCDSQAAIGRARSVMYNGKSRHIRWRQNTVRQLLSSGIITIDYVKSSDNVSDPLTKGLVYGLGQVSRAVTLSSRLEIPRARFKEKNKVVTDGSTLSINSIHSHDEDNVQEQVYLRDDTIRNHLSECEVYTPKLDGSKISHLPIDRVYPTYVHYGKSKGKPTYPDAIDSCL

SEQ ID NO: 32595 - protein, 155 aa, Solanum demissum
MMQDVWTQLGPTIAAIMFIWTMYQNYFPHELCGHIRRYTDKHVSYFYPYMHIIFYELETEGWFERSKAYVAIERYLSKNSSTQAKRLKANAVKDGQSLVLTMDDHEEITDEYKGEKVWWISSQKPANRQTISFYREDEKRYFKLKFHKKRYCWYG

SEQ ID NO: 32596 - protein, 147 aa, Candida albicans SC5314
MSMFQQRLQQYKYMEASKKQQLADLQTKIPDIEKNLDVIKHIKQRKEEGDDKMVTNYELNDTLYSKATVDVQNLNSVYLWLGAEVMLEYNLEDATELLNERLKKNQEQLQIVKEDLEFLKENITTMEVNTARLYNWDVERRKKAKAN

SEQ ID NO: 32597 - protein, 1097 aa, Synechococcus elongatus PCC 6301
MPRRQDIRKILLLGSGPIVIGQACEFDYSGTQACKALREEGYEVVLVNSNPATIMTDPETADRTYIEPLTPELVAQVIERERPDALLPTMGGQTALNLAVALAKNGTLDRFGVELIGAKLEAIEKAEDRLLFKEAMERIGVKVCPSGIANNMAEAQAIAEQIGTYPLIIRPAFTMGGTGGGIAYNQEEFELIVQSGLDASPVSQILVEQSLIGWKEFELEVMRDLADNVVIICSIENLDPMGVHTGDSITVAPAQTLTDKEYQRLRDQAIAIIREIGVETGGSNIQFAINPQDGDVIVIEMNPRVSRSSALASKATGFPIAKIAAKLAVGYSLDELKNDITRQTPASFEPTIDYVVTKIPRFAFEKFPGTPAQLTTMMKSVGEAMAIGRTFPESFQKALRSLEIGRSGWGCDRPETLPTLEQIKPQLRTPSPDRIFAVRQAMLLGLSDGDIYQLTGIDPWFLEKFREILEGEDFLKRASIEQITPAQWLEVKQLGFSDRQIAFALGSSEEAVRQRRQQQGIKPVYKLVDTCAAEFEAYTPYYYSCYESPRSHLAESGLTTIPAESEVRPSDRPKVMILGGGPNRIGQGIEFDYCCCHAAFALAADGYETIMVNSNPETVSTDYDTSDRLYFEPLTREDVLNILEAERPQGVIIQFGGQTPLKLAVPLQTFLQTPEGQALGTQIWGTSPDSIDTAEDRERFEQILRQLDIAQPANGLARSPEEALAIAHRIGYPTVVRPSYVLGGRAMEIVYSDAELERYMTEAVQVEPDHPILIDKFLENAIEVDVDALADRTGQVVIGGIMEHIEQAGIHSGDSACSLPTVSLNETVLETIRAWTTQLAKALNVIGLMNIQFAVKDEQVYILEANPRASRTVPFVSKAIGRPLAKIAARLMSGQTLADLGITSELVPSYLSVKEAVLPFDRFPGTDTLLGPEMRSTGEVMGIDVDFGRAFAKAELAASQRLPRQGTVFISVSDRDKAAIGPIAREFLQLGFRVVATGGTQKVLAEQRLSVEPILKVHEGRPHVLDALKNDQIQLIINTPAGARAKVDDQIIRRAALDYKVPTVTTIAGAKATVEAIRALLEQPLQVKSLQDYQQQG

SEQ ID NO: 32598 - protein, 479 aa, Musa acuminata
MASTAATSFSLLPTSSSRRRVAAVVAPSRLTLRSPSRRLGFAGVAADSLLAAHVAAKIRTVAGRSGKGPRGVAVMAKKSVGDLTAADLKGKKVFVRADLNVPLDEDRNITDDTRIRAAVPTIKHLISNGAKVILSSHLGRPKGVTPKFSLSPLVPRLSELLGIKVEKADDCIGPEVEKLVNALPEGGVLLLENVRFYKEEEKNEPEFAKKLAALADLYVNDAFGTAHRAHASTEGVTKFLKPSVAGFLLQKELDYLVGAVSNPKRPFAAIVGGSKVSSKIGVIESLLEKCDILLLGGGMIFTFYKAQGFPVGSSLVEDDKLELATSLLAKAKAKGVSLLLPTDVVIADKFAPDAQSKVVPASEIPDGWMGLDVGPDSVKTFNDALDTTKTIIWNGPMGVFEFDKFATGTEAIAKKLAELSGKGVTTIIGGGDSVAAVEKVGVADVMSHISTGGGASLELLEGKELPGVVALDEAVVVAV

SEQ ID NO: 32599 - protein, 414 aa, Matricaria chamomilla
MKPASSSADSGTESCSSKGVAKTGEGLRQYYLQHIHDAQLQVRQKTHNLNRLEAQRNELNSRVGMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCAFIRVSGSELVQKYIGEGSRMVRELFVMAREHAPSIIFMDEIDSIGSARMESGSGNGDSEVQRTMLELLNQLDGFESSTKIKVLMATNRIDILDPALLRPGRIDREIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 32600 - protein, 404 aa, Oryza sativa (japonica cultivar-group)
MDPCPFVRVLVGNLPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 32601 - protein, 420 aa, Bacillus clausii KSM-K16
MTEIKVPELGESITEGTISQWLKEVGDYVEQGEFIAELETDKVNAEIPVDTAGVIKEFKREPGDTVEIGEVIAIIDESGSAGGSSATSESTKEEATAKEEAPQEEKQAEQTQQPEKEEAVSNNRPLASPAARKLAREKGISLDAITPTDPTGKIRRQDIEAHQAKPKQTEAPKAQPSSAPVSEGEAGKPVERQKMSRRRQTIAKRLVDVQHETAMLTTFNEVDMSAVMNLRSRRKDAFSEKHGVKLGFMSFFTKAVVGALKEFPLLNAEIQGDELLIKKFYDIGIAVSTDSGLVVPVLRDADRLSFAGIEKGIGELGKKARDNKLQLADMQGGTFTITNGGVFGSLWSTPILNAPQVGILGMHKIQMRPVAIDNERFENRPMMYLALSYDHRIVDGKEAVSFLVKIKQLIEDPEQLLLEG

SEQ ID NO: 32602 - protein, 160 aa, Oryza sativa (indica cultivar-group)
MEHQGQHGHVTSRVDEYGNPVGTGAGHGQMGTAGMGTHGTAGTGGGQFQPMREEHKTGGVLQRSGSSSSSSSEDDGMGGRRKKGIKEKIKEKLPGGNKGEQQHAMGGTGTGTGTGGAYGQQGHGTGMTTGTTGAHGTTTTDTGEKKGIMDKIKEKLPGQH

SEQ ID NO: 32603 - protein, 451 aa, Synechococcus elongatus PCC 7942
MPRPSRGNARWVAFQTLTTIREGAFADLALDRHLQRSGLVGADRRLVTELVYGCVRRQRTLDALIDLLAQRPAAQQPPVLRTVLQLGLYQLRYLEQIPTAAAVAETVQLAKQLGLGGLSGAVNAILRQYLRQSEERDPLPLPSDPIAALAIHQSFPDWLVQLWSDRLGLDEAEFLCHWFNQPPSIDLRINPLRTERSQVQAALEAVGIRSTPDPQLPQALRLIDPPGPIRQLPGFDEGWWMVQDSSAQLIAHLVDPQPGETVLDVCAAPGGKSTHLAELMGDRGQVIACDSSAKRLRKVQENAQRLQLSSITTRAIDGRQIKGIQADRILVDAPCSGLGTLHRHADGRWRQSPDSVAELAQLQSEILDAAAACLKPAGTLVYATCTLHPAENEAVIEQFLQRHPDWQMAPLAADSPFQAWAEANGTLRIWPHRHDRDGFFGARLQRSPARD

SEQ ID NO: 32604 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKINPETTLFLVASKTFTTQETMTNAQSARDWLLKATKDESAVAKHFAALSTNAKDVEKFGIDTN

SEQ ID NO: 32605 - protein, 90 aa, Triticum aestivum
  misc_feature (77)..(77): Xaa can be any naturally occurring amino acid
TLGASWSLRSDFFDGIEHREIRSSADCLHEIDEHHNERAMDGMQDLVLILKRITGDIDDSGADHYPWLYTMGNDLEXSRGFLFGTVDSFK

SEQ ID NO: 32606 - protein, 475 aa, Candida albicans SC5314
MSLEDDEALFEDLYGDDEKQEEKQDTVQKEVESTEKETTVVETASATENASSAEVETTTEGESESVPPPPPPPIPASGDVNAQSNTAQDNATSTAPGSVPAGMPQFPFDPAQFQQYAAANGLQFPGNANQQNFGAAGGVPPPPPPAPTANATSAESAGGPSRKCFIGGLSWDTTEEALVSHFQKYGNIVDYTIMKDSATGRSRGFGFLTFEDAKSVDALLKDRHVLDGKLIDPKRAISKEDQEKVGKIFVGGIDPMVTEEEFDNFFSQFGKIIDCQLMIDKDTGRSRGFGFVTYDSPAAVDKVCVNKYLTLKGKAMEVKRAAPRGQHNQQVMMQQQQQQQQQQAQQQAQQQAMYPYGSYGFQQMNPGAMNPAMSQEYMRYYQWFMYQQAQAAQQQQQSGTSASPEAQPAQPLNPQQQAAEEESEKSDEQARPAIPTGPKRAPPTGPSYRGGGRGGGRGGYRRGRGYHPYSRGGRR

SEQ ID NO: 32607 - protein, 908 aa, Candida albicans SC5314
MSDDEAFDIAGSLALKDEDDYSDSSSNEGEDFQDEIIPSDDEKEPSPPPKKKSKPNPQAFPSLELSDNEGNNDDDDDDDSKINSYFINNNPTAKKAKAGSFASFGLTKFILANIAKKGYKQPTPIQRKTIPLIMEGRDVVGMARTGSGKTAAFVLPLIERLKSRQPGGVRAVILSPSRELALQTYKQVKEFSHGTNLQSIVLIGGDSLEEDFSKMMTKPDIIVCTPGRFLHLKVEMQYDLMTVQYIVFDEADRLFEMGFAEQLNELLASLPSNRQSLLFSATLPRSLVDFAKAGLTNPVLVRLDAESKISDQLQMAYFTTKKNEREANLLYILQEVIKMPLGSEEQIKKLKDMDKRKIDSDSEDDDDDEERKKGKKRYKFKKERLPPANRLPSPHSTIVFVPTKHHVEYVTKLLRDAGYLVSYIYGTLDQHARKNQLYQFRVGLTNVLVVTDVAARGIDIPVLANVINFTLPASSKIFIHRVGRTARAGNKGWAYSIVNEKELPYLLDLELFLGKKILLTSMHEAKVEMLKKSSTGTFIPPVVNYTERLVLGSVPRVDLETFQELYENLLRNNYEIKVLKDVAAKGEKLYHRTRQPASQESLKRSKEIIESSWDDQHLLFGENLEKQKDAFLAKLQDRNSKQTVFELKGSDESLVEFMNRRRRQLAPIQRKAKERKELLAKERLAGLTHGIEDEILRADGENGYGVDEDELQEAFEDADKKKSFRDPQFFLSHYAPASVIQDQQLSLSTSFANEAQAATFDLDNDDKIQTNKQVMRWDKKKGKYINSKSTDKKYIISENGTKIPASFRSGKFDEWRKQRNLKPTSTVEDDSNKRFKHKQQRAPKLPDKFRDDYHKQKKKVEKAIESGVNVKGFHTPQQEIKSTEQIRKARLLKEKRKAKNARPSKKRK

SEQ ID NO: 32608 - protein, 171 aa, Oryza sativa
  misc_feature (165)..(165): Xaa can be any naturally occurring amino acid
MGASRKLQGEIDRVLKKVQEGVDVFDSIWNKVYDTENANQKEKFEADLKKEIKKLQRYRDQIKTWIQSSEIKDKKDPKEKAKAETRDWLNNVVSDLENQIDNFEAEVEGLSIKKGKQRPPRLVHLEKSITRHKAHIKKLESILRLLDNDELSPEQVNDVNDFLDXYVERNQ

SEQ ID NO: 32609 - protein, 354 aa, Bacillus thuringiensis serovar konkukian str. 97-27
MEKRIVCLAGDGVGPEVMESAKGVLHMVERLYGHHFHLQDEHFGGVAIDLTGQPLPQRTLAACLASDAVLLGAVGGPRWDGAKERPEKGLLALRKGLGVFANVRPVTVESATAHLSPLKKADEIDFVVVRELTGGIYFSYPKKRTDEVATDTLTYHRHEIERIVSYAFQLASKRKKKVTSIDKANVLESSKLWRTVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGAETTTSFTKAVMQEMEEQALVGRGR

SEQ ID NO: 32610 - protein, 401 aa, Oryza sativa (japonica cultivar-group)
MASKRSVGTLTESDLKGKKVFLRADLNVPLDDSQKITDDTRIRASVPTIKFLMGKGAKVILASHLGRPKGVTPKYSLKPLVPRLSELLGVDVVMANDCIGEEVQKLAATLPDGGVLLLENVRFYKEEEKNDPEFANKLASVADLYVNDAFGTAHRAHASTEGVTKYLRPSVAGFLMQKELDYLVGAVANPKKPFAAIVGGSKVSTKIGVIESLLAKVDILILGGGMIYTFYKAQGYAVGKSLVEEDKLELATSLIEKAKSKGVSLLLPTDIVVADKFAADAESKTVPASAIPDGWMGLDIGPDSIKTFSETLDTTKTVIWNGPMGVFEFEKFAAGTDAIAKKLADITAKGVTTIIGGGDSVAAVEKAGLADKMSHISTGGGASLELLEGKTLPGVLALNDA

SEQ ID NO: 32611 - protein, 368 aa, Oryza sativa
MDYDELDSMERETTATPMARSLFLPSHHVAVTPYKLPDAATSTLITAVPRTERGFVVELLGELWVLVGPISSLEQEGFQDRFGFLRYGEDGRIEGELERILGPQCLISDSWEVHSPDWCDPGVNFGEFLGSRIWPTVPARNRGNWGPIWCQLGSNLEVEAIDPAGEMIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQAAKRLKTNVKVA

SEQ ID NO: 32612 - protein, 171 aa, Aspergillus ochraceus
MGVSGAGKTTLLDVLAQRKTEGTIQGSILVDGHPLPVSFQRSAAYTEQLDVHEPYATVREALEFSALLRQSRDTPEADKLRYVDVIIDLLELHDIADSLIGKVGTGHGLSVEQRKRLTIGVELVSKPKILIFLDEPTSGLDGQSAFNTVRFLRKLADAGQAVLVTIHQPSI

SEQ ID NO: 32613 - protein, 250 aa, Arabidopsis thaliana
MRGTTDEEDGVMNFSDVLMMSDDVLSSGEVEEDSFGFRFTGNDAPQMLCFGGGNQNDTDLLFSQPSFSPASPLSSRNNACVVNDQSFRSNKKTGSADGHDRVCDPKPGKRCKRDQKKSSLGNAKVKKEKVGEKITTLQHLVSPYGKTDAASVLHETMGYIKFLQDQVQVLSTPYFKHNPLDDEDTGEVNPTMKVKELRSNGLCLVPLAWTVHVANTNGADLWSSAILSPLTSHTNSEPVEIVEVKSHKDK

SEQ ID NO: 32614 - protein, 543 aa, Triticum aestivum
MIEQVCTKKQAGTGPEFPGPRASQQHQPTNTAPVPARPATMVATAKIPQRQLFIDGDWRAPALGRRLPVINPTTEASIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLRIEGGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRDRCQRLAEEIDAGCIWVNCSQPCFCQAPWGGNKRSGFGRELGEGGIDNYLSIKQVTEYTSDAPWGWYKAPAN

SEQ ID NO: 32615 - protein, 828 aa, Aspergillus nidulans FGSC A4
MTFNKAMSSMPVSSSSRSPLPSPSPLTERRLFRTFSGLSASSRPRSPTGNGHAPVTEEISEIKRYEDFTTIDWVQDAVHEQARRRIKRQEGSGFWDKEGTFKWRLKVRESYDAGQAWLVITIVGAVIGLIAAVLNIITEWLSDIKLGYCTTAFYLNQQFCCWGAEGAAKLVKSFAPYAAGSGISEIKCIIAGFVMKGFLGGWTLLIKSIALPLAIASGLSVGKEGPSVHFAVCTGNVISRFFTKYKRSASKTREVLTATAAAGVAVAFGSPIGGVLFSLEEVASYFPLKTLWRSYFCALVATGVLSVMNPFRTGQLVMFQVRYDRSWHFFELIFFVIIGIFGGLYGALVIKWNLRVQAFRKKYLSQHAVVESVILAVVTAVICFPNMFLKINMTEMMEILFQECEGEHDYHGLCESKYRWSMVFSLATATILRIFLVIISYGCKVPAGIFVPSMAIGASFGRMVGIMVQALHESFPDSKFFAACEPDLPCITPGTYAFLGAGAALSGIMHLTISVTVIMFELTGALTYILPTMIVVGVTKAVGDRFGNGGIADRMIWANGFPFLDNKEDHVFNVPVSHAMTTDPVSLPASDFPVREAEHLLNDNKFQGFPIIEDRSSKILVGYIGRTELRYAIDRARREGMISPSAQCVFTKDAAEASVARRASSTLQRTLLTPDTFDNIESSSGASFVDFSRYIDNTPLTVHPRLPLETVMEIFKKMGPRVILVEHRGRLTGLVTVKDCLKYQFKVEAEEQALAATHHPELPLGAYQAKDNGTLEERIWNLMQKIGSRFSKSSGQPRDAMPLPQDDQSPIGVGNDADGRMVELEERP

SEQ ID NO: 32616 - protein, 394 aa, Ostreococcus tauri
MVFEQKKLKNFTLNFGPQHPAAHGVLRLVLEMNGEVVERADPHIGLLHRGTEKLIEYKNYIQALPYFDRLDYVSMMAQEHAYSLAVENLLHCPVPLRAQYIRVLFSEITRLLNHLLALSCHAMDVGALTPFLWAFEEREKLMEFYERVSGARLHASYIRPGGVAQDLPQGLCDDMHTFCQTFASRIDEMEEMLTQNRIWKQRLVDIGTVSAKDAISYGFSGVMLRGSGVAWDLRKTQPYEVYESLEFDIPVGSQGDCYDRYLIRIEEMRQSLRLIAQCLNKLPQGLVKVDDKKISPPSRKHMKESMESLIHHFKLFTEGFIVPASETYVGVEAPKGEFGVYLVSNGTNKPYRCKIRAPGFVHLQALDFMSKHHLLADVVTIIGTQDIVFGEVDR

SEQ ID NO: 32617 - protein, 452 aa, Methylobacillus flagellatus KT
MKAGTQKTLTHSDLVEQGVRFLLASYVDLHGVPKAKAVPISHFDRMMNGSEMFTGAALDGVPQEISDEEVAAHPDMGSAIVLPWSKDIAWLPSDLYTQGEPFNACSRTILKKVRQQAAELGMAMQLGIEAEFFVLKDQEAGGFSPISTRHHLKKPAYDVARLLDNKPWLSELVEAMDSLDWGVYSFDHEDGIGQFEIDFSYFEVLRMADNFTFLRMMANEIARKHGGFASFMPKPYGDRAGSGAHFNISLTDINTGLNLFEPEQDDPRGCGLSTLGYQFIAGVLRHLPAICAVVAPTVNSYKRLVKQGSMSGFTWAPVFCCYGNNNRTNTIRIPLGGKRIEIRAVDSACNPYLGAAMILAAGLEGIRENLDPGDPHLDNMYEKTPEELASLGIRELPKTLEEAIDAFEADPLSRQVFGDQMFSAWTQYKREEWLSYITHVSDWEYDRYLKLF

SEQ ID NO: 32618 - protein, 560 aa, Triticum aestivum
MAAAAVASNGGAAPVPGRLASVYSEVQTSRIAHALPLPSVLRSHFTLADGPASTAAGSPDEIAKLFPCLYGQPSAAVVQSAEPVETKPLKIGVVLSGGQAPGGHNVICGIFDYLQERAKGSTMYGFKGGPAGVMKGKYVELTTDFVYPYRNQGGFDMICSGRDKIETPEQFQQAEDTVNRLDLDGLVVIGGDDSNTNACLLGEYFRGRNLKTRVIGCPKTIDGDLKCKEVPTSFGFDTACKIYSEMIGNVMTDARSTGKYYHFVRLMGRAASHITLECALQTHPNVALIGEEVAEKKETLKNVTDYITDVVCKRAELGYNYGVVLIPEGLIDFIPEIQKLIAELNEILAHDVVDEAGAWKSKLEPASRELFDFLPKTIQEQLLLERDPHGNVQVAKIETEKMLIAMVETELEKRRAAGKYSAHFRGQSHFFGYEGRCGLPTNFDSSYCYALGYGAGALLQFGKTGLISSVGNLAAPVEEWTVGGTALTALMDVERRHGKNKPVIKKAMVELDAAPFKKFASLRDEWASKNRYISPGPIQFSGPGSDASNHTLMLELGAEI

SEQ ID NO: 32619 - protein, 480 aa, Solanum demissum
MMQDVWTQLGPTIAAIMFTWTMYQNYFPHELRGHIRRYTDKLVSYFYPYMHIIFYELETEGWFERSKAYVAIERYLSKNSSTQAKRLKANAVKDGQSLVLTMDDHEEITDEYKGEKVWWISSQKPASRQTISLYREDEKRYFKLKFHKKNRDLITNSYLKYRGGRMWSGVVFEHPSTFDTLAMDPNKKQEIIDDLETFSKSKDYYAKIGKAWKRGYLLYGPPGTGKSSMIAAMANFLKYDVYDLELTSVKDNTELRKLLIDTTGQRETNKKKKEEEDKGKNEEDAVKEKMKKGGEAKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADIAENLMPKSSKENADTCLERLIKALETAKEEAKLKAEEEEKAKAAEKEKEEKDREEKKEVTATEEAENADNVNEKDNGVKENGDVSKD

SEQ ID NO: 32620 - protein, 302 aa, Solanum lycopersicum
SILLRDGMTRAPVVRFTTAKRAAELKFFVEDPLNFEILSLMFNKSSRFARLQGIQCAIAGKNLYMRFSCSTGDAMGMNMVSKGVQNVLDYLQSEYPDMDVIGISGNFCSDKKPAAVNWIEGRGKSVVCEAIIKEDVVKKVLKTEVAALVELNMLKNLTGSAMAGALGGFNAHASNIVSAVYLATGQDPAQNVESSHCITMMEAVNDGKDLHISVTMPSIEVGTVGGGTQLASQSACLNLLGVKGANRDAPGSNARLLATIVAGSVLAGELSLMSAISAGQLVKSHMKYNRSIKDISQVINSS

SEQ ID NO: 32621 - protein, 305 aa, Solanum demissum
MKAQVFNDGRKAHTTKIAVTAMSAMAAETVTFPVDLIKTKLQLHGESLVSSRRISAVRVVAEILRNDGILGLYKGLSPAIIRHMFYTPIRIVNYEFLRNSLVPADHTLSLSSKAIIGGISGVIAQVVASPADLVKVRMQADSRMASQGLQPRYCGPFDAFNKIIRTEGVRGLWKGVLPNAQRAFLVNMGELACYDHAKRFVINNNIANDNIYAHTLSSIMSGLSATTLSCPADVIKTRMMNQAADKQGNCKYRNSYDCLVKTVRVEGLKALWKGFFPTWARLGPWQFVFWASYEKFRQIASLSSF

SEQ ID NO: 32622 - protein, 210 aa, Brassica napus
EELSDEQIADNIIGVIFAARDTTASVMTWILKYLADNPNVLEAVTEEQMAIRKDKGEGESLTWGDTKKMPITSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTQYRWSIVGASDGIQYGPFALPQNGLPIMLTRKSEIDM

SEQ ID NO: 32623 - protein, 81 aa, Glycine max
MAQRTKNCRIKWWKHYHHTHLPNKTSLIQPKLAMGNVIPGYEISVRLAWEGEARDANGKVLQRVDRAVEIPYISDENAGED

SEQ ID NO: 32624 - protein, 356 aa, Cryptococcus neoformans var. neoformans
MSQYSHRFSFAPSSRGEVGEGVGYVNPPGWSADLKQEELLEDPKDQVEITPSLPQVGNRKTQLSAAIIIPIWIALSSAVILYNKYLYTNLAYSYPVFITAYHLGCAALGTRILRATTNLLDGLDKIEMTRELYLRSILPIGVLFSGSLILSNTAYLTLSVSFIQMLKAFTPVAILLISAAFKLQVLNSRLILIVLLISTGCVLAAYGELYFEMFGFICQVSAVAFESSRLVMIQILLQGLKMDPLVSLYYYAPVCAIINAFFIPFTEGFAPFRHFLRVGPLIMLSNAAVAFGLNVAAVFLIGVAGGLVLTLAGIFKDILLISSSCIFFGSPITRIQIFGYSLALVGLMAYKTSSSK

SEQ ID NO: 32625 - protein, 232 aa, Zea mays
  misc_feature (177)..(177): Xaa can be any naturally occurring amino acid
MDPSGPGPSSVVGAGGGEAPAVAPQRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGRAPESNPFAARAVRIYLRDVRDAHAKARGIPYEKKSSASARSRRRRPQEKRRCXLSSAAAAREAAAAASAGDGSSSGSVAAKAAPTPGGGQGSATTTAAPAPTSTSRVQ

SEQ ID NO: 32626 - protein, 242 aa, Glycine max
SLCFDDLVRKLELTMVSLRRRRLLGLCSGNSSFVTPLPLYCENLSGFENSNQQAKPKSEQPALSDDATNPDSNNVVQEEPGSSNASGSSSSKEQLIQQITGPPIKRRKRHRRKNLHNQEQCIMRGVYFKNMKWQAAIKVDKKQIHLGTLGSQEEAAHLYDRAAFMCGREPNFELPEEEKRDLSKFKWDEFLAMTRQAITRKKHKRRLSPGPGNSHDMLPLSKDDWDTKQGVIEDAEQETSVS

SEQ ID NO: 32627 - protein, 101 aa, Bacillus thuringiensis serovar konkukian str. 97-27
MKPNFSKGLLPAVVIEEGTKEVLMLAYMNEEAYEKTLKTKRTWFYSRSRRSLWNKGETSGHVQHVQSLYLDCDQDAIVVVVKQVGPACHTGEKTCFHYKII

SEQ ID NO: 32628 - protein, 107 aa, Bacillus thuringiensis serovar konkukian str. 97-27
MRNAFTLLFETIEERKNNPLPESYTNYLFSKGEDKILKKIGEECSEVIIASKNNDNEELVKEMVDVLYHCFVLLAEKNIPLKDIMEEVTERNGKLSRVGDRREIDTL

SEQ ID NO: 32629 - protein, 646 aa, Vibrio parahaemolyticus RIMD 2210633
MSSRKQARLEAKQFIDTLSVQPYPNSTKVYIEGSRPDIRVPMREISLADSLIGGTKEAPIFEPNEPVRVYDTSGVYTDPDYAIDLYSGLPKLREGWIEERNDTEILEDVSSVYAKERLDDETLDDLRYGNLPRIRRAKAGKCVTQLHYARKGIVTPEMEYIALRENMGRAQYRDDVLTQQHPGQSFGANLPKDITAEFVRKEVAEGRAIIPSNINHPESEPMIIGRNFLVKVNANIGNSSVTSSIEEEVEKLVWATRWGGDTVMDLSTGRNIHETREWILRNSPVPIGTVPMYQALEKVNGIAENLNWEVMRDTLIEQAEQGVDYFTIHAGLLLRYVPMTAKRVTGIVSRGGSIIAKWCLAHHQESFLYTHFREICEICAKYDVALSLGDGLRPGSVADANDEAQFAELRTLGELTKIAWEYDVQVIIEGPGHIPMHMIKENMDQQLEHCHEAPFYTLGPLTTDIAPGYDHITSGIGAAMIGWYGCAMLCYVTPKEHLGLPNKEDVKTGMITYKLAAHAADLAKGHPGAQVRDNALSKARFEFRWEDQFNLALDPDTARAFHDETLPQESGKVAHFCSMCGPKFCSMKISQEVREYAKDTEQVAADQAISIKMLDDPLEGMRKKSEEFRATGSELYHPAVHAEADE

SEQ ID NO: 32630 - protein, 102 aa, Zea mays
  misc_feature (66)..(66): Xaa can be any naturally occurring amino acid
MTGRGKGGKGPGKGGAKRHRKVRRDNIQGITKPAIRRLARRGGEKRKTGHNYEETRGAPKNFLEKXIRDADTYTEHARRKTDTAKDSDYAPKRQGRTPNGIG

SEQ ID NO: 32631 - protein, 124 aa, Bacillus subtilis
TKAVHTKHAPAAIGPYSQGIIVNNMFYSSGQIPLTPSGEMVNGDIKEQTHQVFSNLKAVLEEAGASFETVVKATVFIADMEQFAEVNEVYGQYFDTHKPARSCVEVARLPKDALVEIEVIALVK

SEQ ID NO: 32632 - protein, 316 aa, Oryza sativa (japonica cultivar-group)
MAGGGGGGNRLDLPVVDLASSDPRAAAESIRKACVESGFFYVVNHGVEEGLLKRLFAESSKFFELPMEEKIALRRNSNHRGYTPPYAEKLDPSSKFEGDLKESFYIGPIGDEGLQNDANQWPSEERLPSRRETIKMYHASALSTGKRILSLIALSLNLDAEFFENIGAFSCPSAFLRLLHYPGEVDDSDDGNYGASAHSDYGMITLLATDGTPGLQICREKNRNPQLWEDVHHIDGALIVNIGDLLERWTNCIYRSTVHRVVAVGKERYSAAFFLDPNPDLVVQCLESCCSESCPPRFSPIKSGDYLKERLSATYK

SEQ ID NO: 32633 - protein, 828 aa, Photobacterium sp. SKA34
MKMTRRAFVKANAAASAAAVAGISLPASATNLIVSSDETKIKWDKAPCRFCGTGCSVLVGTQNGRVVATQGDPKAPVNKGLNCIKGYFLSKIMYGKDRLQTPMLRMKNGQYDKEGEFTSVSWDTAFDVMAEKWKLALKKQGPSGVGIFGSGQWTVMEGYAASKMMKAGFRSNNIDPNARHCMASAVVGFMRTFGIDEPMGCYDDLEHADVFVLWGSNMAEMHPILWTRMTDRRLSHPHVKVNVLSTYQHRSFELADNGMIFEPQTDLAIANFIANYIIQNDAVNWDFVNKHTHFKRAQNDIGYGLRDDNPLQQQAANPNSGDIFPMNFEEYKASVADYTVEKASEMSGVAPEKLIQLAKYYADPKLKVMSLWTMGMNQHTRGVWMQSLVYNLHLLTGKIATPGNSPFSLTGQPSACGTAREVGTFAHRLPADMVVANPKHREIAEKIWKLPEGTIPPKPGYHAVLQDRMLKDGKLNAYWVMCNNNMQAGPNINEERLPGYRNPENFIVCSDPYPTVTAQASDLILPTAMWVEKEGAYGNAERRTQAWYQQVEAPGEAKSDLWQIMEFSKRFKVEEVWGEELINKMPQYRGKTMYDILFRNGQVDKFPLSEAQELNDDAKAQGFYVQKGLFEEYASFGRGHGHDLAPYDTYHQVRGLRWPVVDGKETLWRFKEGSDPYAKKGTDWDFYGKPDGKAWIISAPYEAPPEVPDSEYDMWLCTGRVLEHWHTGTMTRRVPELYKAVPDALCYLHPDDAKKRGLRRGDEVNVASRRGEVRCRIETRGRNRPPEGLIFIPFFDARILVNKLILDATDPLSKQTDFKKCPVKISKV

SEQ ID NO: 32634 - protein, 144 aa, Xanthomonas axonopodis pv. citri str. 306
MNRADQSPVSPPAARATIVFDGVCLLCNGWVKFLLRHDRHGRYRFAAMQGQAGRALLQQHGLDPDDPLSFLLVDATGAWTDSDAIVRVLAGLGGLWQLSGVLRLVPRRVRDLGYRLIARNRYRWFGRSDHCMLPTPEQHARFLD

SEQ ID NO: 32635 - protein, 438 aa, Bacillus thuringiensis serovar konkukian str. 97-27
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKTEEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEELRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEEVVSIAGKCCESGDMLIWDITLPKVASADLLAISCTGAYGYSMANNYNRIRRPAVVFVKGGTSQIVVERETYENIIGNDRIRIKELV

SEQ ID NO: 32636 - protein, 297 aa, Kineococcus radiotolerans SRS30216
MSDQYTFSNPVTRYHQEGFEPQPQDGPGLAGELSPAPDHGESTYRGTGRLTGRRALVTGADSGIGRAAAIAYAREGADVVLNYLPAEQSDAEEVARLVEEAGRKAVLAPGDLTDEAFARSLVATTVRELGGIDLVANVAGKQQHVEEITDLTSGQFEETMRTNLNSLFWIVQEAVPHLPPGSTIVNTASIQGYQPSPNLVDYATTKAGIIAMSQALAQQLAPKGIRVNVVAPGPVWTPLQVAGGQPDDAMPEFGQSTPLGRAGQPVEMAPAYVFLASAESSYVVGAVLDVNGGMPTP

SEQ ID NO: 32637 - protein, 249 aa, Triticum aestivum
MVADEKLPASGDANNSEQQLHDTDTNSRVEDMWKKMNSGLPAKMPKPAMVKLKTAAKEKKPKATNNWMTILGLPPKMASANDQVPKNEPPQTQHQTSEDAKKLAANALAAVRDAATAASGRGKVEIPEVRDFAGQDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDA

SEQ ID NO: 32638 - protein, 277 aa, Vibrio parahaemolyticus RIMD 2210633
MTPQIDRYAVFGNPIGHSKSPFIHTLFARQTNQSLTYTAECAPVGGFIEAAKAFFADGGKGCNVTLPFKEDAYQFASRLTERAQLAGAVNTLKKLDDGEIIGDNTDGAGLVQDLLQHQVVLEGARILIIGAGGAARGVIKPLLDQKPTSLTITNRTFSKAEELAELFSVYGPVTAKEMNIVAEEFDIIINSTSASLSGELPAISSSVFAANSTSYDMMYGKGDTTFNQWAKQHGAAHAYDGLGMLVGQAAESFMLWRGLRPGAKQILRELRKNLEGQ

SEQ ID NO: 32639 - protein, 186 aa, Ostreococcus tauri
MVNLPLLLFPKWVQKVIAQSNEVTLVLKSPQDLHPVLEILKNHSATQFKMLIDITAVDYPSREARFEVVYHLLSVQRNTRLRLKVQCSEHAIVESVTSLYPAANWFERETWDMFGICFTNHPDLRRILTDYGFEGHPLRKDFPLTGYVEFKYDDTKKRVVAEPVELAQQFRQFEFRSPWEVIPQQY

SEQ ID NO: 32640 - protein, 597 aa, Gibberella zeae PH-1
MAALDQHRGYVQDHYQEVKQERSPEYVDENNAAGYQIVREPLWNKGLAFTPEQRANKNLTGLIPHTIESFDTQCARAMKMIQTRQTPIDKYLYLSTLKDQNTDLFYRLLIDNVRELMPLVYTPTIGDVCLQYSSIYTRPEALYISIKQRKSIRAMLRNWPCQDPEICVVTDGSRILGLGDLGINGVGISIGKLALYTGAAGIHPSKTLPIVLDCGTNNEENLQDPFYLGLRQKRPSYPEQQAFMDEFMEATREVFPNMVVQFEDFDSEKAFGYLDRYRDQYRCFNDDIQGTGAVVLGGYIGAVEQSNVPIEEQRLVFMGAGSAGVGVAKQLVEYYTRRGLSEAAAREKFWLVDTKGLVTKDRGDRLAEHKKYFARTDNNGQQFRTLEEVIEYVKPSALVGLTATFGVFTEPVVRALKSSVQEGGLERRPILFPLSNPLTKAECTFEQAIEWTEGTVLFASGSPFNPVKAKFGDETHHTVYHPNQGNNVYIFPGLGLGAILAKASRVTDEMVYTSAAALAGSLNADEVHKGLIYPRIERVRDASVIVAREVMKAARRGGVSELPESQWAEWEEWGDVALTSFIKQHIYNPLCFADAKL

SEQ ID NO: 32641 - protein, 258 aa, Calystegia sepium
MAGRWSLQGMTALVTGGTRGLGHAIVEELSSLGAIAYTCSRNQKELDECLKNWKEKGYPVFGSTCDISQQSERENLIQLVCKQFDGKLHILVNSAATIIPKETLNLNAEDNSIVIGTNLMTSLNFSQLAHPLLKASGNGSIVFISSCASFVFVPVHTVYAATKGAINSLAKNLACEWANDNIRVNAVAPWAMRTSLTEAAREEAGGEILEALIQRTPQHRLVEPKEASAAVAFLCFPASSFVTGQVICVDGGATSYGL

SEQ ID NO: 32642 - protein, 113 aa, Pseudomonas syringae pv. tomato str. DC3000
MSKALQITDLHIGEGKAAVKGALITTHYTGTLEDGTVFDSSHERGKPFQCVIGTGRVIKGWDQGLIGMKVGGKRTLFVPAHLAYGDRTIGAHIKPGADLKFEIELLEVLTRDD

SEQ ID NO: 32643 - protein, 1543 aa, Cryptococcus neoformans var. neoformans JEC21
MSATGVPAELNNLGAPITATTQNPSGLANSQVTSGPASSATQHDEHRSSAGNTLADEENDKAVESEKAEVIDAAADGKQKRLAADSSEDIVTELEPHHVSIHRGKEEFAALERRYSTLSQQSQHELHRPTTRHSVRSSFSRKDRVVSRLTQDDAEKAKEGEGEFNLVDVLRSGRENQDEAGIKRKAVGVIWEDLEVIGAGGMRINIRNFSSAIIEQFMMPAFKILSIFGVNPFAPKPKAILHPSSGLLKPGEMCLVLGRPEAGCTTFLKTITNQRAGYMEIKGNVEYAGVGWKEMRKRYAGEVVYNQEDDDHLPTLTVAQTIRFALATKTPKKKIPGVSAKQFQDDMLDLLLSMLNIKHTANTIVGNAYVRGVSGGERKRVSIAEMFCSGATVCSWDNSTRGLDASTALDYAKSLRLLTDIMGQTTFVSLYQAGEGIYDQFDKVLVLNEGHVAYFGPAKEARQYMIGLGYRDLPRQTTADYLSGCTDVNERRFADGRDETNVPATPEEMDKAYKESEVCARMTREREEYKQLMAEDATAREDFRQAVLEQKHKGVSKKSPYTVSFLQQVFIIFKRQLRLKFQDHFGISTGYATAIIIALIVGSVYFRLPETASGAFTRGGLLFLGLLFNALTSFSELPSQMLGRSVLYRQNEYRFYRPAAFALAAVLADVPYNASVIFLFSIVLYFMGGLYSSGGAFFMFFLFVFLTFMVMSAFFRTLGVATSDYNVAARLASVLISFMVTYTGYMIPVQRMKRWLFWIFYLNPLSYGYEAIFANEFSRINLTCDSSYTIPRNIPEAGITGYPDTLGPNQMCSIFGSTPGDPNVSGSDYMATGYSYYKAHIWRNFGILLGFFAFFMFMQMLFIEVLEQGAKHFSINVYKKEDKDLKAKNERLAERLEAFRAGELEQDLSELKMRPEPFTWEGLNYTVPVPGGHRQLLNDIYGYVKPGSLTALMGASGAGKTTLLDVLASRKNIGVIEGDVLMNGRPIGTGFQRGCGYAEQQDTHEWTTTVREALRYSAYLRQPQHVPKQEKDDYVEDIIELLELQELADAMIGFPGYGLSVEARKRVTIGVELAAKPELLLFLDEPTSGLDGQSAYNIVRFLKKLCAAGQKILCTIHQPNALLFQSFDRLLLLQRGGECVYFGDIGPDSKVLIDYLERNGAKVPHDANPAEFMLEAIGAGSRKRIGSDWGEKWRNSPEFAEVKREIQELKAEALAKPVEEKSNRTEYATSFFFQLKTVLRRTNVALWRNADYQWTRLFAHLAIGLIVTLTFLQLDNSVQSLQYRVFAIFFATVLPALILAQIEPQYIMSRMTFNREASSKMYSSTVFALTQLLSEMPYSLGCAVSFFLLLYYGVGFPYASSRAGYFFLMILVTEVYAVTLGQAVAALSPTILIAALFNPFLLVLFSIFCGVTAPPPTLPYFWRKWMWPLDPFTRLISGLVSTVLQDQEVVCKDGEYQVFPAPSGQTCQQWAGAFAEAIGGYINNPDSTGDCQFCQYRTGQAFFTPLEISFSTRWRDFGIFICYVVFNILVLLIAARFLKWQRR

SEQ ID NO: 32644 - protein, 1501 aa, Candida albicans SC5314
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPASGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 32645 - protein, 322 aa, Triticum aestivum
  misc_feature (215)..(215): Xaa can be any naturally occurring amino acid
  misc_feature (262)..(262): Xaa can be any naturally occurring amino acid
  misc_feature (272)..(272): Xaa can be any naturally occurring amino acid
  misc_feature (284)..(284): Xaa can be any naturally occurring amino acid
DPRVRAHRNQLSSTTKYPQGGFRRHNPQAASRGASSTMDRAVLPAAVEPKKKGNVRFAFACAILASMTSILLGYDIGVMSGASLYIQKDLKINDTQLEVLMGILNVYSLIGSFAAGRTSDWIGRRFTIVFAAVIFFAGALIMGFSVNYAMLMFGRFVAGIGVGYALMIAPVYTVEVSPASARGFLTSFPEVFISFGILLGYVSNFGFARLSLPLXWCIMLGIGAVPSVLLAYMVLGMPESPRWLVMKDRLADAKDVLAQTSXTPEEAAERLXDIRRAAGSSEPXGDVVPCPKQGARGNRCGGLIFPRQGRANPIGDRIHFSG

SEQ ID NO: 32646 - protein, 247 aa, Glycine max
MYIASMGRSFKDSLKLLEADIHHANTLASDFPREYDGTCLQMRMSYSPAAHLFLFFVQWTDCNLAGALGLLRILIYKVYVDGTTTMSTLERKASIREFYAIIYPSLVQLQESVADTEDKKQKAVCMERYRKRDDEEHRQPSDIDIEREEECGICMEMNSKIVLPDCNHVMCLTCYHEWRTRSQSCPFCRNSLKRVNSGDLWVFTDNRDVVDMATATRENLRRLFMYIDKLPLVIPDFLFDTYDSHLR

SEQ ID NO: 32647 - protein, 271 aa, Synechococcus elongatus PCC 6301
MNLLDRSLSPDSLIFFGLILGRYLLIAGGLYWLFYGFLAERSTRRRVKHWPTWKKSIRSDVGLSIASALVFALLASWLTSTPVLIHTRLYTDVSQYGFFYLIFSFFLVLILQDTSFYFCHRLFHQPWLFRWVHRGHHRSQCPTPWTSFAFDLPEAVMQALLIIGIVFVFPVHVGILLAALVTMTLWSVFNHLGFSLFPDSGVSQWLAQWLIGPQHHLLHHQRYSFHYGLYFTFWDRLLGTQIPASQPQTQRSVRLALLTAAKPLAVRGKER

SEQ ID NO: 32648 - protein, 531 aa, Oryza sativa (japonica cultivar-group)
MGSADLVLKAACEGCGSPSDLYGTSCKHTTLCSSCGKSMALSGARCLVCSAPITNLIREYNVRANATTDKSFSIGRFVTGLPPFSKKKSAENKWSLHKEGLQGRQIPENMREKYNRKPWILEDETGQYQYQGQMEGSQSSTATYYLLMMHGKEFHAYPAGSWYNFSKIAQYKQLTLEEAEEKMNKRKTSATGYERWMMKAATNGPAAFGSDVKKLEPTNGTEKENARPKKGKNNEEGNNSDKGEEDEEEEAARKNRLALNKKSMDDDEEGGKDLDFDLDDEIEKGDDWEHEETFTDDDEAVDIDPEERADLAPEIPAPPEIKQDDEENEEEGGLSKSGKELKKLLGKAAGLNESDADEDDEDDDEDESSPVLAPKQKDQPKDEPVDNSPAKPTPSGHARGTPPASKSKQKRKSGGGDDSKASGGAASKKAKVESDTKPSVAKDETPSSSKPASKATAASKTSANVSPVTEDEIRTVLLAVAPVTTQDLVSRFKSRLRGPEDKNAFAEILKKISKIQKTNGHNYVVLRDDKK

SEQ ID NO: 32649 - protein, 376 aa, Oryza sativa
MATAAAASLQYALHGAASASAKPRSAAPGRSVRVVAARRSASADATAESKSGGHEVLLFEALREALIEEMKEDPTVCVFGEDVGHYGGSYKVTKGLAEMFGDLRVLDTPIAENSFAGMGVGAAMKGLRPIVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 32650 - protein, 320 aa, Vibrio vulnificus CMCP6
MIKKIGVLTSGGDAPGMNAAIRGVVRTALGAGLEVYGIYDGYLGLYEGRIKQLDRSSVSDVINRGGTFLGSARFPEFKEVAVREKAIENLKAHGIDALVVIGGDGSYMGAKKLTEMGYPCIGLPGTIDNDIAGTDYTIGYLTALNTVIESIDRLRDTSSSHQRISIVEIMGRHCGDLTLMSAIAGGCEYIITPETGLDKEKLIGNIQDGISKGKKHAIIALTELMMDANELAKEIEAGTGRETRATVLGHIQRGGRPTAFDRVLASRMGNYAVHLLMEGHGGRCVGIVKEQLVHHDIIDAIENMKRPVRNDLFKVAEELF

SEQ ID NO: 32651 - protein, 291 aa, Chlamydomonas reinhardtii
MALRAAQSAKAGVRAARPNRATAVVCKAQKVGQAAAAAALATAMVAGSANALTFDEIQGLTYLQVKGSGIANTCPVLESGTTNLKELKAGSYKLENFCIEPTSFTVKEESQFKGGETEFVKTKLMTRLTYTLDAMSGSFKVGSDGSAELKEDDGIDYAATTVQLPGGERVAFLFTIKQFDGKGTLDGIKGDFLVPSYRGSSFLDPKGRGGSTGYDNAVALPARADAEELLKENVKITKALKGSAVFSVAKVDPVTGEIAGVFESIQPSDTDLGAKPPKDIKVTGLWYAQLK

SEQ ID NO: 32652 - protein, 401 aa, Kineococcus radiotolerans SRS30216
MRALTWQGKRSVSVQDVPDPRIVDPTDAVVRITSTAICGSDLHLYEVLGPYMSKGDVLGHEPMGVVEAVGPAVANLQVGDRVVIPFNISCGHCFMCTRGLQSQCETTQVHEQGSGAALFGFSSLYGSVPGGQAEYLRVPHADYGPVKVGREGDGGLPDDRYLFLSDIVPTAWQGVQYADVPDGGTLAVLGLGPVGQFAARIGRHLGYEVIGVDPVAERRQMAQRHGVTAIDLTDGDADVVTQLRERTDGRGPDAVLDAVGMEAHGGAEGAVAKAAQTAVGLLPDALAQKVTETAGVDRLWAVRSAVEAVRRGGTVSLSGVYGGEADPLPMKTMFDKQLQFRMGQCNVRRWIDDLLPLVEDPADPLGVEDLTTHRVSLEDAPDAYEMFQEKRDGCIKVVITP

SEQ ID NO: 32653 - protein, 329 aa, Pisum sativum
MAASLQAAATLMQPTKLRSNTLQLKSNQSVSKAFGLEHYGAKVTCSLQSDFKELAHKCVEASKIAGFALATSALVVSGASAEGAPKRLTFDEIQSKTYLEVKGTGTANQCPTIDGGVDSFSFKPGKYNAKKLCLEPTSFTVKSEGVTKNTPLAFQNTKLMTRLTYTLDEIEGPFEVSADGSVKFEEKDGIDYAAVTVQLPGGERVPFLFTIKQLVASGKPDSFSGEFLVPSYRGSSFLDPKGRGASTGYDNAVALPAGGRGDEEELGKENNKSAASSKGKITLSVTQTKPETGEVIGVFESIQPSDTDLGAKAPKDVKIQGVWYAQLES

SEQ ID NO: 32654 - protein, 452 aa, Escherichia coli O157:H7 EDL933
  misc_feature (69)..(69): Xaa can be any naturally occurring amino acid
MTQRRDLQALIDAAPVGKMQWRVIICCFLVVMLDGFDTAAIGFIAPDIRTHWQLTAGDLSPLFGAGLLXLTAGALLCGPLSDRFGRKRVIELCVFLFGALSLASAFSPDLQTLVFLRFLTGLGLGGAMPNTITMTSEYLPARRRGALVTLMFCGFTLGSAFGGIVSAQLVPVIGWHGILVLGGVLPLMLFVALLVVLPESPRWQVRRQLPQAVIAKTVSAITRERYVDTHFYLIESASVTKGSIRQLFMGRQLPITLMLWVVFFMSLLIIYLLSSWMPTLLNHRGIDLQHASWVTAAFQIGGTLGALALGVLMDKFNPFRVLTLSYAIGAICIVMIGLSQDGLWLMALAIFGTGIGISGSQVGLNALTATLYPTQSRATGVSWSNAIGRCGAIVGSLSGGVMMAMNFSFDTLFFIIAVPAAISAVMLTLLITVVRQSTSVPDSLPRAGVVNE

SEQ ID NO: 32655 - protein, 332 aa, Spinacia oleracea
MAASLQASTTFLQPTKVASRNTLQLRSTQNVCKAFGVESASSGGRLSLSLQSDLKELANKCVDATKLAGLALATSALIASGANAEGGKRLTYDEIQSKTYLEVKGTGTANQCPTVEGGVDSFAFKPGKYTAKKFCLEPTKFAVKAEGISKNSGPDFQNTKLMTRLTYTLDEIEGPFEVSSDGTVKFEEKDGIDYAAVTVQLPGGERVPFLFTIKQLVASGKPESFSGDFLVPSYRGSSFLDPKGRGGSTGYDNAVALPAGGRGDEEELQKENNKNVASSKGTITLSVTSSKPETGEVIGVFQSLQPSDTDLGAKVPKDVKIEGVWYAQLEQQ

SEQ ID NO: 32656 - protein, 325 aa, Triticum aestivum
MAASLQAAATVMPAKIGGRASSARPSSHVARAFGVDAGARITCSLQSDIREVASKCADAAKMAGFALATSALLVSGATAEGAPKRLTFDEIQSKTYMEVKGTGTANQCPTIDGGVDSFPFKAGKYEMKKFCLEPTSFTVKAEGIQKNEPPRFQKTKLMTRLTYTLDEMEGPLEVRRRRTLKFEEKDGIDYAAVTVQLPGGERVAFLFTVKQLVATGKPESFRPFLVPSYRGSSFLDPKGRGGSTGYDNAGALPRGGRGDEEELAKENVKNASSSTGNITLSVTKSKPETGEVIGVFESVQPSDTDLEAPKDVKIQGVWYAQLESN

SEQ ID NO: 32657 - protein, 482 aa, Zea mays
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLDPSEPTHTKVKQLLFSLLLSRKDDVIPTFRSNFSSLLATVEAELAKGGKAEFNKLNDVTSFDFIGEAYFGVRPSATELGKGGPTKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAGDFVPDRFLGEEGSKLLQYVYWSNGRETENPSVDNKQCPGKNFVVLVGRLLLVELFLRYDTFTAEVGKELLGTSVIFTGVTKATSGPGSE

SEQ ID NO: 32658 - protein, 581 aa, Cryptococcus neoformans var. neoformans JEC21
MRSSSVLSLSWTAPRSHRRTVALLPIRQQRNTTIMRAMSNIIGGTESKVPSGTRPLSTRAHAVLSALNIPADNAAPIPGVFDGQWKGSGEEITSKCPATGEILARVKGASVEETQAAIAKSKEAYRIVRSMPAPKRGEVIRQIREALEAKVSELGDLVSLEMGKIKSEGKGEVQEFIDVCDFATGLSRTMTGRVLPSERPEHVIYEIPNPLGVVGILSAFNFPVGRSSPPNLTVALASGNSTIWKPAPSTPLTAIAVARLIQPVLEKNGLPGATAALVCGGIDVGKIIVGSEDIPLVSFTGSEKVGKEVGKAVNDRFGKTILELGGNNAVIVDKDADLPLALQSVLFAAVGTAGQRCTSTRRLILHKSIAQEFLSKLLPVYDAQAPSPHLMVGDPLQTSTLIGPLHNEAAVKKYEATLQAVTSRGGEILTQRSGRINGMNKEVEGGNWVWPTVVRPKKDDPCWKEEVFAPILFVTEFETLEEAIEINNSVPQGLSSALFTSDLRSLGKWLGPEGSDCGIVNVNVGTSGAEIGAGFGGNKSTGWGRESGGDAWKQYVRWSAATVNYSSKVSLAQGVTFGIDA

SEQ ID NO: 32659 - protein, 478 aa, Rickettsia conorii str. Malish 7
MISNFFNLIRIFRIISKKQILIDSRSPKYCRFIGYILALFFAPVSLIKKSREDYGKRLIDCLSDLGPIYIKFGQTLSTRADLVGTEIAGYLRLLQDKLPPFDGGVARRLITSLRGDIYVDEAISASKQKIATQSMTVSHDALPFLHLDDTPIAAASISQVHKAQLITGEYVAVKILRPGIHKKYNRDIKLLYFLAKIISKFSKAKRLKPIKVVDKFHETMKFELDLRLEAAAASELTDNMRNDINVIIPKIYWDLTSENILTTEWLDGTSIYDTLLLKEMGLEPAKISQDFAVMFFNQAYRDGFFHADLHAGNILVNKQGKIILLDFGIMGRLKEKDRLAVAESLFGFLRRDYKLVAKVHLRAGYIPSNTDLALFAQSCRAVTEPIVGTPIKNISIGKLLAHLFKITEDFGMEVQPELLLLQKTLIMVEGIGRQLDGNVNMWQLAEPWIKKWAVKNLSPEAKLLRLVKHDLDSLEDII

SEQ ID NO: 32660 - protein, 1127 aa, Solanum demissum
MADFQRSSLADRDIDQAIAALKKGANLLKYGRRGKPKFCPFRLSNYAVAEDRKNALKSLFSQNLDIKDESAVVWYHDKEEKQLELCHVSRIIPGQRTAIFQQYPRPEKEYQSFSLICNDRSLDLICKDKDEAEVWITGLKAIITRGRSRKGKYDARSETVFSDSPHGQRVTTSTSSIDQGDNQRTESLPQSRLGKAYADIIQYTAAGKSPTLVETGSFNLSSLSAGAVDNSNARSSTADTFRVSLSSALSSSSQGSCLEDFDNLGDVFIWGEGTGNGLLGGGKHRIGKSSGTRIDANTPKSLESSVVLDVQNISCGNRHAMLVTKQGEAFSWGEEAGGRLGHGAETDVSHPKLIKNFKGMNVELIACGEYHSCAVTSSGDLYTWGDGAKSSGLLGHRSEASHWIPKKVCGLMEGLRVSHVSCGPWHTALITSAGRLFTFGDGTFGALGHGDRSGCITPREVETFNGLKTLKVACGVWHTAAVVELMSGLDSRPSDAPSGTLFTWGDGDKGKLGHGDNKPRLAPQCITALVDKSFSEVACSYAMTVALTTTGRVYTMGSNVYGQLGCPLANGMSPICVEDYLVDSTVEEISCGSHHVAVLTSRTEVYTWGKGENGQLGHGDCENKCTPTLVDILRDKQVKRIVCGSNFSAAICVHNWALSADNSICFGCRIPFNFRRKRHNCYNCGFVFCKACSSKKSLKASLAPSTSKPYRVCDDCYDKLQKAIESEPFSRVPKVKAGNALYKASEQTDKESGFPLLVGHTSRLSSSDSFNRAQGRISRVDQYENRASSFQNENPPRESFSLSKSPISAFRVSKSLFSASLPSTRVVPQSTSPLLGKASALWSAIPAPYPPVRTAEVVVDNLKPINDSLSQEVKQLKAQLEAMLLGLFKNANGIRDGCGIKSEESAQLRLEELASKSQLLEAELGRKTKQLMDATAKAAVEAEKRRAAKHVIKSLTAQLKEVTERLPEEQISTSNLDFNVEQTSFNRTRPSNGKCVTTTTLTECSGSSNTVVSAKKSRGQKPERMLQVEPGVYLYLISLPDGGNELKRVHFSRKCFSEDEAEKWWNENGQKICEKREGRLSNGFLQSSLLFAITQETLVIFEQLDICIQTRTRSSSIQESAEDRGKS

SEQ ID NO: 32661 - protein, 172 aa, Nostoc punctiforme PCC 73102
MDLKSLVRDIPDFPKPGILFRDITTLLRDPEGLRYTIDFLTQKCKEAEIKPDYVIGIESRGFIFGSPLAYQLGAGFIPIRKRGKLPAAVHSIEYDLEYGTDCLEVHQDALRHSSRVLIVDDLIATGGTASATAKLVQKIGCELVGFGFIIELRDLEGRKYLPDVPIISLIEY

SEQ ID NO: 32662 - protein, 352 aa, Solanum demissum
MATELEELIGFLSAPSPPVKKIAVDIVRDYTGSEDGLESLGKYSNVVLPSLSRLLGEKKVVSEPAAQALVNLSQKPELAGKMVEMHMVRTSMETLYKQDCEITSLLIMLLVNLTQLDAGIDSLLQSADEKMHGLYVMKLVRSFCSSSCEGKVDPFEHVASVLVNISKKEDGRKLLLDQKRCLLKQIVRNDSKSLLRKRGVAGTIRNCCFEAENQLQNLLLISEFLWPALLLPVAGNKESSHLCPRTVYKDFFQQVYSEEDTRKMPLELASALSIEREPVTDPEIRVQVLEAIYLLILQEAGRRAFWSVNGPRILQVGYADEDDPKAMEAYERAGSLLIQESGLDEELTETSS

SEQ ID NO: 32663 - protein, 125 aa, Triticum aestivum
WGWWPGLSSSELYIVTTKQSRFTGALLKELAGVDFPSERIYGLGTGPKVKVLQQLQEMPQHQGLTLHFIEDRLATLKNVMKEPALDKWNLYLVKWGYNTQKEREEAGDIPRIQLIDLPDFSKQLK

SEQ ID NO: 32664 - protein, 450 aa, Geobacter sulfurreducens PCA
MSPHQVDEKLQGIYQDVLKRNPGEVEFHQAVAEVLESLGPVVTKHPEYLERKIIERICEPERQIIFRVPWQDDKGQVHINRGFRVEFNSALGPYKGGLRFHPSVYLGIIKFLGFEQIFKNSLTGMPIGGGKGGSDFDPKGRSDDEIMRFCQSFITELYRHLGEHTDVPAGDIGVGGREIGYMFGQYKRITNRWEAGVLTGKGLKWGGSLVRTEATGYGATFFINEALKVRKDSFDGKICTVSGSGNVAIYTIEKIHQLGGKCVACSDSNGVIFHEKGLDLDLIKQLKEVERRRIEDYASYHKDAKYIAGGNIWDIPCQVAMPSATQNEINGKDAKTLVKNGCIAVGEGANMPTTPEGVKVFLDAKIAYGPGKAANAGGVATSALEMQQNAQRDSWSFEDTEKKLENIMKGIHRLCHETAEEYGATGNYVLGANIAGFTKVADAMVAHGLV

SEQ ID NO: 32665 - protein, 180 aa, Vitis pseudoreticulata
MASSMVSSATVATINRATPAQANMVAPFTGLKSLSTFPGTRKANTDITSIASNGGRVRCMKVWPTEGLMKFETLSYLPPLTDEQLSKEVDYLLRMNWIPCLEFTKLYPYPHREHNRSPGYYDGRYWTMWKLPMFGCTDSAQVIKEVQEARTEYPNAHIRIIGFDNNRQVQCIAFIAYKPS

SEQ ID NO: 32666 - protein, 474 aa, Zea mays
MATAPASLSLSASTLPTRLRAAAVLAGMRWRQPQRGRMVVRAKIREIFMPALSSTMTEGKIVSWSAGEGDRVSKGDAVVVVESDKADMDVETFHDGIVAVVLVQAGESAPVGAPIALLAESEEEVPLALAKAQELSNGQPQQAPPAPTEDAAATPPPPPAPATAPTPVAVGTKGIASPHAKKLAKQHRVDLAKVTGTGPYGRITSADVEAAAGIQPKSKPAPAAAAAAAPPPVAAPSVGAVPQSAVLPPVPGATVVPFTTMQAAVSKNMVESLAVPAFRVGYPIITDKLDELYEKVKPKGVTMTVLLAKAAAMALAQHPVVNASCRDGKSFTYNSNINIAVAVAIDGGLITPVLQDADKLDIYLLSQNWKDLVKKARAKQLQPNEYSSGTFTLSNLGMFGVDRFDAILPPGQGAIMAVGASKPTVVADKDGFFSVKSKMLVNVTADHRIVYGADLAAFLQTFAKVIEDPESLTL

SEQ ID NO: 32667 - protein, 445 aa, Oryza sativa (indica cultivar-group)
MEVSASAAAEAGMMVGHGEWRDDDGRARRTGTAWTASAHIITAVIGSGVLSLAWAIAQLGWVAGPAVMLLFAFVIYYTSTLLAECYRSGDPCTGKRNYTYMDAVRANLGGAKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGAGVTSMQKDTIKAPPPSEAKVMKRATMVSVATTTVFYMLCGCMGYAAFGDRSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVVAAAGSIADVVDALKVYRPFSG

SEQ ID NO: 32668 - protein, 365 aa, Pseudomonas citronellolis
MNSAIKGTNVTALPQKIQTILDKGQGTAARALDKLPKIVQESLAKVLGYPYQYPDLDAFTKCLMAVQIKQGRIGFIGEDPIESRRQFDAQMLAILNKATQIESVEDIRLPLQSGTVFARHYHPAPNKKLPMILFYHGGGFVVGGLDTHDEVCRLIAKYAKVQVLSIDYPLAPEASPQLLIKSCEDALAWVYQNRRQLKIYKNRIAVAGDSAGGNISTVVAQHTAGKSYAPQAQLLIYPVVDFKSRHPSFYAYGEGLVLTSKDVDYVTQYYATQHNIALDNPLISPTYGNLRKLAPVYVITAGHDLLHDEGEIYSHKLRQSGVKVQYVDYPDQTHGFINLTPISSKAKRNTIEIAKNFRKFWDKHS

SEQ ID NO: 32669 - protein, 246 aa, Nicotiana benthamiana
MSNLDVSLDDLIKRNKSSSSRNPRPRTSGSGSGSGGPGPRRRPNRAAKRSAPYSSGPVHAPESTWDHDMFAEHAPAYPAARGAGGISGIETGIKLLISNLDYGVSNEDIKELFSEAGDIKRYSIHYDKSGRSKGTAEVIFSRRRDAEAAIKKYNNVQLDGKPMKIEFAGPNIGAPALPPIRNRLYRNPNPAPRSQQRGGGFRRPPRGGRGSMRKEGGRGRGRGENISAEDLDADLEKYHSEAMETN

SEQ ID NO: 32670 - protein, 122 aa, Sorghum bicolor
TPSAAVVKEELFGPVLYVMKFQSLKEAIEINNSVPQGLSSSIFTKRPEIIFKWLGPHGSDCGIVNVNIPTNGAEIGGAFGGEKATGGGREAGSDSWKQYMRRATCTINYGSELPLAQGINFG

SEQ ID NO: 32671 - protein, 275 aa, Nicotiana benthamiana
MASLDMTLDDMIKSRRNTQRGGRGQGRARRGRGGSFRGGRTTGAPRKVPLGVNARPSATRIAKSFRRTKNLPWQNGNGLFEDSLRAAGIPSGLESGTKVYVSNLDVGVTNSDIRELFSEIGELIRYAIHYDKNGRPSGAAEVVFARRSDAYQALKRYNNVQLDGKPMKIEVVAPPTDMPLSARVDVGRGNGRRTVVMMPGSARGRGSASAANRGSSQRGRGGFGTTSGRGRSRGRGGGRGRGRGGRGRKNGVEKSAEELDKELENYRATADAMQT

SEQ ID NO: 32672 - protein, 508 aa, Rickettsia conorii str. Malish 7
MNNTYYITTPIYYVNDIPHIGHAYTSVASDVIARFMRLRGFDVMFLTGTDEHGQKVEKAAINKNIDPQKFTDQTSESFRHLMTAMHISNDDFIRTTEHRHKKAVAVFWQKLLDNGTIYEGFYEGWYAVRDEAFFDESELTRDGLAPTGAPVEWVKEPSYFFNLSKWQDKLLEFYEANPDFIRPISRRNEVISFVKSGLKDLSVSRTTFNWGIKVPNNEKHVIYVWLDALANYISALGYLDEQSNYNKFWPADLHVVGKDILRFHAVYWPAFLMAAEVPLPKTIMAHGWWTNEGQKISKSLGNTIDPIKLIDEFGVDQVRYFLMREVTFGADGNFARSNLITRINSELSNKIGNLLQRTTSFVYKNNDAKVPLLTQGVIDKIYELPILKTASKFVEQNILLMDKTEINKILENIINLAEEANIYIDSEAPWNLKKTDPDKMLEVLYALLEVLRYIAIMLLPFIPSSANKMLDQLGVNKEERLFKHLIRDYTLTAGSNILEPTIIFPKFE

SEQ ID NO: 32673 - protein, 529 aa, Geobacter sulfurreducens PCA
MNAHELWQRYQTYLLFDADTGLILDVSRMAFSDDFFASMEPAMQRAFDAMERLEAGEIANPDENRMVGHYWLRSPELAPDPAIAAAIRETVDRVTAFAADVHNGVVTAPRARLFRNVLVIGIGGSALGPQFVADALGGHGDRMRPFFFDNTDPDGMDRVLETLGADGLAETLAIVISKSGGTKETRNGMLEAEAAYRRAGLDFSRHAVAVTGAGSELDRTAEAGGWLCRFPMWDWVGGRTSETSAVGLLPAALQGIPIRDFLDGARTCDTLTRRRETLRNPAALLALMWHHATRGSGSRDMVVLPYKDRLLLFSRYLQQLIMESIGKELDLDGTVVNQGLTVYGNKGSTDQHAYVQQLREGTNNFFVAFIEVLKDREGASLAVEPGFTSGDYLSGFLQGTRTALSEKGRESLTITIPAITPRTVGVLVALFERAVGLYASLVNINAYHQPGVEAGKKAAGGVLALTGEALAFLRREGGTLSATEIAAALGRPEEAETIFRSLLHAAANPDHGVVMEAASPLTRSRFSAR

SEQ ID NO: 32674 - protein, 226 aa, Geobacter sulfurreducens PCA
MNAQRIIVISFCVALVALFFILDLGRLLTFASLKANHGALLAFYGEHRTLTVAVFLAIYIIQTALSLPGATILSLAAGALFGAVAGTAWAVTGATIGATLAFLLTRYLFHDAVQRRFGPRLEGINRELEKAGLNYLLFLRLVPLFPFFLINLGAGLTRLPLRTFVLGTFVGIIPGGFVYVNAGASLAAIASPADIASPRVIGSFALLGLFSLVPVLYKKITAQRRT

SEQ ID NO: 32675 - protein, 277 aa, Oryza sativa (japonica cultivar-group)
MQGGGGGDSSGGGGGEAPRPSRYESQKRRDWHTFGQYLRNHRPPLELSRCSGAHVLEFLRYLDQFGKTKVHAAGCPFFGHPSPPAPCPCPLRQAWGSLDALVGRLRAAFEEHGGRPEANPFGARAVRLYLREVRDSQAKARGIAYEKKRRKRPPTSSSSSQAAAAAAAATSPASPAASPTPPPPPPTERSADVRPMPPEGHFFIPHPHFMHGHFLVPGGDADHHHQVSNAGNGGNTNTNTNTNTGGGGGNGDEMAVAMAAVAEAHAAGCMLPLSVFN

SEQ ID NO: 32676 - protein, 454 aa, Burkholderia mallei ATCC 23344
MKNLQRHLSARHIRFLALGSAIGTGLFYGSASAIRLAGPAVILAYIVGGAAVYMVMRALGEMAVREPVPGSFGHYATENLGPFAGFVTGWTYTLEMVIVAIADITAFGIYMGFWFPHVPQWIWVLAIVAIICGLNLCHVKVFGELEFWLSIVKVGAIVAMIGGGAAILFTGMRLGSGGAPSLANLWSHGGFLPNGVGGLVASLSVVIFAYGGIEVIGMSAGEAKEPERVIPRAINAVPMRILLFYVLTMIVLMSIFPWTGVGANGSPFVQIFSALGVRSAAEILNLVVISAAISAINSDIFGAGRMMYAMALQGQAPRALAAMSARGVPWVTVLVMAGALLVGVVLNYLMPKDVFLMVAASATFATVWVWLMILLSQVAMRRRLGAAEVAALKFKVPFWPVGPALTIAFMAFVIAMLGYFDDTRVALFVGAAWLAILALVFYTRIRPRLAAVAR

SEQ ID NO: 32677 - protein, 322 aa, Geobacter sulfurreducens PCA
MHAALSLVGDDLKNVELQFRKDLESDVYLIRKVGEYVLASGGKRIRPMLLLLSAKLCGYQGDRHVPLASVIEFIHTATLLHDDVVDNATLRRGNASANEVWGNEASVLVGDFLFSKSFSLMVEAGDLRILKVISGATTIIAEGEVLQLLCTSDLEMTQERYIEVVKSKTAVLLSAACEAGAILGTSSAEQQEALRDFGMDLGIAFQLMDDTLDYTASEEQFGKEIGHDLEEGKITLPLIHTLMKCSDEERETIAAVVEKEILEPGDFESVFTLVHKYGGIEYTVSVANEYIARCKAHLGAFVDSQEKAALIELADYVVNRKR

SEQ ID NO: 32678 - protein, 409 aa, Glycine max
  misc_feature (372)..(372): Xaa can be any naturally occurring amino acid
MPPVSFSLSFGKKKVYQELLFHQPQNCEPFKETKPSNLSETFLFSLILLYQLNIRMSRSQDPHPSRSFFPFGNPFRMISPKGSRMSPQLLAVLQAFEATLAERLKNLMPKSKDEILTLSWMTLAMKSLCESHNDIRTLMTALELPVSDWEDKWIDMYLDISSKLLDICNAFSSELSRLNQGNLPLKCALHNLDSASSKQYLRACSLLDDWRQHVSSRNPRIEKCSSMLDNLVGSLDLPKVKNSAKGKVLMQAMYGVKVETVFICRVFTAAFSGSSKKLSDLNVADIHSWAPDFRRLQDLVNEEIRVRFSGGKFTVLNELEAVDASVKILYPTIQAGVDTVETEWLVKTVEELRAGAEKLSQGIDLLAKGVDXFFQAVMTSRDTLLSSVRFDKTVNDRSPGRNRDMQVVH

SEQ ID NO: 32679 - protein, 312 aa, Vibrio parahaemolyticus RIMD 2210633
MATKTADFIWFNGEMVPWAEANVHVLTHAMHYGTSVFEGVRCYNTPKGPIVFRHREHAQRLKDSAKIYRFPIPYSVEEIMEATRETLRQNKLDSAYIRPLGFVGNVGLGVCPPVGAEMELIIAAFPWGSYLGEEALEKGVDAMISSWNRAAPNTIPTAAKAGGNYLSSLLVGGEARRHGYDEGIALSVDGYLSEGAGENIFVIKDRVITTPPATSAILPGITRDSIMTIARDKGYEVREANIAREALYLADEVFMTGTAAEVVPVATIDKIEVGSGKRGPITKELQEAYFGLFNGTTEDKWGWLDYVYPEQQ

SEQ ID NO: 32680 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSIMFVLPNGQAHKPSGARVPISLVEQLSLAMHWTWYLATMFLFIKDPVNMIVYFLVSQAVCGNLLAIVFSLNHNGMPVISKEEAVDMDFFTKQIITGRDVHPGLFADWFTGGLNYQIEHHLFPSMPRHNFSKIQPAVETLCKKYGVRYHTTGMIEGTAEVFSRLNEVSKAASKMGKAQ

SEQ ID NO: 32681 - protein, 500 aa, Leifsonia xyli subsp. xyli str. CTCB07
MSEQNREPAETSEESALQPTAAMRRKVTGLALAAAVGGFLFGFDSSVINGAVDSIQRNFALNAFVTGFIVAIAFFGCAVGAFVAGRLADRWGRLRVMLLGAVLFLISSVGAGLAFSVWDLGLWRIVGGLGIGIASVVAPAYIAEISPRQSRGRLGSLQQLAITLGIFVALLSDALLAGIAGSASSQLWLGLEAWRWMFLVGVIPSVVYGVLALTLPESPRYLLTTGRHKDARAIFSTMVPEGDVDRQVRDIERVIEEDKEGRRGTLAGNRFGLKPIVWIGVILSVFQQFVGINVIFYYSTTLWRAVGFTESNSLLITVITSVTNVVVTIVAILLVDRVGRRPILLTGSVGMALALGVMALSFTFAVKQDGAVSLPSPWGPLALVAANVFVVCFGASWGPLVWVLLGEIFPSRIRGKALGVAAAAQWIANFLVTVSFPPMSDFSLPFTYGMYAVFAALSWFFVFFKIPETNGMALEHAETLFQEAGGRRRGIQVRSSGDSV

SEQ ID NO: 32682 - protein, 330 aa, Silicibacter sp. TM1040
MTKTYQLVGIGNAVVDVISQCDDSFLDHMGIEKGIMQLIERERGEVLYAAMKERVQTPGGSVANTIAGAGALGLSAAFIGRVHDDALGRFYAEAMQDDGVDFVNPPVAGGELPTSRSMIFVSPDGERSMNTYLGISSELSSADVSNAVAGQAQIMFLEGYLFDKDKGKSAFMEAARDCRAGGGKPGIAISDPFCVERHRADFLKLIETELEFVIGNEDEIRSLFETDDLEAALAKTAAICPLVVCTRSGDGVTVVSQEGRIDVPVIKVVPVDATGAGDQFAAGFLFGLAEGRDLETCARMGNACAAEVISHIGPRPKADMRAVLKQAGLL

SEQ ID NO: 32683 - protein, 457 aa, Mortierella alpina
MAAAPSVRTFTRAEILNAEALNEGRKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSIMFVLPNGQAHKPSGARVPISLVEQLSLAMHWTWYLATMLLFIKDPVNMIVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 32684 - protein, 424 aa, Chlamydia trachomatis D/UW-3/CX [sequence omitted]

SEQ ID NO: 32685 - protein, 115 aa, Leifsonia xyli subsp. xyli str. CTCB07
MHILDQVDAASLKQDIPAFRAGDTVKVHVNIIEGSRSRVQVFQGVVIARSGEGVRETFTVRKISFQVGVERMFPVHSPVIDKIEVVTRGDVRRAKLYYLRELRGKKAKIKEKRDN

SEQ ID NO: 32686 - protein, 127 aa, Zea mays
MNSGFPNKMPKPAMTKLSTTEKQKKNKPTNITEVRDFAGKDIEIKKLVDANSKEAIEKARAGGAAPSAVDNILEQIRKKQKLSVLDKTKKDWGEYKEENRGLGEELDAYKKSSNQYLDKQSFLQRTD

SEQ ID NO: 32687 - protein, 431 aa, Oryza sativa (japonica cultivar-group)
MAIAVSGRWTRLRTLGRGASGAVVSLAEDGASGELFAVKTAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERPVSGTPAFMAPEVARGEEQGPAADVWALGCTVIEMATGRAPWSDMDDVLAAVHRIGYTDAVPEVPVWLSAEAKDFLAMCFARNAGDRSTAAQLLEHPFVAFACHEVKAAQPKPRWVSPKSTLDAAFWESETDDEEEVDEITESLCDRIKSLACPVSALPDWDSDEGWIDLLGEQCEACDSEAARESIDVARSAPSKVSSAATVPAAEVVLVGGGCCPSNEADAFDQSIGGDIQAADRSIERRNKVCAGSDNDVLPFRLVCNGICAMEFFQFFT

SEQ ID NO: 32688 - protein, 413 aa, Oryza sativa (japonica cultivar-group)
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTVRLITVASIGQQEVFCLGLINDPLVFSVNKSELTKSLFP

SEQ ID NO: 32689 - protein, 310 aa, Vibrio angustum S14
MANTADYIWFNGEIVPWADANVHVLTHAMHYGTSVFEGIRCYNTPKGPAVFRHEEHMVRLKNSAKIYRFPIPYSCDELMEICRETIRVNKLDSAYIRPLGYVGNVGLGVCPPVDTKMDLIVAAFPWGSYLGEEALENGVDAMISSWNRAAPNTIPTAAKAGGNYLSSLLVGSEARRHGYAEGIALSVDGYLSEGAGENIFVIRNGVLSTPPTTSAILPGITRDTIMILAKERGYEVREENIAREALYLADEIFMTGTAAEIVPVRSVDQITVGEGKRGPITKELQAAYFGLFNGETEDKWGWLDYVYPQK

SEQ ID NO: 32690 - protein, 168 aa, Citrus jambhiri
LGSQIKVSTAIELGALDTSSPPSAGSFKQDYRPILDPLIAFLNENNSPLLVNLYPYFAIVGDRQISLDYALFRSQQPVVLDPPLSYQNLFDAQLDATYAALEKAGGGSLDIVISESGWPTAGGDGALTNVDNAMTYNNNLIQHVKQGSPKKPRPIETYIFTMFDEKDK

SEQ ID NO: 32691 - protein, 526 aa, Vibrio vulnificus CMCP6
MSPKCRKLLKFDEVITMSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 32692 - protein, 243 aa, Brassica napus
MSVFLTNPRLTYPPPHALSTPRPSPTSVANLRLPAADFSRRFKSNFFSAELSSPQTRSVPVPVVFSDQQRRRSMEPSNVYVASSNTGMEIGSQETAKNPSLICAPVMADSIDKMVTEACKAQELGADLVEIRLDSLKDFNPLEDLKTIINKSPLPTLFTYRPKWEGGQYEGDENERLDVLRLAMELGADYIDVELQVASEFIKSIKGKKPENFRVIVSSHSYQNTPSVEDLSDLALRIQQAGA

SEQ ID NO: 32693 - protein, 859 aa, Oryza sativa (indica cultivar-group)
MGSSRFVLLLLLLLAVAACVARGQGGGNSSSAAAPAPAAGAGPFVPRDDILLDCGATGKGNDTDGRVWSGDAGSKYAPASLGSASAAGQDPSVPQVPYLTARVSAAPFTYSFPLGAGRKFLRLHFYPANYSSRDAADARFSVSVPAANVTLLSNFSAYQTATALNFAYIVREFSVNVTTPTMELTFTPEKGHPNAYAFVNGIEVVSSPDLFDISTPNLVTGDGNNQPFPIDAGTALQTMYRLNVGGQAISPSKDTGGYRSWDDDSPYVFGAAFGVSYPKDDNVTIAYPSNVPEYVAPVDVYATARSMGPDKNVNLAYNLTWIMQVDAGFTYLVRLHFCEIQYPITMINQRVFNIYINNQTAFQGADVIAWTNNNGIGSPVYQDFVVTTVGSGAMDLWVALYPDVQAKPQYYDAILNGLEVFKLPLSNGSLAGLNPVPTVEPSLDGGAVKKSSVGPIVGGVIGGLVVLALGYCCFMICKRRSRVGKDTGMSDGHSGWLPLSLYGNSHSSGSAKSHTTGSYASSLPSNLCRHFSFAEIKAATNNFDESLLLGVGGFGKVYRGEIDGGVTKVAIKRGNPLSEQGVHEFQTEIEMLSKLRHRHLVSLIGYCEEKNEMILVYDYMAHGTLREHLYKTKNAPLTWRQRLEICIGAARGLHYLHTGAKHTIIHRDVKTTNILLDEKWVAKVSDFGLSKTGPSMDHTHVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGDQSVASIDSDGLTPSAVFSQIMNPKGR

SEQ ID NO: 32694 - protein, 107 aa, Geobacter sulfurreducens PCA
MAKELYVGHMSYEATEDDLRRLFSVAGTVTSVHIITDPETGRSKGCGYVRMLTEEEAKEAIETLDGALLRNRVITVSVARPQKQATRPAPRRGKPGPGGRPGKKRPS

SEQ ID NO: 32695 - protein, 384 aa, Arabidopsis thaliana
MFSIHEGKPIRCKAAVSRKPGEALVIEEIHVDPPQAYEVRIKIICTSLCHTDVSFSKIDSGPLARFPRILGHEAVGVIESIGEHVNGFQQGDIVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTSFINPTLCGEKKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 32696 - protein, 362 aa, Arabidopsis thaliana
MTENSEKNDRLNDLTTFISTKTGVKGLVDAEITEVPSMFHVPSSILSNNRPSDISGLNLTVPIIDLGDRNTSSRNLVVSKIKDAAENWGFFQVINHGVPLTVLEEIKESVRRFHEQEPEVKNQYLPTDNNKKFVYNNDFDLYHSSPMNWRDSFTCYIAPDPPNPEEIPLACRSAVIEYTKHVMELGAVLFQLLSEALGLDSETLKRIDCLKGLFMLCHYYPPCPQPDLTLGISKHTDNSFLTLLLQDQIGGLQVLHEDYWVDVPPIPGALVVNIGDFMQLITNDKFLSVEHRVRPNKDRPRISVACFFSSSLSPNSTVYGPIKDLLSDENPAKYKDITIPEYTAGFLASIFDEKSYLTNYMI

SEQ ID NO: 32697 - protein, 710 aa, Xanthomonas axonopodis pv. citri str. 306
MRRPASAAYANPSRIRQGRPFPRGAVFDGKGTNFALFSAHATRVELCLFDEQGNETRVDLPEYTNEIWHGYLPDAKPGQRYGYRVHGPYAPTEGHRFNHNKLLLDPYARELDGDLIWSDELYGYTVGHPDGDLSFDERDSAPFMPKCVVVEDTYDWGDDTRLLKPWNETVIYETHVRGYTMRNPQVPEAVRGTFAGLAQPQVLQYIKDLGITAVELLPVHAYLDDQHLLDKGLRNYWGYNTIGFFALKSRYLSSGHRDEFRDMVKAMHKQGLEVILDVVYNHTAEGSELGPTLSFKGIDNASYYRLADDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGDTDNAEVLQIRERQMKNLLATLLLSQGTPMMLSGDERAQTQGGNNNTYCQDNEITWLDWENDPTDGRLTEFVKALTRLRKRYPILSRGRFLNGQYNEEAGLRDLTWLNPGGIEMDDAHWTDPAARSVGLLLEGKAQTSGVKELANDDTLLIVINAYHEGVTFTLPSSDEPVHWKLVLSTDEALEVDMMPAGASEFLAPPRSVSVFECKSDQ

SEQ ID NO: 32698 - protein, 249 aa, Prochlorococcus marinus str. MIT 9303
MVFNPAQKYKTAKHFIWITSPRISLLSFALIVSPWSNPALAEKLVPITTSEGMVLLQTSKSVSDYGSLMEAFLTQANLAYCGVASAVMVLNSLAIPAPPVDGFRNYHFWTQDNIFDSDSSQLVISPAKIKRQGMTLQEVQNLLSHHGVSSKRLHGDILSLSAFRSLLKTNLDDSSDRLIVNYDRRVIGQKGGGHFSPLAAYDAITDKVLILDVARYRYPSVWVKTHDLWRAMRTLDGISGLKRGILSIE

SEQ ID NO: 32699 - protein, 433 aa, Fusobacterium nucleatum subsp. nucleatum ATCC 25586
MYKTQMEAAKKGILTKEMKSIAESESIDEKVLMERVASGEITIPANKKHSSLLAKGVGTGLSTKINVNLGISKDCPNVDKELEKVKVAIDMKVDAIMDLSSFGKTEEFRKKLITMSTAMVGTVPVYDAIGFYDKELKDIKAEEFLDVVRKHAEDGVDFVTIHAGLNREAVNLFKRNERITNIVSRGGSLMYAWMELNNAENPFYENFDKLLDICEEYDMTISLGDALRPGCLNDATDACQIKELITLGELTKRAWERNVQIIIEGPGHMAIDEIEANVKLEKKLCHNAPFYVLGPLVTDIAPGYDHITSAIGGAIAAAAGVDFLCYVTPAEHLRLPDLDDMKEGIIASRIAAHAADISKKVPKAIDWDNRMAKYRTDIDWEGMFTEAIDEEKARRYRKESTPENEDTCTMCGKMCSMRTMKKMMSGEDVNILK

SEQ ID NO: 32700 - protein, 478 aa, Listeria monocytogenes EGD-e
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLQFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 32701 - protein, 364 aa, Cistus creticus
MTTVSISSWVQTYCVFNQATRSRSRSRSPSFNRFNLPIIPVSKPFRFFRPSNRLGTHQRRRIEQDPPKWAFDLKSYMIQKANSVNQALETAVSLREPLKIHEAMRYSVLAGGKRVRPVLCIAACELVGGEESMAMPAACAVEMIHTMSLIHDDPPCMDNDDLRRGKPTNHKVFGEDIAVLAGDALLAFSFEHMTGSTVGVSPARIVRAVGELAKSIGSEGLVAGQVVDICSEGLTDVGLEHLEFIHVHKTAALLEGSVVLGAILGGGSDEEVEKLRKFARCIGLLFQVVDDILDVTKSSTELGKTAGKDLVADKVTYPKLMGIEKSREFAEELKNDAVEQLRGFDQEKAAPLIALANYIAYRQN

SEQ ID NO: 32702 - protein, 411 aa, Synechococcus elongatus PCC 6301
MPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPATYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 32703 - protein, 369 aa, Cistus creticus
MSTVNVNLGSWSQPTCFVFNQKTRSRIPNFSSFKGFMASSSNFRSVSSSSSSSSSFIASVLSGKDTMKGEEENSGFDFQSYMDQMADSVNQALESAVSLREPLKIHEAMRYSLLAGGKRVRPLLCIAACELVGGDVSVAMPAACAVEMIHTMSLIHDDLPCMDNDDLRRGKPTNHKAFGEDIAVLAGDALLSFAFEHVAVSTVGASPDKIVRAVGELAKAVGKEGLVAGQVVDITSEGLNDVGLDHLEYIHVHKTAVLLEAAVVLGAILGGGTDEEVERLRKFAICIGLLFQVVDDILDVTKSSVELGKTAGKDLVADKVTYPKLMGLEKSREFAEKLRDDAVEQLRVFDQVKAAPLIALAHYIAYRQN

SEQ ID NO: 32704 - protein, 660 aa, Oryza sativa (indica cultivar-group)
MAHAFAGGTSAICRCPHDPGRAALVSRPRHRLCVLASSLPTPAIEGQGVELSVTTRRGRVLPVLKDCSLRVPPGQLWMLLGPNGCGKSTLLKVLAGFLNPSSGTVYINRPCSYVFQNPDHQVVMPTVESDVAFGLGKLNLSLDERPIQTLSGGQKQRVAIAGALAEASKVLLLDELTTFLDEYDQMGVIKAVRKSVGAGGEVSALWVTHRLEELRYADGAIYMEDGQTIIQERGTSAPSVWRSDGSVGIYRPHPVQSGLHRFIRMEGHEGGEEEGLGDQFERLPDEVLLDVFGRIGDVKALGRCALVSRRFHALVPLVDSVFVRVDCVISDDPPPSSAGSAQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGLTGASWILDAFEEPYRTAAQVLLKRRTYSLEMNSF

SEQ ID NO: 32705 - protein, 430 aa, Synechococcus elongatus PCC 6301
MPDDYGTQIAEITAREILDSRGRPTVEAEVHLEDGSVGLAQVPSGASTGTFEAHELRDDDPSRYGGKGVQKAVENVSAIEDALIGLSALDQEGLDKAMIALDGTPNKKNLGANAILAVSLATAHAAATSLNLPLYRYLGGPLANVLPVPMMNVINGGAHADNNVDFQEFMIMPVGAPSFKEALRWGAEVFHALAKVLKDKGLATGVGDEGGFAPNLGSNKEALELLLTAIEAAGYKPGEQVALAMDVASSEFYKNGLYTCDGVSHEPAGMIGILADLVSQYPIVSIEDGLQEDDWSNWKTLTQQLGSTVQLVGDDLFVTNPDRLQSGIEQGVGNAVLIKLNQIGTLTETLRTIDLATRSGYRSVISHRSGETEDTTIADLAVATRAGQIKTGSLSRSERIAKYNRLLRIEAALGENALYAGAIGLGPKGR

SEQ ID NO: 32706 - protein, 143 aa, Lachancea kluyveri
MFGRISTRALLRPAFTHRIPSVSLSRFLSTETKQAIESAIESAPVVLFMKGTPEFPQCGFSKATINMLGQQGVDPMKFAAYNVLEDAELREGVKEFSEWPTIPQLYVNKEFVGGCDIVMNMAQTGELAKLLEDADALVPEEEE

SEQ ID NO: 32707 - protein, 1279 aa, Oryza sativa (indica cultivar-group)
MVTPRAPELLQQDQDEEMLVPDQDVVVEGPQPMEDSGSTVENEQVPETSTSRFTWTIEDFSNHRKLYSDVFVVGGHKWRVLVFPTGNSVQSLSMYLDIADANEQPHGWSKYAQFSLAVINQLDSKYSLRKGDLYDPTKGYIVNDKCIIEAEVAVRKIVDFWNYDSKKETGYVGLKNQGATCYMNSLLQTLYHIPYFRKHSDNSVSTKELTKSFGWDTVDSFLQHDVQELNRVLCEKLENKMKGTTVEGTIQQLFEGHHMNYIECINVDYKSTRKESFYDLALDVKGCSDVYASFDKYVEVERLEGDNKYQSEKHGLQDAKKGMLFIDFPPVLQLQLKRFEYDFVRDTMVKINDRYEFPLQLDLDKDDGKYLSPEADRRVRNLYTLHSVLVHSGGGHGGHYYAFIHPALSDIWYKFDDERVTKEDMKRALEEQYGGEEELPHTNPGLNTTPLRFTKHSNAYMLVYIRESDREKIICNLDENDIPEHLKIRLRKENEEREYKKKEKAEAHMFTALKVARDSDFAEQIGKHIYFDLVDYDNIQSLRAPKHLTINQAKVDLSKEFGIPVQSQRFWLWAKRQNHTFRPVRPLTLQEEASSIGHLTDPSNKSLNSELKLFLEVALGQPKFIDLGLLVDNLTQIMTCVQENHPISVPPKTKDDILIFFKLYDPEKEELRYVGKLLVKASGKPADIVQKLQEMAGFQSDEDIELYEEVMFEPSVMCEPININDSFLSSQLEDGDIICYQKRCSPEKLDHYRCADVPSFFEYIQNRQVVHFRLLENPKDDDFTLELSKRFTYDDVVEKVANQLGLDDPSKLRLTQHLPYSQMPKSHYIKYRGLDHLSDMLRNGNQMSDILYYEILDIPLPVLQDLITLRVAFYHATNNEVSSHFIRLPKGSTMSDLIEDMKSKVELSYSDAEFRLFEVYKNKIRKVYQPSEKISVNEFNGLLCVEEVPEEEKNAGVRDRLVHVCHFIIEKQHIDYYGEPFFFLIRDGETLSDIKVRIQKKLLVSDEQFAKWKFAYIAHNRLAGEYFQDSDIVLSRFQKDVYGPWEQCLGLEHSDVTPKRSCLSNQVGRHSHANARLYWLVFSKGFFRKLPCVHLKIAPYFTIAGALISPNFSPVYFTPAGRAFSAARVGATEALRGGAVAAARDRSYEGGARWGLRWRHAERTSAAAAAAGRSCGDRDAEAALGGGCGGGARSGLHRRRRQQELRRRRAEKSSTAMVRRSCGGYTRVQQRRRQHVVGTLAATAHGGSESGMWELQQRVGAATTTRRCGRNGNTCMSIL

SEQ ID NO: 32708 - protein, 413 aa, Arabidopsis thaliana
MKGRISKIGSYAISSSIRDQHQQPCISCTTFNILAPIYKRLSHKDQSLRESDNRAYWLGRNHRIIDWLLYERSSIICLQEFWVGNEELVNLYEKRLGDAGYLSYKLGRTNNRGDGLLTAVHKDYFRVVNSRDLLFNDCGDRVAQLLHVELVPPYSQYDAHQEVLIVNTHLLFPHDSTLSIVRLQQVYKILQYVESYQKEVNLSPMPIILCGDWNGSKRGHVYKFLRSQGFVSSYDTAHRYTDSDAHKWVSHRNHRGNICAVDFIWLLNPNRYRKLLKTSWSEAVFGMFRYLLRRASLTAEDAFAFLKTDNDGDHITFMGFCETLRQLNLTGHCNGLTTKEIKDLWTQADIDGNGLLDYKEFQQRIWNQTWSEQRDAEDGEAKEKLRSVSPLDRLDRSHVAVPALGGKKRERGT

SEQ ID NO: 32709 - protein, 548 aa, Methylococcus capsulatus str. Bath
MYQYDQYDQRLVDERVAQFRSQTRRFLQGELSEDQFRPLRLMNGLYLQRHAPMLRVAIPYGVLSSRQLHKLAEIARRYDKSVAHFTTRQNIQFNWPRLEDVPDILAELATVQMHAIQTSGNCIRNVTSDPLAGVCPDEIEDPRPYCEIIRQWSTLHPEFSYLPRKFKIAVSGARKDRAATQVHDIGLQMVENEAGETGFEVLVGGGLGRTPIIGQTIRPFLAKTDLLSYLEAILRVYNRFGRRDNKYKARIKILLKETGIEDFTRRVEAEWVQIRQQLVLDTGEIERVKRHFTAPEYKTVAGPGLDAQAAADPRFAVWLRNNTTPHKIPGYRAVFLSLKARGVPPGDIADTQLDAVADLAERYSFGEVRATHTQNLVFADVHQDDLHELWQRLDSIGLATPNIGKATDMICCPGLDYCSLANASSISVAEDIYSRIDDLDYLHDLGDLRINISGCMNGCAHQSVGHIGILGVDKKGEEWYQLTLGGSSSNDASLGERLGPAIDKAHVAEAVETILQTYIELRQDGESFLDTVRRLGINPFQERVYAHH

SEQ ID NO: 32710 - protein, 588 aa, Camellia sinensis
  misc_feature (77)..(77): Xaa can be any naturally occurring amino acid
MLSGASAETPKPEFSPPPPQNPQSSSSQTHVFRSKLPHIPISNHLPLHTYRFQNLSQFPNRPCLLIGSTGKSYSFSXTHLVSRKVASGLSLLGIKKGDVIMLLLQNCAEFVFAFMGASMIGAVTTTANPFYTSAEVFKQFNASKSKLIITHSQYVDKLRDAGDNFPNWAKEFSVITIDDPPENCLHFSVLSEANESEIPTVSIDPDDPVALPFSSGTTGLPKGVILTHKSLISSVAQQVDGENPNLRLKGEDMVLCVLPLFHIYSLNSVLLCSLRAGTGVLLMHKFEIGALLELIQRHRVSVAAVVPPLVLALAKNPMVVTFDLSSIRMVLSGAAPLGKELEEALRARVPQAIFGQGYGMTEAGPVLSMCLAFAKQPFPTKSGSCGTVVRNAELKVIDPETGCSLGPNHSGEICIRGPQIMKGYLNHAEATATTIDVDGWLHTGDIGYVDDDDEVIVDRVKELIKFKGFQVPPAELEALLVSHPSIADAAVVPQKDDVAGEVPVAFVVRSNGLELTEDAVKEFIAKQVVFYKKLHKVYFVPCHSQSLLSGKILRKDLRAKLGHVRSLSNSLETIYMYLFDFHLRVSIN

SEQ ID NO: 32711 - protein, 508 aa, Oryza sativa
  misc_feature (208)..(208): Xaa can be any naturally occurring amino acid
MDLKRRDEGAEESFVKPLQLKVKDYPLLGVHISECQIYDLENHMICYQKRRDFTMISSQHKRRPCENKYCREYLVNICNQSAEGVAQKVWNFSKCRGMCSYRLYRKKNWEMLAEILDHAVNTLGYTSVHKLLNKGSYVVAVAEMLTSTPLEIWDLCFAQALSSMEIVMAGKACHQCRQMKRNFAVACTQVKKGVCPIKYCHRCLLKRXEFSSLYFLGRYDENDEEVGQMEAWICPKCRGICNCSCCRRKKGQQPTGRLVHTAKKGEQGAADEESTGRSLRIENSVEELLVEGDQIKLKGNIVVNKNFDGESSLAKDKNGSILGYNSAVSSPNKKVLPRGSLVTNILGADLEVKDVGPAIQLYEFCNSFGEIFQIRKGQPEQILQDIARDQEVEIVPELIAGFHKNLLSVIKEDRGEKNSIYITNGDAWLNDLGAYINELAFMSKELHLEFVNKGTLGYNKLSPCKLHVLNLLCDEALSTVKLRKLIEEQNGRAAERRNDAKAKLRAAK

SEQ ID NO: 32712 - protein, 466 aa, Aspergillus nidulans FGSC A4
MKAHTLVPILSLASATAAAAVPPSSKTPFGYASGSKESIANLKDKIENVVWILLENRSFDNILGGVKRKGLDNVVNNGPFCYPQNVSEPSSTQRCSVYKDFDSVKHDPDHSITGYNMELYGTYHPSDEAIRNGTLKPSMNGFVQQQLVHHKGMDPKVATEEVMGYYSEDEIPTLVNLVDDFTTFNYWHSCIPGFTNVHQPTNPNRLCAVSGTSDGHGENDNSFDVSGVEISSIFQVASENGISWKNYDGTNGDFLPDALFFNWTSENAQSSVVPLENFYQDAYLGLLPQLSYINPSCCDLDTNSMHPSGNVSFGQVLVKQIYDAVRTGPQWNKTLLLLTFDETGGFYDHVEPPLAVRPDDKTYVETAADGTDYTFTFDRLGGRMPTWLISPYTPKGHIEDYGVDPVTGQKASYSATSALKTLGYLWDLEDFTPRVEHSPAFDHLIGPTLRSSPETLANPHTFPDAV

SEQ ID NO: 32713 - protein, 880 aa, Arabidopsis thaliana
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGFARVFFSATPTFIRYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKLLKLIKLNVFICRNLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 32714 - protein, 434 aa, Fusobacterium nucleatum subsp. nucleatum ATCC 25586 [sequence omitted]

SEQ ID NO: 32715 - protein, 602 aa, Pichia angusta
MSYQRAVPSSSNHTMPERDRLDELLDAVKKEFDNLTRETTIYKDHHHDYELKINQQHQELTNIRNTVYELEQAHRTMKEAYEKEILRLKQDLENRDRLFQQQSLQQAQAQAQAQAQVKAQVQSQQHPLLDRPQGAFPQTPQQLPPPNLSGSPSDYRGAGFNGALPQINAQASGAKPEISQSTQLPPPPPVSTQEQQAASQTQTSPEQPPTAVQTSVVKTEADAGYVMRSQHNKPIPTFLKDFDSYSTLPYKKQHSEYYIVYNPKVPKKVDTSLVHSFDHTSVVCCVRFSKDGKFLATGCNKLTQVFSVETGDLVARLSDESSASSNGSYDTDTGDLYIRSVCFSPDGKFLATGAEDKIIRIWDLATRTIVKYLKGHEQDIYSLDFFPDGSKLVSGSGDRTVRIWDVFTGQCSLTLSIEDGVTTVAASPDGKLIAAGSLDRTVRVWDANQGFLVERLDSANESGNGHMDSVYSVAFTHDGKEIASGSLDRTVKLWSLKDLQKQQGSSKSNCEVTYVGHKDFVLSVCCTPDDEFILSGSKDRGVIMWEKATGEPYIMLQGHRNSVISVNVSPVMTQKRGVNGGYFATGSGDCKARIWRWEKVSS

SEQ ID NO: 32716 - protein, 514 aa, Oryza sativa
  misc_feature (36)..(36): Xaa can be any naturally occurring amino acid
  misc_feature (277)..(277): Xaa can be any naturally occurring amino acid
  misc_feature (323)..(323): Xaa can be any naturally occurring amino acid
MERMSRVAVAVLLLLCLQLQLGISGGGGGGHGARRXISFSVDPCQEVIIIFAAAAAAAAEQAGRQQGRMAVDVVDAVEPVRTPDAAAAAAAAQGLAAMARHAAASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKXDNEPVEGEPQELCEPSWLLRGGAAVHEDDGVRVRPKRHTIRASPRXRDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 32717 - protein, 229 aa, Rhodococcus sp. RHA1
MSAKSPSTARAVLFDVDGTLVDSNYLHVRAWQRAFREVGHDVDAWRVHRAIGLDSSLLLQSLLGDDADELGDRAKDLHTTYYLGARDSMRPLSGARELIRELHGRGVQVVLATSAPEEELDVLREILSVDSYIAHTTSSEDVDQAKPDPGVVRAAMDRASTSPDTAVMVGDAVWDGKAASRAGVTFVGLLSGGISRADLTEAGAAAVFEDAQDLLDNLESSPLAKLLVS

SEQ ID NO: 32718 - protein, 440 aa, Rhodococcus sp. RHA1
MTNESAGEPTRIVVVGSGFAGFECARALTRRLRGTDTRITLISAHDYMLYTPLLPEVAGGILDARFVTVPLAEALPNVELVKGNVDSVDFEARTVHVTDCEHGVEDVAWDRVVLTPGSVTRLFDIPGLAEHARGLKTPAEALYFRDQLLTQIELAERDTDPSVADARRTVVVVGASYAGTELTAQLRALADEAAARRNLDPAKIRFLLLDAADTVMPEVGEKLGGKVLDVLRSRGIDVRLETTLTELGPEHVTLDDGTVIPTRTVAWVTGVTASPLIDTLGLPTEKGRLTVRPDLSVDGHPDVFAGGDAAAVPDPRNSGSITPPTAQHAVRQGQTLARNVAASLGVGDPKPYGHRDMGLVVDLGPGFAVANPLGIQLSGFLAKVVTRAYHLYAMPNTANRWAVALAYLTDLLFPRPLVSIGLVTDSESRFAAGEGVGAQH

SEQ ID NO: 32719 - protein, 273 aa, Vibrio angustum S14
MDKYVVFGNPIGQSKSPFIHTLFARQTSQQMTYTSQLVAIDGFVQAADTFFNDGGKGCNITVPFKEQAYQYATKLTERARLAGAVNTLKKLDDGGVLGDNTDGEGLVQDLINQQVELKDQRILLLGAGGAARGVILPLLAQQPKQLIIANRTVSKAQQLAELFSSYGNVVALEQAELDNQTFDVIINSTSASLSGNVPAISPTVIGPNTTCYDMVYGSAITSFNGWAKEHGAVKVLDGLGMLVGQAAESFMLWRGLRPGAKQVQRELRRTLQE

SEQ ID NO: 32720 - protein, 513 aa, Desulfovibrio desulfuricans G20
MSSSGPLNPVLLLILDGWGIAPAGKGNAVSAARTPVLDSLMAAPCRSRLQCSGRSVGLPDGFMGNSEVGHMNLGAGRIVYQDMTRIDIAVEERQLSARPAIADMFDALKSSGGTLHLLGLVSDGGVHSHVRHLYALVEAARDACVPVCIHAFMDGRDTAPKSGLQFINDLEEVLVRLGHGRIASVTGRYYAMDRDRHWERNETAWNALVHGQGEFADSAAQAVENAYAAGQTDEFIKPVIVGSAAGIADGDGIFFYNFRADRARQLTRCFIDPSFDAFDRGRVPVLARFATMTSYDASFDVPVAFDKDPLEGTLGEVVSLAGISQFRIAETEKYAHVTYFFNCGREEPFTGEDRLLVPSPRDVATYDLKPEMSVYEVTDSLLAALDKGYGLIVCNLANLDMVGHTGVFSAAVKACEAVDACTGRIIDAFVERGGVVMVTADHGNAEQLLDAQGNPHTAHSMNPVPVALLGAPAAWRLVPEGKLGDVAPTIIDILGLHRPEAMTGQSLLVKESV

SEQ ID NO: 32721 - protein, 588 aa, Oryza sativa (japonica cultivar-group)
MASHALRLHPLLFSAAAARPAPLAARPGGGARRVHRRHSLAVVRCSSSAAQALKVKVFQQENYLANWIQALFNSLPPEDYVGGTLVLGGDGRYFNKDAAQIITKIAAGNGVGKILVGRNGLLSTPAVSAVIRKRQANGGFIMSASHNPGGPDNDWGIKFNYSSGQPAPETITDQIYGNTLSISEIKTADIPDVDLSSLGVVSYGDFTVEVIDPVLDYLELMENVFDFQLIKGLLSRPDFRFVFDAMHAVTGAYADPIFVEKLGADPVDYILNGVPLEDFGNGHPDPNLTYAKELVFTMFGSGAPDFGAASDGDGDRNMILGRRFFVTPSDSVAIIAANAQAAIPYFQSGPKGLARSMPTSGALDRVADKLNVPFFEVPTGWKFFGNLMDAGKLSICGEESFGTGSDHIREKDGIWAVLAWLSILAHRNKDKKAGERLVSVEDVAREHWATYGRNFFSRYDYEECESESANKMMEHLRDVIAKSKPGEKYGNYTLQFADDFSYTDPVDGSTVSKQGLRFVFTDGSRIIFRLSGTGSAGATIRIYIEQFESDASKHDLDAQIALKPLIDLALSVSKLKDFTGRDKPTVIT

SEQ ID NO: 32722 - protein, 218 aa, Yersinia pestis CO92
MTQDELKKAVGWAALDYVKPGTIVGVGTGSTAAHFIDALGSIKHQIEGAVSSSDASTAKLKSYGIPVFDCNDVDVLDIYVDGADEINGQMQMIKGGGAALTREKIIAAIARKFICIADESKQVGVLGKFPLPVEVIPMARSYVARELIKLGGLPEYRQNVLTDNGNVILDVHNLSILDAIALENQINGIAGVVTVGLFANRGADVALIGTANGVKVIG

SEQ ID NO: 32723 - protein, 838 aa, Neurospora crassa
MDVLDFSLLPTFVLSFTPDHRDWIQRHPLPGKQQCTYHMVDARRGSDHQQTPFTFFALSQRRTFRLASIRPSSLLTIQQRCGNGHRSRARYDFTVADRTPNQQVPIDPPNSDQHSNTPQPPASSSSTVELAPISPPPFPAAPPQPPSVTPSVPTSLPPLYVPQGPHDRPHAYTPSQVLGRRRLSDLDENGQDEYRLASIDVSVSTTSSAAATTTTYTSLRPLKRRRGIMSADIDGQNSSNGVGQSVSNGSRAEITMAVSNGNGTLKAASGPPNGSAWEANRPRLPSGNYHGHDREQFTRLLIQAMTEMGYNDAADKLSQDSGYRLENPTVAAFRAAVLDGDWGKAEELLNDAQVAGIADPGLRDGLILAAGADRNMMKLWLRQQKYLELLERRETPRALVVLRTELTPLCGDQHQKLEFLSSLLMCASAEDLKDKAGWDGARGESRHTLLSELSKFVSPSVMLPEHRLAALLSQAQEIQISNCLYHSTLQTPSLYKDHVCDRKAFPTIAKYKLDEHNGNEVWQVRFSHDGTRLASCGMERLVIIYSVPEFKVLHKLDTGDEQHDNRGVGNIAWSPDDKMLVTCAMNAKVWDTETGALLRTIDQFNEPVSSCAWASNYVLITGSFDKDRSICSWNFGSADVYKIVWTKDHRTEDLVLSPDRNWVVALDEQKRFHVYNYHTREQVYSHELKDRGTSLCISQDSTSLLVNTQVGTAILYDILTKDVIHEYNQHKGGDFLIRTYLGGANEGFVLSGSEGTLTDGSIYIYHRSTGTLVARLKGAHAPRCNSVTWNPSDPRMIASCGDDGLVKIWYPEWPDWDESMEHSGANNNGNVHVTARPR

SEQ ID NO: 32724 - protein, 400 aa, Methylococcus capsulatus str. Bath
MNRRQHEAGQPIPAAEQGGCLADAIRPFHVMAILARARELESSGRSIVHLEIGEPDFPTPEPVAAAATRFLAGGQVRYTPAAGLPELRERIAAYYAERYGVAVAPQRIFLTPGASGALSLALAVALSPGRRVMLADPGYPCYSNFVRLYSGDPHAVPVGAEQDFQLNAALCRMHCGGDVPVAISASPSNPTGTVMRTGVLRELVEWFEAEGGILISDEIYHGLEYGGRAVSALEFGQHTFVVNSFSKYFGMTGWRLGWVVVPEAYAAAVERVAQNIFISAPTLSQYAALAAFSEESRAELERRRRAFEARRDFLWGELVKLGFGVPVAPSGAFYIYADCSAFAEDSAEFAARLLETAGVAVTPGKDFGAQSPERYLRFAYTADIPVLQEAVGRIRRFVTG

SEQ ID NO: 32725 - protein, 955 aa, Flaveria brownii
MSSLFVEGMPLKSANESCLPASVKQRRTGDLRRLNHHRQPAFVRGICRRKLSGVSRIELRTGGLTLPRAVLNPVSPPVTTTKKRVFTFGKGNSEGNKDMKSLLGGKGANLAEMASIGLSVPPGLTISTEACEEYQQNGKKLPPGLWDEILEGLQYVQKEMSASLGDPSKALLLSVRSGAAISMPGMMDTVLNLGLNDEVVDGLAAKSGARFAYDSYRRFLDMFGNVVMGIPHSLFDEKLEQMKAEKGIHLDTDLTAADLKDLAEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTLEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 32726 - protein, 255 aa, Zea mays
  misc_feature (151)..(151): Xaa can be any naturally occurring amino acid
  misc_feature (184)..(184): Xaa can be any naturally occurring amino acid
TLALHAGAICGPASLVNAMMDLQEGALMLLGPTMNAKVAFELSERLPHLPLRMQEHSRRALAFAERMQGLGLRVLYPGLPGHPHHARLCAMGNPGYGCGGMLCLDMGTEERANRLMHHLQNTTQFGLMAVSLGYYETLMSCSGSSTSSEMXPPEDRARAGISPGLVRMSVGYNGTLEQRWAQFXERALALMQTPDAHAPSQGRRRRPRRPRSRQQPPPQALTRLRFRACVRACMACGLVFVVFVYILLVPFKQEY

SEQ ID NO: 32727 - protein, 953 aa, Flaveria bidentis
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLPLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPDAYKELVENCEILEGHYKDMMDIEFTVQENRLWMLQCRTGKRTGKGAVRIAVDMVNEWLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPNLKVGICGEHGGEPSSVAFFDGVGLDYVSCSPFRVPIARLAAAQVIV

SEQ ID NO: 32728 - protein, 387 aa, Yersinia pestis CO92
MSVIKMTDLDLAGKRVLIRADLNVPVKEGKVTSDARIRASLPTIEAALKQGAKVMVTSHLGRPTEGEYNEEFSLLPVVNYLKEKLSSPVRLAKDYLDGVEIAAGELVVLENVRFNKGEKKDDEALSKKYAALCDVYVMDAFGTAHRAQASTHGVGKFAPIACAGPLLSAELEALGKALGNPARPMVAIVGGSKVSTKLTVLGALSKIADKLIVGGGIANTFVAAQGHNVGKSLYEADLIPEAKRLLETCDIPVPTDVRVATEFSETAAATLKPANEIKDDEQILDLGDESAERLAEILKNAKTILWNGPVGVFEFPNFRKGTEIVARAIAESEAFSIAGGGDTLAAIDLFGIADQISYISTGGGAFLEFVEGKKLPAVVMLEERAKQ

SEQ ID NO: 32729 - protein, 956 aa, Flaveria pringlei
MMSSLFVEGMLLKSADESCLPAKGKQRRTGDLRRLNHHRQPAFVRWICRRKLSGVSRIEFHSGGLTPPRAVLNPVSPPVTTTKKRVFTFGKGRSEGNKDMKSLLGGKGANLAEMASIGLSVPPGLTISTEACEEYQQNGKKLPPGLWDEILEGLRYVQKEMSASLGDPSKPLLLSVRSGAAISMPGMMDTVLNLGLNDEVVAGLAGKSGARFAYDSYRRFLDMFGNVVMGIPHSLFDEKLEEMKAEKGVHLDTDLTAADLKDLVEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLATMETCMPEAYRELVENCKILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVLTIGDRVIKEGDWLSLNGSTGEVILGKQLLAPPAMSNDLETFMSWADQVRRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELAVDTGMSEDEIYSKIEKLSEVNPMLGFRGCRLGISYPELTEMQVRAIFQAAVSMNNQGVTVIPEIMVPLVGTPQELRHQIGVIRGVAANVFAEMGLTMDYKVGTMIEIPRAALIAEEIAKEAEFFSFGTNDLTQMTFGYSRDDVGKFLQIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 32730 - protein, 949 aa, Mesembryanthemum crystallinum
MASAFKGILIRSPPDVCAETVAKVSQCNRAQLVKNSSTGFKNIFKLSEARKFHAPVASHLRSQAVMAPASDPTSTAIKRVFTFGKGRSEGNKGMKSLLGGKGANLAEMASIGLSVPPGLTISTEACQEYQEHGKQLSAGLWEEILEGLRVIEKDMGSYLGDPSKPLLLSVRSGAAISMPGMMDTVLNLGLNDDVVAGLAAKSGERFAYDSYRRFLDMFGNVVMGISHSSFEEKLEKLKQAKGVKLDTELTASDLKEVVEQYKNVYLEVKGEKFPADPERQLQLAIQAVFDSWDSPRAIKYRNINQITGLKGTAVNIQCMVFGNMGNTSGTGVLFTRNPSTGEKKLYGEFLINAQGEDVVAGIRTPEDLDTMRSCMPEAYKELVENCEILERHYKDMMDIEFTVQENRLWMLQCRSGKRTGKGAVKIAVDLVKEGIVDTYTAIKMVEPQHLDQLLHPQFEDPSAYKDRVIATGLPASPGAAVGQIIFSADEAESWQAQGKSVILVRNETSPEDVGGMHAAIGILTARGGMTSHAAVVAGGWGKCCVSGCSEIRVNDTDKVLLVGDKVISEGDWLSLNGSTGEVILGKVPLSPPALSGDLETFMSWADDIRVLKVMANADTPEDALAARNNGAEGIGLCRTEHMFFASDDRIKTVRKMIMAVTSEQRKVALDQLLPYQRSDFEGIFRAMDGLPVTIRLLDPPLHEFLPEGDVEQIVSELTLETGMAEDEIFSRIEKLSEVNPMLGFRGCRLGISYPELTEMQARAIFQAAVSMSNQGVKVFPEIMVPLVGTPQELGHQVSLIRNVAEKVFSETGSSLSYKVGTMIEIPRAALVADEIAMEAEFFSFGTNDLTQMTFGYSRDDVGKFLPVYLSKGILQSDPFEVLDQKGVGQLIKLATEKGRSARPSLKVGICGEHGGEPSSVAFFAEAGLDYVSCSPFRVPIARLAAAQVV

SEQ ID NO: 32731 - protein, 338 aa, Yersinia pestis CO92
MAIRIAINGFGRIGRSVLRALYESGRRAEISVVAINELASAEGMAHLLKYDSSHGRFAWDVRQECDSLYVGDDIIRLIHQSEIEQLPWSELGIDVVLDCSGVYGSREDGEAHVASGAKKVLFAHPGGHDLDATVVYGVNHQDLRAEHRIVSNASCTTNCIIPIIQLLDIAYGIESGTVTTIHSSMNDQPVIDAYHQDLRRTRAASQSIIPVDTKLAAGITRIFPKFCDRFEAISVRVPTINVTAIDLSVSVTHPVGVAEVNQLLQKAARGAFRGIVDYTELPLVSMDFNHDPHSAIVDGTQTRVSGQHLIKTLVWCDNEWGFANRMLDTTLAMAKSGF

SEQ ID NO: 32732 - protein, 1064 aa, Clostridium perfringens ATCC 13124
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEDAVLSIENSLKGVILENGFLKINEEVAPGTKIIVKAYDSLNDMTAYKEIEVREEGEKGTFVQFLKNDGLYYGENFSWNIWGFGKNSSGKEFNLNIKTDLGVGTFVDEEKFIVRKRTWGCNWVNDWNEQTYTFYLGKEDRNLFCIYENNKILTSLKTAIEETTPKIQVALMDHKNTIKAYLSHKPLIGVKYGLYINGIKAKGVSTLVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVQRKENEGKYYLYRLYFNDLSKEGKHVNKITYAVDPYAVSVGVNGEKGALVDLFSKECVPEGWNKYNKPKLINKEDSIIYEMHIRDFTINENSGVSESLRGKFLGAVEEGTFYINKENGNKVKTGLDHLKELGITHVHLLPVFDFSSVNEEITKDENNRNWGYDPKNFNAIEGSYSTDPYTPSRRIIEFREMIKKFHDNGIRVVLDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKAWQVIEGIKGSINSITYKPMESINYLESHDNYTLWDQIVKSQNHSVEKGHYRDFNEENILDNFYVKEDLLGASILFTSQGIPFIQSGAEILRSKDGDHNSYKSPDSINALNWAEKEKYIDVFNYYKDLISLRKNHSAFRMKNPEDIIENLEVYFYDNNDTSGVIIAHYKNNANEDLWKDIVVIYNGTTIDDYNVISSMPKSSNGFWNIAVKNGGVNQFGIERVSEDEIPKIKSHSMMILYDE

SEQ ID NO: 32733 - protein, 393 aa, Listeria monocytogenes EGD-e
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQACVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 32734 - protein, 579 aa, Fusobacterium nucleatum subsp. nucleatum ATCC 25586
MEWVMKQNNLIKGIPASPGIAIGKAFLYKENKLEIDEKSNLSKEEEIERLVKGREIAKKQLEEIKENTLKKLGKDKADIFEGHITLLEDEELFSEIDSKISQKKCTAEFALNEAIDEYATMLANLEDTYFKERAGDLRDIGKRWLYGVMNEQIVDLSKLEPETIIVAKELNPSDTAQINLDNVLAFVTEIGGKTAHSSIMARSLELPAVVGVGAVLDELEDNQILIVDALKGEVIVSPDVETLQIYKEKREKFLKEKEELKALKDKEAISKDGIKVDVWGNIGSPNDVKGIISNGGFGVGLYRTEFLFMEKDSFPTEDEQFEAYKIVAEELKGYPVTIRTMDIGGDKSLPYMELPKEENPFLGWRAIRVCLDREEILRTQFKALLRASKYGKIKIMLPMIMDIVEVRKAKAIFEECKKELQEKGIEFDKNIMLGIMVETPAVAFRAKYFAKECDFFSIGTNDLTQYTLAVDRGNEKIANLYDTYNPSVLQAIKMLIDGAHDGGIKISMCGEFAGDENAIAILFGMGLDAFSMSGISIPRVKRIIMKLEKKECQNLVERVLSLSTASEIKEEIKKFMEKI

SEQ ID NO: 32735 - protein, 176 aa, Triticum aestivum
  misc_feature (132)..(132): Xaa can be any naturally occurring amino acid
  misc_feature (158)..(158): Xaa can be any naturally occurring amino acid
MAPTVMASSATSVGPFQGLKSTVGLPVSRRSNGASLGSVSNGGRIRCMHVWPIEGGGKVDTLSYLPPLRTEALLEQVDYLIRSKWVPCLEFSKVGFIFRDHNTSPGYYDGRYWTMWKLPMFGCTDATQVINXVEEVKKEYPDAYVRIIGFDNMRQVQXCVSFIAFKPPGCEESGKV

SEQ ID NO: 32736 - protein, 303 aa, Solanum chmielewskii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELDQTHLSTVVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32737 - protein, 503 aa, Ralstonia sp. PHS1
MLITDPQATASTGNQSVARAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNAAGVPPGVYNVVHGFGPSSTGEFLTTHRGINAITFTGETRTGAAIMKAAADGARPVSLEMGGKNAAIVFADCDFDAAIEGTLRSCFANCGQVCLGTERVYVERPIFDRFVSALKKGAEGMQLGRPEDPATGMGPLISQEHRDKVLSYYKKAVEAGATVVAGGGVPDMPDALKGGAWVQPTIWTGLGDDSVIAREEIFGPCALVMPFDSEEEVIRRANDNDYGLATAIWTTNLSRAHRVAGAIEVGIAWVNSWFLRDLRTPFGGAKQSGIGREGGVHSLEFYTELKNVCIKL

SEQ ID NO: 32738 - protein, 204 aa, Coprinopsis cinerea okayama7#130
MSHCNHHEGCGHDHLGNDLGPQDNLFSQIDQSNVVALNGVQEGSVVIKPWHERTDETKYLESDADDQLIIRIPFTGNVKLRSLLLKAGPGEKTPEKIILFASEPNLDFDSVNEKKPSQELEVAQGSEVGEYPLRTVKFNNISSITLFIPAAQGDDVTRIYYVGFLGHWQKRNDSPPITVYEAQANIADHEKIQGTDAAHSSLGH

SEQ ID NO: 32739 - protein, 303 aa, Solanum chmielewskii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELHQTHLSTVVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32740 - protein, 1399 aa, Myxococcus xanthus DK 1622
MQLCFLPQLPRATFLIAVEYWAAMPKDIIDFQLERGRHEQLLGRQDALTTLDSFLLSGESARGWLLVKGGPGRGKSALLSSWLGARELAGQRVPHHFLRRGVEDWDRPEVVVRNLAAQVEALYPLHADLEAKPESRLREVLQRVSTAVLVPQRKQLVLLVDGLDELDASGPNPLPRFLPHALPPGVKVLCSSRPMYPHLSWLEARDNVRTLDLDGQRWAASNEEVVREYWAHVAPKFTPSLEPSLMAQAIKNAQGNVLHAVKLAEWLLEQPAEERRAAMLPSGLDAFLEDAWQRIQDQPMEVRGIVLEGLELVAVAREALPLSVLADVAEWKGISAREQFLRVARPFLLEESGHWGGEKAWRLFHKAFHDFILSKLGEQGELQQHRRLAENICKWSVDAPISGFRRNYTLRHGVTHWLKAQEWQHVRKLCMDLSFLEAKCQEIGIFAVEEDMPQAVDGVGELYKTALRDLHQAVRAESHWLREDAAAFPRLIYNRLLSQGWKAARIAEMLHFPGGLPALRLRHPVRLRHGEVRTLKGHDGPVNGCTVTPSGWVVSASDDKTLRVWELETGKELARMEGHEGWVRSCAVIPDGRVVSASDDKTLRVWELETGKELARMEGHKGPVWGCSVTPDGRLVSASFDEMLRVWELKTGIKLAQLVGHKGAVNGCAVTVDGRVVSASSDGTLRVWELETGKELARMEGHEGPVNGCAVTVDGRVVSASSDGTLRVWELETGKELARMEGHEEPVNGCAVAADGWVLSASNDKTLRVWELDTGREVAQLEGHEGPVKSCAVTEDGWVVSASDDKTLRVWELETARQSARRQDHKGPVWGCTATSDGRLVSASSDKTLKVWELKTKKELARLEGHDGWVRGCAVTANGRLVSASSDRTLRVWNLEAGKELMRLEGHAGPVNDCAVTARGQVVSASSDRTLRVWDLETGKELMRLEGHDGPVWDCAVTARGQVVSASSDRTLRVWDLETGKELVRLEGHDGPVLGCVMTADGRLVSASSDKTLRIWEPTTGKELARLEGHRGPVWDCAMTADGMVISASDDKTLGVWDIASGQRIHTFHGMSGFRSVAVTRDTVCAGDTLGNIWMTEIEPARVNQERSPKEKLESGTTVSVKIPAPVLEAYRSNKLALFVGSGLSLGKDVQGDFPTWGKLPERLLDACKRYDSLDEETIRLKHALFRNRMRLESMLSELGTLRTSLGRDYQNALNHIFRPPDAAPGKAQHAVIQLGVRAILTTNYDQLLELTPEMPRRQPYTWKDSDKALADLRAGRKILLKVHGTSEHHDTVVMSEVEYREAHSNSGYQAVLRHLLQEHLFLFVGYGMNDPLDLDLALKSNVESFGITTQRHYVLLRDAAANDHDRIEREYNIRIIDCSRHEQVPEFLESLAAAKAIP

SEQ ID NO: 32741 - protein, 303 aa, Solanum habrochaites
TNSINDALSSSYLVPFESYRVPLVDLEEATNNFDDKFFIGAGVFGKVYKGVLRDGTKVALKRRKPESSQGIEEFETEIETLSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYA

SEQ ID NO: 32742 - protein, 545 aa, Solanum tuberosum
MPMDTETKQSGDLIFRSKLPDIYIPKHLPLHSYCFENLSEFNSRPCLIDGANDRIYTYAEVELTSRKVAVGLNKLGIQQKDTIMILLPNCPEFVFAFIGASYLGAISTMANPLFTPAEVVKQAKASSAKIIITQACFAGKVKDYAIENDLKVICVDSAPEGCVHFSELIQSDEHEIPDVKIQPDDVVALPYSSGTTGLPKGVMLTHKGLVTSVAQQVDGENANLYMHSDDVLMCVLPLFHIYSLNSVLLCALRVGAAILIMQKFDIAQFLELIPKHKVTIGPFVPPIVLAIAKSPLVHNYDLSSVRTVMSGAAPLGKELEDAVRAKFPNAKLGQGYGMTEAGTVLTMCLAFAKEPFDIKSGACGTVVRNAEMKIVDPDTGCSLPRNQPGEICIRGDQIMKGYLNDPEATARTIEEEGWLHTGDIGFIDDDDELFIVDRLKELIKYKGFQVAPAELEALLINHPDISDAAVVPMIDEQAGEVPVAFVVRSNGSTITEDEVKDFISKQVIFYKRIKRVFFVETVPKSPSGKILRKDLRARLAAGISN

SEQ ID NO: 32743 - protein, 172 aa, Glycine max
MALQLPPLPGRAMRFNSSVCSLPARKSSTFATLSQPRSDWVEATNSFFDQDKRPIMLFDGVCNLCNGGVKFVRDNDRNKTIRYEPLQSETGKILLRRSGRAPDDISSVVLVEKERSYIKSEAVLKIMEYIDLPFPQLAILLQFVPLFIRDFVYDNVANNRYLIFGRSESCEI

SEQ ID NO: 32744 - protein, 303 aa, Solanum habrochaites
TNSINDALSSSYLVPFESYRVPLVDLEEATNNFDDKFFIGAGVFGKVYKGVLRDGTKVALKRRKPESSQGIEEFETEIEILSFCRHPHLVSLIGFFDERNEMILIYKYMENGNLKRHLYGSDLPSMSWEQRLEICIGAARGLHFIHTRAVIHRDVKSINILLDENFVPKITDFGLSKKGTELDQTHLSTVVQGTLGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 32745 - protein, 338 aa, Xanthomonas campestris pv. campestris str. ATCC 33913
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVEFDKAQG

SEQ ID NO: 32746 - protein, 664 aa, Yersinia pestis CO92
MSSRKELANAIRALSMDAVQKAKSGHPGAPMGMADIAEVLWRDYLNHNPTNPHWADRDRFVLSNGHGSMLIYSLLHLTGYDLPMEELKNFRQLHSKTPGHPEYGYTAGVETTTGPLGQGIANAVGFAIAERTLGAQFNRPGHDIVDHHTYAFMGDGCMMEGISHEVCSLAGTMKLGKLTAFYDDNGISIDGHVEGWFTDDTAARFEAYGWHVVRGVDGHNADSIKAAIEEAHKVTDKPSLLMCKTIIGFGSPNKAGTHDSHGAPLGEAEVAATREALGWKYPAFEIPQDIYAAWDAKEAGKAKEAAWNEKFAAYAKAYPELAAEFKRRVSGELPANWAVESKKFIEQLQANPANIASRKASQNALEAFGKVLPEFLGGSADLAPSNLTIWSGSKSLSDDLAGNYIHYGVREFGMSAIMNGIALHGGFIPYGATFLMFVEYARNAVRMAALMKIRSVFVYTHDSIGLGEDGPTHQPVEQMASLRVTPNMSTWRPCDQVESAVAWQYALERKDGPSALIFSRQNLAQQPRTAEQLANIAKGGYVLKDCAGQPELILIATGSEVELAVAAADQLTATGRKVRVVSMPSTDAFDKQDAAYRESVLPSAVSARVAVEAGIADYWYKYVGLNGAVVGMTTFGESAPAELLFKEFGFTVENVVAKAQALLK

SEQ ID NO: 32747 - protein, 520 aa, Solanum habrochaites
MKSTVHLGRVSTGGFNNGEKEIFGEKMRGSLNNNLRINQLSKSLKLEKKEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 32748 - protein, 419 aa, Arabidopsis thaliana
MAEDTSFEGDQLASMTTDDIGRASRLLANEIRILKEESQRTNLDLESVKEKIKENQEKIKLNKQLPYLVGNIVEILEMSPEDDAEEDGANIDLDSQRKGKCVVLKTSTRQTIFLPVVGLVDPDTLKPGDLVGVNKDSYLILDTLPSEYDSRVKAMEVDEKPTEDYNDIGGLEKQIQELVEAIVLPMTHKEQFEKLGIRPPKGVLLYGPPGTGKTLMARACAAQTNATFLKLAGPQLVQMFIGDGAKLVRDAFLLAKEKSPCIIFIDEIDAIGTKRFDSEVSGDREVQRTMLELLNQLDGFSSDDRIKVIAATNRADILDPALMRSGRLDRKIEFPHPTEEARGRILQIHSRKMNVNADVNFEELARSTDDFNGAQLKAVCVEAGMLALRRDATEVNHEDFNEGIIQVQAKKKASLNYYA

SEQ ID NO: 32749 - protein, 285 aa, Methylococcus capsulatus str. Bath
MCDAQDWFTESYPDNGSALSLKIRAKLHEEQTPFQRIEIYDTESFGKLMVIDGCTMVSDRDNFLYHEMMTHPVLYTHPAPKTVWIIGGGDCGSLREVLKHSEVEKAVQIDIDERVTRLAERYFPELCEANGDPRAELLFIDGIQWVKEAPDGCVDVIIVDSTDPVGPAEGLFNEAFFRQCHRCLRTDGILVQQSESPLFHLPLIASMHRIMRQAGFAQTRTLFFPQFIYPSGWWSATMAGKGDLNRFRADAAEAKLFPTRYYNADIHRAAFAVPEFFGDALRELV

SEQ ID NO: 32750 - protein, 424 aa, Brassica rapa
MATPMVEDTSSFEEDQLASMSTEDIVRATRLLENEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 32751 - protein, 509 aa, Xanthomonas campestris pv. campestris str. ATCC 33913
MNALPSAKSLNTDPQSIFKPRYDNFIGGAWVAPQGGQYFDNTTPITGKVFTSIARSTAPDIEAALDAAHAAKEAWGKTSTTDRSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMEVIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDTFMEKALKRVAAIKQGNPLDPNTMVGAQASSEQLEKILSYIDIGKQEGAEILIGGERNMLDGELSDGFYVKPTVFKGHNKMRVFQEEIFGPVVSVTTFKDEAEALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 32752 - protein, 379 aa, Pichia pastoris
MSTEGQIIKCKAAVAWEAGKDLSIEEIEVLPPRAHEVRVKVEFTGVCHTDAYTLSGADAEGSFPVVFGHEGAGVVESVGEGVESVKVGDSVVLLYTPECRECKFCLSGKTNLCGKIRATQGKGLLPDGTSRFRCKGKDLFHYMGCSSFSQYTVVADISVVKVQDEAPKDKTCLLGCGVTTGYGAAINTAKISKGDKIGVFGAGCIGLSVIQGAVSKGASEIIVIDINDSKKAWADQFGATKFVNPTTLPEGTNIVDYLIDITDGGFDYTFDCTGNVQVMRNALESCHKGWGESIIIGVAAAGKEISTRPFQLVTGRVWRGCAFGGIKGRTQMPSLVQDYLDGKIKVDEFITHRHDLDNINKAFHDMHAGNCIRAVITMH

SEQ ID NO: 32753 - protein, 814 aa, Gibberella zeae PH-1
MPENRRPRSALPIESLGQSISGPSGRLSTSLEIEDPPPENLKHRLHEWAGTGARNDDEDDQGEEYELLMDPNLPREYETRRKNSQESGDEAALIKDDEDENEEEENSPYPEVRAAVRNFDEDLPCNTVRAWTIGMLLVVVGASMNTLFSLRQPSISIGPLIAQIVAWPMGHGWAKFVPEREFTTFGITWTLNPGPFNVKEHAIIVVMASVSFSVAYATDIILAQVVFYKQDFGIVFQLLLTISTQSVGYGIAGMLRKFLVYPASMIWPENLAGVTLMNAMYERNDAPDPSVIGGAMHRYKWFAIVTACSFFYYFIPGFLAQFLSIFAVATWMAPQNPIVNQLFGGQTGLSLLPITFDWTQIAGYVGSPLIPPWHAIANTLIGVVVFFVVGSSVLHFGGAWYGEYLPMSDSGTYDNTGARYNTTRILTKDFTLNEEEYKNYSPLFISTTFAISYGLSFAAISSLVVYTYLHNGKQIWQQWRNSTNEKPDVHMKMMRKYKEAPTWWYMSLFAIMLLIGFYTVLGYPTNLSWWAFLLAIAISFGFALPIGIIQAVTNTQIGLNVLTEFIYGYLQPGRPLALMIFKTYGYITMAQSLRFVSDLKFGHYMKIPPRTMFLSQVVATTFSCFIQIVVLNLSLNHIPDVCEQHQVDHFTCPGGRVFFAGPARMFSPGQVYSGLFVFFVIGAVAPVVIYFLAKRRPKSPVRFLMAPLIFGGAGAMPPATPLNYLSWGAVGFLFQFWIKKRHFRWWSRLNFLTSSALDLGLALATLFIFFAFTLHGIDPPSWWGNDIVSSTMDVQGTAIQAHVAEGARFGPKSW

SEQ ID NO: 32754 - protein, 423 aa, Aspergillus niger
MGDVAVETPANNVTPLTKAAPLDTIPNIDSLEGTGNDGSDEYATLKRLQRHLEYIQLQEEYIKDEQRSLKRELVRAQEEIKRIQSVPLVIGQFMEAIDQNTGIVQSSTGSNYVVRILSTLDREKLKPSSSVALHRHSNALVDILPPEADSSIAMLGENEKPDVTYADVGGLDMQKQEIREAVELPLTQFDLYKQIGIDPPRGVLLYGPPGTGKTMLVKAVANSTTASFIRVNGSEFVQKYLGEGPRMVRDVFRMARENSPAIIFIDEIDAIATKRFDAQTGADREVQRILLELLNQMDGFEQSSNVKVIMATNRADTLDPALLRPGRLDRKIEFPSLRDRRERRLIFSTIASKMSLSPEVDLDSLIVRNEPLSGAVIAAIMQEAGLRAVRKNRYNIIPRSDLEDAYAAQVKTGQEADRLEFYR

SEQ ID NO: 32755 - protein, 440 aa, Glycine max
MASRLEQQQQPTNVGGENKQKNMGGEGRNRRVLQDIGNLVGKQGHGNGINVSKPVTRNFRAQLLANAQAATEKNKKSSTEVNNGAVVATDGVGVGNFVPARKVGAAKKPKEEPEVIVIISDDESDEKQAVKGKKAREKSAMKNAKAFSSVLSARSKAACGLPRDFVMNIDATDMDNELAAAEYIDDIYKFYKETEEDGCVHDYMGSQPDINAKMRSILVDWLIEVHRKFELMPETLYLTLNIVDRFLSVKAVPRRELQLVGISSMLIASKYEEIWAPEVNDFVCISDNGYVSEQVLMMEKQILRKLEWTLTVPTPYHFLVRDTKASTPSDKEMENMVFFLAELGLMHYPTVILYRPSLIAASAVFAARCTLGRSPFWTNTLMHYTGYSEEQLRDCAKIMANLHAAAAPGSKLRAVYKKFSNSDLSAVALLSPAKDLSALS

SEQ ID NO: 32756 - protein, 532 aa, Oryza sativa
  misc_feature (155)..(155): Xaa can be any naturally occurring amino acid
  misc_feature (169)..(169): Xaa can be any naturally occurring amino acid
MAMAASPFLILPSLFPKPTILAARIHPSIFRGRHIRCSPNGAAVPESPEPAPRRGRRKSPSPSPPKAKTTRRRTKKNTQESDSEGEEEPPKRRGRRTRKSKQEAEQEAAEKEDEVRAASPGTEDSKRAVQDEDGEAEATGSNSARGEDSPYDWPXLVCCFGAPRWEFVXPTVRVSDRQMHPDIYSTWLHLQWEPPEFARAPGSAASNVGIALTRGGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQVYVPSMW

SEQ ID NO: 32757 - protein, 227 aa, Triticum aestivum
  misc_feature (186)..(186): Xaa can be any naturally occurring amino acid
  misc_feature (211)..(211): Xaa can be any naturally occurring amino acid
MPGSIAFGRFDDSFSLASFKAYIAEFISTLIFVFAGVGSAIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILXAGPFSGGFMNPARSFGPAVASGDFXNIWIYWAGPLIGGGLA

SEQ ID NO: 32758 - protein, 607 aa, Bacillus anthracis str. Ames
MCGITGWVDWKEDLSNQHVILKKMANRIQHRGPDAEGFWFSPRAAFAHRRLIVIDPEGGAQPKTFRAGDYTYALTYNGEIYNFRELREQLQKCGHTFETHSDTEVLLHAYLEWKEDCVQHLNGIFAFALWDDQKQRLFLARDHLGVKPLFYTERNDSIIFGSEIKALLAHPSVPAEIDADGINEIFGLGLFRTPGCGVFKHIEEVRAGHSITFTRDKKVVTKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKNTSPLLLHEISNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPQYLQTIRHLSLDMCSNKNNPIFSLINHSTLLAIADGSNKEINNFEARSAMEYMLQVNEWLKTYHIHIA

SEQ ID NO: 32759 - protein, 303 aa, Solanum habrochaites
TNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYA

SEQ ID NO: 32760 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPENGGPRICLGQQFALTEASYVTVRLLQEFGNLKQDPNTEYPPKLQNTLTLSLFEGAEVQMYLIL

SEQ ID NO: 32761 - protein, 303 aa, Solanum habrochaites
TNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKRHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYA

SEQ ID NO: 32762 - protein, 546 aa, Zea mays
  misc_feature (198)..(198): Xaa can be any naturally occurring amino acid
MFLGALFAAVTTSAPAARSLLVYGVPGLVLLWQGGRLLSRLWREPRRLERALRAQGLRGTSYRFLMGDLREFGRLNQEAWARPPLPLGCHDIVPRVTPFLCGNVREHGKTCFSWFGPIPNVTITDPALVRDVLSNKFGHFGKPQFPALTKLLSDGLTSHEGEKWVRHRRILNPAFHLEKLRLMLPTFSACCEELVGRXAARCLGPDGGSCELDVWPELQALTGDVISRTAFGSSYLERKKIFELQSEQAERFVGAIQKIVIPGYMYLPTKNNRRMRQINKEVNSILRGVVGKRMRAMAMREGGESTTGADDLLGLLLESNNTRHEGETGHGQQSALGMTIEDVIEECKLFYFAGMETTSVLLTWAMVLLSMHREWQDRAREEVTGLFGRDDNKPEYEGLSRLKTVNMILYETLRLYPPAVVFSRKAYKEMKVGGVTLPAGAIIEIPVLFIHHDPDTWGDDAHEFKPERFAEGVSRACNGASGAFIPFGWGPRTCIGQSFALLEAKMALCVILQRFEMELAPSYTHAPHTVMTLHPMHGAQIKLTAI

SEQ ID NO: 32763 - protein, 77 aa, Brassica napus
  misc_feature (11)..(11): Xaa can be any naturally occurring amino acid
  misc_feature (14)..(14): Xaa can be any naturally occurring amino acid
  misc_feature (32)..(32): Xaa can be any naturally occurring amino acid
  misc_feature (34)..(34): Xaa can be any naturally occurring amino acid
GRVGFLPRKFXVAXTVPTDNGVYLLTNDIGRXVXSDENGEPHGFNLYVGGGMGRTYIMESTFDRLAKPLGYVPKEYI

SEQ ID NO: 32764 - protein, 305 aa, Solanum chilense
TNSINDALSSSYLVPFESYRVPLVDLEEATNNFDHKFFIGHGVFGKVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYE

SEQ ID NO: 32765 - protein, 442 aa, Triticum aestivum
  misc_feature (99)..(99): Xaa can be any naturally occurring amino acid
  misc_feature (114)..(114): Xaa can be any naturally occurring amino acid
NLRSHIAFPFYCRPFPRLPLRSIRSAVSPRETLNPVTLAAGDRWSPASAAMFGTPNSPSLFGTPSSTPSFGTPSTTPAFGTPSSTPAFGAPSSTPAFGXPSSTPAFGAPSSTPXFGTPTSSPTFGTPSSTPAFGAPPSSSPSPFGFQQQVTPSPSPFGFSGGAGGQITTQMAPVAPLPLSPSDRDIQAMVDAYKEDPGNPRYAFRHLLFSVTDPSQRVKPVAASDIMWAEAMGKLECMDSADRERLWPQLVQGFKDLSCRLKLQDEVLVSDTERLSMTHSNVKKLQRHFQADTYPWIQRLKHQELVIERRLLRIMRIVEALENRGFRVPLMKEEADLYERLVAIIKQIKGTGGDLSKRAYNLLSTSRVLASAGCASGPIYIPSSTKVDKQNVTELLEALQQQTEAVAKLGNVLKRDTRDVEIVLSEDTDMEEDSSGRRAFKM

SEQ ID NO: 32766 - protein, 984 aa, Staphylococcus aureus subsp. aureus N315
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTSIKEKYGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRHPQYSVQVQKKWERSDYVFPGNQVDK

SEQ ID NO: 32767 - protein, 137 aa, Burkholderia mallei ATCC 23344
MNAEAKPGDWLGKVRWDANGLVPVIAQDAATNDVLMFAWMNRDALAKTIELKRAVYYSRSRQRLWFKGEESGHVQHVHEVRLDCDEDVVLLKVEQVEGIACHTGRRSCFFQKFEGTVDDGEWVAVDPVLKDPEHIYK

SEQ ID NO: 32768 - protein, 555 aa, Borrelia burgdorferi
MNTSLFKQERQKYIPKLPNILKKDFNNISLVYGENTEAIQDRQALKEFFKNTYGLPIISFTEGESSLSFSKALNIGIILSGGPAPGGHNVISGVFDAIKKFNPNSKLFGFKGGPLGLLENDKIELTESLINSYRNTGGFDIVSSGRTKIETEEHYNKALFVAKENNLNAIIIIGGDDSNTNAAILAEYFKKNGENIQVIGVPKTIDADLRNDHIEISFGFDSATKIYSELIGNLCRDAMSTKKYWHFVKLMGRSASHVALECALKTHPNICIVSEEVLAKKKTLSEIIDEMVSVILKRSLNGDNFGVVIVPEGLIEFIPEVKSLMLELCDIFDKNEGEFKGLNIEKMKEIFVAKLSDYMKGVYLSLPLFIQFELIKSILERDPHGNFNVSRVPTEKLFIEMIQSRLNDMKKRGEYKGSFTPVDHFFGYEGRSAFPSNFDSDYCYSLGYNAVVLILNGLTGYMSCIKNLNLKPTDWIAGGVPLTMLMNMEERYGEKKPVIKKALVDLEGRPFKEFVKNRDKWALNNLYLYPGPVQYFGSSEIVDEITETLKLELLK

SEQ ID NO: 32769 - protein, 368 aa, Exiguobacterium sibiricum 255-15
MGQDYQQWVDRLAQKKTGERQDGVEVVIKPVPDRTESGVLDPRVLEVMMQQQQDSSPVGPFSLEAARAGMGWINTDLTTTDITTEDIMIPSAEQPIPARIYRPRSTEPLPAVVYFHGGGFFGGTLEPVEHPCRLLAERANVVVISIDYRLAPEHPFPAGLNDCFTAVKWVYEQGEELGINREQLAVAGDSAGGNLATVCALLDREQQTEMIQYQVLLYPVVNLAALPTDDFNWRLDAYEMNENRELLEGIVTALEDSDGLLNRLYLQGTTDVQDPHVSPLFSDKLTGLPDALIITAEYDYLRLEGEAYGRKLARSGVKTKRIQYNGMDHAFIEKLGQYPQAEDCITEIANGLQNRFAVMKSDTNTIGG

SEQ ID NO: 32770 - protein, 305 aa, Solanum chilense
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSINILLDENFVPKMTDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32771 - protein, 142 aa, Rhodococcus sp. RHA1
MRIADVLRNKGPAVVTVDPEMPVSTLIGELARHNVGALVVTENDAVVGIVTERDVVRRIHERGPDILNARVVDIMTTSVFTCLPTDTVDSLAETMTERRIRHLPVIVDGQLVGIVSIGDVVKSRIGELQTERDQLESYIDHG

SEQ ID NO: 32772 - protein, 305 aa, Solanum chilense
TNSINDALSSSYLVPFESYRVPLVDLEEATNNFDHKFLIGAGVFGEVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSINILLDENFVPKMTDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32773 - protein, 448 aa, Zea mays
  misc_feature (169)..(169): Xaa can be any naturally occurring amino acid
  misc_feature (183)..(183): Xaa can be any naturally occurring amino acid
  misc_feature (441)..(441): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKXLAMQEFMILPTGAXSSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIQAVMMSNRSGWGVMASHRSGETEDTFIADLSFGLSTGQIKTGAPCRSERLAKYNQLLRIEEELGDAAVYAGAKXRAPVEPY

SEQ ID NO: 32774 - protein, 303 aa, Solanum chilense
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDEINEMILIYKYMENGNLKRHLYGSDLPSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32775 - protein, 254 aa, Chlamydophila pneumoniae AR39
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 32776 - protein, 305 aa, Solanum chilense
TNSINDALSSSYLVPFESYRVPLVDLEEATNNFDHKFFIGHGVFGKVYKGVLRDGTKVALKRRQPESSQGIEEFETEIETLSFCRHPHLVSLIGFCGERNEMILIYKYMENGNLKSHLYGSDLPTMSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32777 - protein, 517 aa, Zea mays
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 32778 - protein, 402 aa, Oryza sativa (japonica cultivar-group)
MLTTSDMASAAGGASGKDWFDCLPDDLVHHVLSFLPALDAVRTSVLSRRWRDFWVSMPRLNVDVGDFRDDGQFENFTVHALPLLDSSVPLRSLRLRSSLHYLSALWVNHAVKRKVAVLEYSGRAELCSSVDASLSLASSYLTKVVLKHFDFDYGQFWPLIDACPALENLELLDVWTFYSVTISSSSLKHLRIVSCLFYNGFRINAPNLLTMCLDDVNVNGPLGHDSLVLENLSSLMTASVSVYHCFYPKHYVKTELHFFHGLSHARNLKLIAPLYEALFEEGLPTCPVFNNLKCLVLGDWCMAFDLYPLRCILRQSPMLEELCVELGEEECENCKNRKPAFSYGEISPFWCDRLKTIKIKCTEHDERFVALLQLFCKILVCIEEVDIDRQWVSAQPPDSSEL

SEQ ID NO: 32779 - protein, 308 aa, Yersinia pestis CO92
MVTTLDNALLNDILQQVRPLIGQGKVADYIPALAEVPANKLGIAVCTLDGQIFQAGDADERFSIQSISKVLSLTLALSRYSEQDIWQRVGKEPSGQPFNSLVQLELEKGKPRNPFINLGALVVCDMLQSRLSAPKQRLLEVVRQLVKDDSISYDPRVARSEFEHSDRNAAIAYLMKSFGNFDNDVLTVLQTYFHYCAMRMSCVELARCFVYLANQGRSISGSESLITPMQARQINALMITSGMYDGAGEFAFRVGMPGKSGVGGGIIAIVPDEFCIAVWSPELDHAGNSLAGTAALERLAQQMGRSIF

SEQ ID NO: 32780 - protein, 243 aa, Clostridium perfringens ATCC 13124
MDDKINKLKEIIKNSNNIVFFGGAGVSTESGIPDFRSANGLFNEKLNITFTPEQLVSHSFFERYPEEFFNFYKAKLIYPNAKPNDAHIALAKLEEMGKLKAIVTQNIDGLHQMAGSKNVFELHGSVLRNYCVDCHTFYDEKFILESKGVPKCTKCGGIVKPDVVLYEEPLDDNVIRGAIDAISKADTLIIGGTSLVVYPAAGLINYFRGKNLVLINKSSTQADSKADLVINDSIGKVLGKVID

SEQ ID NO: 32781 - protein, 357 aa, Catharanthus roseus
MRSNLCHPLKNQLPISFFLSGTIRKPIFSCSRLSISAIITKEQTQEESESKSKKEVAFSSSSSFDFKAYMIGKANSVNKALEDAVLVREPLKIHESMRYSLLAGGKRVRPMLCIAACELFGGTESVAMPSACAVEMIHTMSLMHDDLPCMDNDDLRRGKPTNHKVFGEDVAVLAGDALLAFAFEHIATATKGVSSERIVRVVGELAKCIGSEGLVAGQVVDVCSEGIADVGLEHLEFIHIHKTAALLEGSVVLGAIVGGANDEQISKLRKFARCIGLLFQVVDDILDVTKSSQELGKTAGKDLVADKVTYPKLLGIDKSREFAEKLNREAQEQLAEFDPEKAAPLIALANYIAYRDN

SEQ ID NO: 32782 - protein, 369 aa, Bradyrhizobium sp. BTAi1
MKTRAAVAFEAKKPLEIVEVDLEGPKAGEVLVEIKATGICHTDAYTLDGFDSEGIFPSILGHEGAGIVREVGPGVTSVKPGDHVIPLYTPECRQCKSCLSRKTNLCTAIRATQGKGLMPDGTSRFSYKGQTIYHYMGCSTFSNFTVLPEIAVAKIREDAPFDKSCYIGCGVTTGVGAVVNTAKVEPGSNVIVFGLGGIGLNVIQGAKMAGADKIIGVDLNDGKEEWGRRFGMTHFVNPKKVTGDIVQHLVALTDGGADYTFDCTGNTTVMRQALEACHRGWGESIIIGVAEAGKEISTRPFQLVTGRVWKGTAFGGARGRTDVPKIVDWYMNGKIEIDPMITHTLKLEEINKGFDLMHEGKSIRSVVVF

SEQ ID NO: 32783 - protein, 366 aa, Sinapis alba
MASSVTPLGSWVLLHHHPSTILTQSRSRSPPSLITLKPISLTPKRTVSSSSSSSLITKEDNNLKSSSSSFDFMSYIIRKADSVNKALDSAVPLREPLKIHEAMRYSLLAGGKRVRPVLCIAACELVGGEESLAMPARCAVEMIHTMSLIHDDLPCMDNDDLRRGKPTNHKVYGEDVAVLAGDALLSFAFEHLASATSSEVSPARVVRAVGELAKAIGTEGLVAGQVVDISSEGLDLNNVGLEHLKFIHLHKTAALLEASAVLGGIIGGGSDEEIERLRKFARCIGLLFQVVDDILDVTKSSQELGKTAGKDLIADKLTYPKLMGLEKSREFAEKLNTEARDQLLGFDSDKVAPLLALANYIANRQN

SEQ ID NO: 32784 - protein, 303 aa, Solanum chilense
TNSINDALSSSYLVPFESYRVPLLDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32785 - protein, 184 aa, Arabidopsis thaliana
  misc_feature (21)..(21): Xaa can be any naturally occurring amino acid
  misc_feature (46)..(46): Xaa can be any naturally occurring amino acid
  misc_feature (88)..(88): Xaa can be any naturally occurring amino acid
  misc_feature (101)..(101): Xaa can be any naturally occurring amino acid
  misc_feature (130)..(130): Xaa can be any naturally occurring amino acid
  misc_feature (145)..(146): Xaa can be any naturally occurring amino acid
MAISMLSSATMDASPDRVTMXAPFKVIHSSAAFPATRRAKKDITSXITINGRRVNCMPGCSPMGRKKFETLSYLPDHTESKLDIVDDXLMLMKGMPCGEFXLEQGFGYREDVISPRYYDCDGHCTMWKLXMIGCTDSAQVSNELXXCYKEYPNVLLYGFVGFEHTRQALCINCIGYHSEASQKS

SEQ ID NO: 32786 - protein, 303 aa, Solanum chilense
TNSINDALSSSYLVPFESYRVPLLDLEEATNNFDDKFFIGEGGFGKVYKGVLRDGTKVALKSCKPESSQGIEEFETEIEVLSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKMRPESLRKFGETAVKCLALSSEDRPSMGDVLWKLEYA

SEQ ID NO: 32787 - protein, 116 aa, Haemophilus influenzae Rd KW20
MSNIIKQLEQEQLKQNVPSFRPGDTLEVKVWVVEGSKRRLQAFEGVVIAIRNRGLHSAFTLRKVSNGVGVERVFQTHSPAVDSIAVKRKGAVRKAKLYYLRERSGKSARIKERLGA

SEQ ID NO: 32788 - protein, 305 aa, Solanum chilense
TNSINDALSSSYVVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSTNILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 32789 - protein, 162 aa, Coprinopsis cinerea okayama7#130
MANVFFDITINDQPAGRIVFKLFDDVVPKTARNFRELATGQHGFGYEGSSFHRIIPNFMLQGGDFTRGNGTGGKSIYGEKFADENFQLKHSKPGLLSMANAGKNTNGSQFFITTVVTSWLDGAHVVFGEVVEGMDLVKKIEALGTASGNPKAKITIKKSGTV

SEQ ID NO: 32790 - protein, 292 aa, Desulfovibrio desulfuricans G20
MQFSGALTAIVTPLKNGHIDEEAYRNLIEWQIEQGINGLVPCGTTGESATLSHEEHRDVIRICIDQVKGRVPVLAGAGSNSTKEACGLAQFAKDAGADGALLITPYYNKPTQEGLYQHFKAIAAEVSMPYIMYNVPGRTGVNMTSETVARVKRDVPEVVGIKEASANLKQVSEIIEFCGPDFQVLSGDDFTVLPLLSVGGCGVISVVSNIVPAKMSGLCKAFAGGDLARAKTLHHELSPLSRAMFCETNPIPVKTALSMMGRLSLELRLPLVPMQPQNEKYLRGILSLAGLV

SEQ ID NO: 32791 - protein, 144 aa, Brassica napus
  misc_feature (2)..(2): Xaa can be any naturally occurring amino acid
  misc_feature (11)..(12): Xaa can be any naturally occurring amino acid
  misc_feature (17)..(18): Xaa can be any naturally occurring amino acid
  misc_feature (21)..(22): Xaa can be any naturally occurring amino acid
  misc_feature (26)..(26): Xaa can be any naturally occurring amino acid
  misc_feature (29)..(29): Xaa can be any naturally occurring amino acid
  misc_feature (43)..(43): Xaa can be any naturally occurring amino acid
  misc_feature (49)..(50): Xaa can be any naturally occurring amino acid
  misc_feature (59)..(59): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (95)..(95): Xaa can be any naturally occurring amino acid
  misc_feature (98)..(98): Xaa can be any naturally occurring amino acid
  misc_feature (107)..(107): Xaa can be any naturally occurring amino acid
  misc_feature (109)..(109): Xaa can be any naturally occurring amino acid
  misc_feature (122)..(122): Xaa can be any naturally occurring amino acid
  misc_feature (126)..(126): Xaa can be any naturally occurring amino acid
  misc_feature (141)..(142): Xaa can be any naturally occurring amino acid
MXSSMLSSAAXXTSPAXXTMXXPFTXLKXSAAFPVTRKANNDXTSIASXXGRVSCMKVXPPXGKXKXETLSYLPELTEVEWDKEVDYLLRNKWIXLCXEFELEHGFXVXREHGSTPGILTMXRYWXQWWKASPWVGCTDSXXRG

SEQ ID NO: 32792 - protein, 293 aa, Mesorhizobium loti
MLRGSLTALVTPFEKSGRFDEKAFRAFVEWQLGEGTTGLVPVGTTGESPTLSHDEHRHVVKVCIEVANGRAPVVAGAGSNNTAEAVGLVQYAEKAGADAALVVTPYYNKPTQRGLYEHFAAVARATKLPIIIYNIPPRSVIDMMPETMGRLAHDFKNIVGVKDATGKVERVSEQRMTCGKDFIQLSGEDASALGFNAHGGVGCISVTSNVAPRLCAEFQEATLSGDSVKALELQDRLLPLHKAIFLEPGVSGAKYALSKLGKVENVLRSPLVTVEESTAAKIDAAMKHAGLIN

SEQ ID NO: 32793 - protein, 524 aa, Arabidopsis thaliana
MDLVKPEEISHPPMDQLQGLEYCIDSNPPWGEAIALGFEHYILALGTAVMIPSILVPMMGGDDGDKVRVVQTLLFLQGVNTLLQTLFGTRLPTVIGGSYAFMVPIISIIHDSSLTRIEDPQLRFLSTMRAVQGAIIVASSVQIILGFSQMWAICSRFFSPIGMVPVIALTGFGLFNRGFPVVGNCVEIGLPMFILFVIFSQYLKNFQFRQFPVVERFALIIALIIVWAYAHVLTASGAYKHRPHQTQLNCRTDMSNLISSAPWIKIPYPLQWGAPSFDAGHAFAMMAAVLVSLIESTGAFKAAARLASATPPPPHVLSRGIGWQGIGILLNGLFGTLSGSSVSVENIGLLGSTRVGSRRVIQISAGFMIFFSMLGKFGALFASIPFTIFAAVYCVLFGLVASVGLSFLQFTNMNSLRNLFIVGVSLFLGLSIPEYFRDFSMKALHGPAHTNAGWFNDFLNTIFLSSPMVALMVAVFLDNTLDYKETARDRGLPWWAKFRTFKGDSRNEEFYTLPFNLNRFFPPS

SEQ ID NO: 32794 - protein, 522 aa, Arabidopsis thaliana
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFEYIFLPETKGIPIEEMGQVWRSHWYWSRFVEDGEYGNALEMGKNSNQAGTKHV

SEQ ID NO: 32795 - protein, 305 aa, Glycine max
MPLNIFQDKDGLPRIILTEPKGSSAEVLLYGGQIISWKNHRKEELLFMSSKANKKQHKAIRGGISACLARFGDLSSLEQHGFARNRMWSLDRDPSPLPPLDNQSSVDLILKSTEVDLKTPCSFEFRLRISLNAGKLILIPRVRNTANKAFSFSFTLCNYLSVSDISEVRIEGLETLDYFDNLLNRSRFTEQADALTFDGEMDRVYLHSPTKIAIIDHEKKRTFVLQKKGMPDAVVWNPWGKKAKAIPDLGDDDYKIMMCVNSAAIDTPILLKPSEEWMGYQELSTVSSSYCSGQLDPRKVLYGFH

SEQ ID NO: 32796 - protein, 523 aa, Ustilago maydis 521
MVVVKYAQDEARHPPLPSRLRHSLSKQRQRSARIVSTASIAPEGKATLVSSISNLTNTIIGTGMLATPGAFKYTGLVLGPLLIVFCGFTAALGLYLLTRCAARVGGRKNSFFTIASQALPAGAWYFDLAIALKCYGVSISYLIICGQLMPQVIMSFFRAFNRDVHQIPQLFLDRSFWILALIILLIPLCFLRRLDSLRHTSYLSLLAVLYLVIIVLHYSFSSDAKATLPPKGEVELVNLSWHTISIFPVFVFAFTCAQNMLPVYNELFNNHERRVNSAIGSSIGTGATVYLIVGVLGYLSFGGNVGDNIIAMYPSTSLFVCFGRVSIIILTIFSYPLQVHPCRASLDKVFSRASRRQQILDDAAAASAMDGANEEADAIEPYHDDDEDAIDDEEAPLRPSSSQTTHQAAQASDDDIPLAKWCFMTAAILSTTFVISLLVDDLSIILGFVGSVGSTTISFILPGVLYASLFRDQPNSRLRKAAVALAAWGVIVLVVALSANILKLVHAQVPSSLLVTTVAKGRP

SEQ ID NO: 32797 - protein, 294 aa, Rickettsia montanensis
MHNIFKGLITALITPFKDNKLDLYALERIIKHQIKHEVDAVLIAGSTGESSSLSFEEYKLLLQTSVEIVNKCIPIISGCSSNNTTYARALAAESTKIGVDGFMASPPSYVKPTQHGIYKHFEALHEVCNLPIMLYSAPTRSGVDFSDETILRLSKLPRILALKDCGVDLERPLRIRATVKKDFNILTGNDEVVLAFNAQGGVGWTSVASNIVPNICKELLEKWNKNDTKGALEIHQKLLPLYTALFVESNPIPIKYAAHYLGLCENEIRPPLTEASDSAKKQIENIITSLSIKI

SEQ ID NO: 32798 - protein, 305 aa, Solanum chilense
TNSINDALSSSYVVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKSHLYGSDLPTMSMSWEQRPEICIGAARGLHYLHTRAVIHRDVKSTNILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 32799 - protein, 196 aa, Vibrio fischeri ES114
MTKKILVCIAPGTEELEAITVIDILERAKFDVTVASTAFDGSLTMKAAQRVMLTADVKLVEVADEEFDCIVLPGGLKGSENFRDSTLLIEMLKQQKYDEKWVAAICAAPAIVLQHHNLYPDALMTCYPSFMEAIPEKNRRIKRVFTDVLNHLITSQGPGSALEFAMEIVTTLAGKELTAKLAADLVTLPNLNYHQV

SEQ ID NO: 32800 - protein, 466 aa, Exiguobacterium sibiricum 255-15
MKEGTFRRKMESRHIVMLSLGGVIGTGLFLSTGYTLEQAGRVGTILSYLVGALAIYLVMLCLGELAVHMPETGAFHSYATKYIGSGTGYTVAWLYWLTWTVALGSEFTAAGLLMQRWFTDVPVWLFSALFVVMILGINVLTVRLFAEVEFWFSAVKVLTILVFIVLGTAAIVGFLPLADGSQAPLLAPLTEGGLFPNGAFAILMTMLAVNFAYSGTELIGIAAGEAVDPKRTVPLAIRTTVFRLVLFFVGTIIVLAILLPNDSKGVLESPFVAVFERIGLPFAADIMNFVILTAILSAANSGLYAASRMLWSLSDQRMITPYFSKLNASGVPTRAVLFSMLGGLLALFSSVYAPGSVYIALVSISGLAVVVVWMSISASQFMFRKRYLQEGHDLNDLVYRTPWYLFVPILSFLMCLASLIGIAFDPTQRVALYFGVPFIAVCYIVHHLTKTSWKRSVEDVKEQQSS

SEQ ID NO: 32801 - protein, 145 aa, Glycine max
MSTDLQLKSSCSGCGSTTDLYGSNCKHMTLCLGCGKTMAAKRAKCVDCGATLTRLIREYNVRASSPNDKNYFIGRFINGLPDFSKKKSAENKWSLQKDGLHGRQITDTLREKYKNKPWLLEDETGQSQFQGHLEGSQSATYYLLM

SEQ ID NO: 32802 - protein, 528 aa, Oryza sativa
  misc_feature (431)..(431): Xaa can be any naturally occurring amino acid
MAEVKPEDMVHHPPMDQLQGFEYCIDSNPSWGEAIALGFQHYILSLGTAVMIPTMLVPLMGGNDHDKARVVQTLLFVTGIKTLLQTLFGTRLPTIIGGSYAFVVPILSIIRDPSLAQIADGHTRFVQTMRAIQGSLIVSSSIQIILGYSQLWAICSRFFSPLGMVPVVALVGLGLFERGFRTRGRCVEIGLPMLILLILFVALSQYLKHVNVRHVPVLERFSLLICVALVWVYAHILTASGAYKHTALLTQFSCRTDRANLISSALWISIPFPLQWGAPTFSANHAFGMMAAVVVSLIETTGAFMAAARLASATPPPAYVLSRGIGWQGIGTLLDGLFGTGTGSTVSVENVGLLGSTRVGSRSARQISAGFMIFFSMLGKFGALFASIPFPIFAAIYCVMFGIVAAVGLSFLQFTNMNSMRNLFIVGVSLXFGLSIPEYFSRYTTSAQQGPAHTKAGWFNDYINSVFSSPPTVALIMAVLLDNTLDVREAARDRGMPWWARFRTFRGDSRNEEFYTLPFNLNRFFPPS

SEQ ID NO: 32803 - protein, 303 aa, Solanum chilense
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDEINEMILIYKYMENGNLKRHLYGSDLPSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNPADKIRPESLRKFGETAVKCLALSSEDRPSMGDVLWKLEYA

SEQ ID NO: 32804 - protein, 303 aa, Solanum chilense
TNSINDALSSSYLVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32805 - protein, 303 aa, Solanum peruvianum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENWNLKRHLYGSDLPSMSWEQRLEICIGAARGLHFLHTRAVIHRDVKSINILLDENFVAKITDFGISKKGTELDQTHVSTVVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32806 - protein, 282 aa, Saccharomyces cerevisiae
MLLLALSDAHIPDRATDLPVKFKKLLSVPDKISQVALLGNSTKSYDFLKFVNQISNNITIVRGEFDNGHLPSTKKDKASDNSRPMEEIPMNSIIRQGALKIGCCSGYTVVPKNDPLSLLALARQLDVDILLWGGTHNVEAYTLEGKFFVNPGSCTGAFNTDWPIVFDVEDSDEAVTSEVDKPTKENQSEDDDAKGGSTGKEQPGSYTPKEGTAGERENENESNVKPENQFKEDEVDMSDSDINGSNSPSFCLLDIQGNTCTLYIYLYVNGEVKVDKVVYEKE

SEQ ID NO: 32807 - protein, 469 aa, Zea mays
FGSSDSAIFDLGVPILGICYGCQELAWQINSANVARGEAREYGHADVIIHKVDNHVDRLFAGLGETMHAYMSHFDKLVSLPEGFVVVASTSNSEFAGIANKTKPIFGVQFHPELEHTPRGSELLRNFSVDICGANPSWVMGDFVQQEISRIRHLVGDRAQVIGAVSGGVDSTVAAKLMKEAIGDRFHAVLVDNGLMRLNECEQVKATLGEHLGINLTVVDAADLFLGRLAGVLEPEKKRKIIGSTFIDLFEKEAERIEKEAENTPNAGKVEWFLQGTLYPDVIESLSFKGPSATIKTHHNVGGLPERMMNGQGLRLLEPLRLLFKDEVRAIGRTLNIHHDLIMRHPFPGPGIGIRILGEVTPERVEIARKADHIYISMIKEAGIYDQMSQAYAGVDTNKAVGVMGDTRVYGYIIILRAVTTSDFMSAEAFEFPWALLQKIARTIVNSVDGVSRVTYDLTSKPPGTIELE

SEQ ID NO: 32808 - protein, 131 aa, Glycine max
  misc_feature (52)..(52): Xaa can be any naturally occurring amino acid
  misc_feature (57)..(57): Xaa can be any naturally occurring amino acid
  misc_feature (84)..(84): Xaa can be any naturally occurring amino acid
  misc_feature (95)..(95): Xaa can be any naturally occurring amino acid
MADETQNRYESSEVEVQDRGAHDFLAMKKDEEDKPHAYEEVIAAEVEKVTVXTNDRXQRRLLKKLHRSDSPSSSSSEEEGEHGXNGRRRRRHRKXLKEKIVEKIEGDHHHHKDEDTCVPDEKVDVVEDSHA

SEQ ID NO: 32809 - protein, 175 aa, Triticum aestivum
  misc_feature (76)..(76): Xaa can be any naturally occurring amino acid
GNQTLQDVLRNYSSRPRIGELRTACHSFGPSGRTKIPKKGVTTGYTCRLAAPERHKSIVRPDALNPSLINVVHHFXHLKEGMKYANVGQGVMLINHYKYQVWEVFKEKFAGRVATYVADWQDEENVGSRDRAPGLGTKPVEPEDWPSRFCEVYDTGLKDFVHKEFTDPQTGSLPW

SEQ ID NO: 32810 - protein, 128 aa, Methylococcus capsulatus str. Bath
MPRQVIHTEHAPKAIGTYSQAVRVGNTVYLSGQIPLDPATMTLVDDNMEMQIRRVFDNLSAVAEAAGGTLGDVVKLNVFLTDLGHFPLVNEIMANYFSEPYPARAAIGVAALPRGAGVEMDAILVLPD

SEQ ID NO: 32811 - protein, 406 aa, Nicotiana tabacum
MLEAPKFVELIDLNQNLSQNFYHKLGEGSNMSTESYGSLQMSSGGGSVAMSMDNSSVGSNDSHTRILNHQSLNRVHNNYSVAASVNRVRVSNGLSNDALAQALIDPRFPTIGLENYDEWTIDLRKLNMGPAFAQGAFGKLYKGTYNGEDVAIKLLERPEHDLERAHLMEQQFQQEVMMLANLKHPNIVRFIGACRKPMVWCIVTEYAKGGSVRQFLTRRHNRSVPLKLAVKQALDVARGMEYVHALNLIHRDLKSDNLLIAADKSIKIADFGVARIEVQTEGMTPETGTYRWMAPEMIQHRPYTQKVDVYSFGIVLWELITGMLPFQNMTAVQAAFAVVNKGVRPTIPNDCLPVLSEIMTRCWDADPDNRPPFSQVVRMLEAAETEIMTTVRKARFRCCIQPMTTD

SEQ ID NO: 32812 - protein, 385 aa, Oceanospirillum sp. MED92
MNLPQYFSADAQSRLESLIEKYPTPFLAMDLSVVEKRYVELEHGFPEADIFYAVKANPADEVIELLASKGSSFDIASPQELDKVLAYGVPAERMSYGNTIKKASAIKYFYEQGVRLFATDSEADLQNIAKYAPGSNIYIRVLTDGSEGADWPLSRKFGCNPEMAYELAVLAKELGLNPYGVSFHVGSQQRDIDVWDGAIAKVKVIFERLLEEAGIRLEMINMGGGFPAIYLQKTNEFTTYAEEIKRFLREDFGEDIPRIILEPGRSLVGDAGVIVSEVVLISRKSSTALERWVYTDVGMFNGLIETLGEAIKYPISSSRQGEEEEVILAGPTCDSLDIMYEQFKYKLPLSLEIGDHVFWYSTGAYTTSYSSIEFNGFPPLDYYIL

SEQ ID NO: 32813 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAMAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFQGLDGVRDGYKMMPFGSGRRSCPGEGLAVRMVALSLGCIIQCFDWQRIGEELVDMTEGTGLTLPKAQPLVAKCSPRPKMANLLSQI

SEQ ID NO: 32814 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAIAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFEGLEGVRDGYKMMPFGSGRRSCPGEGLAIRMVALSLGCIIQCFDWQRLGEGLVDKTEGTGLTLPKAQPLVAKCSPRPIMANLLSQI

SEQ ID NO: 32815 - protein, 665 aa, Listeria monocytogenes EGD-e
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQHLMDDNLTADWDAELPVFDENADKPVATREVSGIILQELEKKLPNLFGGAADLASSNKTHLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRFAFTQKEQPTMLVLSRQNLPILPNSAAKAKTGLAKGAYILADSPLDKLDIILLASGSEVHLMTAVRDNLAKKGFGARVVSMPSFDLFDKQSPEYKESILPKAVKKRFAAEMGASYGWHKYLGDSGEILAIDSFGMSGPGDELAERFGFTVENLTELALKQL

SEQ ID NO: 32816 - protein, 549 aa, Triticum aestivum
  misc_feature (147)..(147): Xaa can be any naturally occurring amino acid
MGKSPAKWIKSVLLGKKSTKSSSTKAKDLPAKAANSNGYTAGKEPESSDNSPLISEPVLVSSHNVSEISNLPNGRAIENMVRVGSDTQISPEKLREELAAVKAQAAFRGYLARRAFRALKGIIRLQALIRGHLVRRQAVSTLRATWXLIVKFQALVRGRNVRFSSAATQLAVKFGQHKYGGDKSSDAWKEKLSSHPYVRKLLSSPILVQALHVQYDETNPNSALNWLERWTISCIWKPVSKPKIVTDGKPQVRRASYAMETHSAKLKRNVRKSSTATVETQANTVESEKWKRNPRKLNGSPADSVPDSQLSELEKVKRNLKKAANSMAEASKISTKADVLKVPNSIADELKILGSMAELSKKSSIPNGISDHQDSECEKALESTREAVFPLGTQDSHSGNLLENSNISKLVPDIKYDLEASFLGDKVNEPTTVAQADEVIQLQNLDNGYDIIERKEETRSKEEPLPNGSLKTKRRSSFSNSEYPESGTKNTPVPSRKPSYMAPTESLKAKLRGPPRLDSDLPVDKNAFTRRQSLPSAANNRAIKTEWRR

SEQ ID NO: 32817 - protein, 577 aa, Bacillus anthracis str. Ames
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENGVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENFSDNDIKIAVKEAIWEPEYRQIKAVEKVTI

SEQ ID NO: 32818 - protein, 303 aa, Solanum peruvianum
TNSINDALSSSYLVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32819 - protein, 241 aa, Brassica napus
MAMIGLFGVLIAFIFFLVFQCFFVCKKSHNVALLENWPFLGMLPGILFNLPRIFDWLSEVHEANDMTFAFKGPWFSGTDMLFTVDPRNINHMLSSNFPNYPKGPEFKKIFEILGDGIVAADMELWEDLRKSGHALFHHQNFLKLTVSSTTSKLKNDLVPLLDQAAEENIVIDLQDVFQRFMFDTASILMTGYDQMSLSIEMPEVEFSEAADFAEEALFYRHLKPVILWRLQNLIGVGVESR

SEQ ID NO: 32820 - protein, 303 aa, Solanum peruvianum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLLEVLCARSAIVQSLPREMVNLAEWAVESHNNGQLEQIVDPNIADKIRPESLRKFGETAVKCLALSSEDRPSMGDVLWKLEYA

SEQ ID NO: 32821 - protein, 305 aa, Solanum peruvianum
TNSINDALSSSYLVPFESYRVPLVDLEEATNNFDHKFLIGHGVFGKVYKGVLRDGAKVALKRRQPESSQGIEEFETEIETLSFCRHPHLVSLIGFCDERNEMILIYKYMENGNLKRYLYGSDLPTMSMSWEQRLEICIGAARGLHFLHTRAVIHRDVKSINILLDENFVAKITDFGISKKGTELDQTHLSTVVKGTFGYLDPEYFIKGRLTEKSDVYSFGVVLLEVLCARSAIVQSLPREMVNLAEWAVESHNNGQLEQIVDPNIADKIRPESLRKFGETAVKCLALSSEDRPSMGDVLWKLEYA

SEQ ID NO: 32822 - protein, 303 aa, Solanum peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32823 - protein, 432 aa, Bacillus cereus ATCC 10987
MINSTFLTNRVFSTWYYFSLLLYKEKGCDLVKTPKIVVLGAGYGGMITTVRLQKALSVNEAEITLVNNNSYHYQATWLHESAAGTLQDEKICLDIQDVIDTNKVNFVQDTVVEIKAAEKRIILKDGELEYDYLVIGLGFESETFGITGLKEHAFSIANINATRQIREHMEASFAKYADEKRDELVTIVVGGAGFTGIEYVGELANRVPELCKQYNVPREKARIICVEAAPTALPGFDPALVEYAVKQLEKKGVEFRIGTAIKEATEEGIIVANGDDTELIKSETVVWAAGVRGNGIVEESGFEAMRGRVKVDEYMHAPGYEDVFMVGDAALIINEEINRPYPPTAQIAIQQGYNIAHNLTVLVRGKGEMKKFVFDNKGSVCSLGHDDAMGVVMGKKLTGWKASFMKKVIDNRYLFLLGGPLLVLKKGKLKFF

SEQ ID NO: 32824 - protein, 430 aa, Pseudoalteromonas tunicata D2
MSKIVKVIGREIMDSRGNPTVEADVHLECGAWGRACAPSGASTGTREALELRDGDKSRYLGKGVLTAVNFVNTDIANAVAGQNAIEQAKIDGIMIELDGTENKEKFGANAILAVSLAVAKAAAQAKGVQLYEHIADLNGTPGQYSMPVPMMNIINGGEHADNNVDIQEFMIQPVGAPNFREALRMGAEIFHTLKKVLSARGLSTAVGDEGGFAPDLKSNEEALAVIVEAVEGAGYVMNKDITLALDCASSEFYHDGVYDLKGEGKTFNSEGFADFLADLSVRYPIVSIEDGLDESDWDGWKVLTDKIGDKVQLVGDDLFVTNTKILKRGIDNGIGNSILIKFNQIGSLTETLEAINMAKAAGFTVVISHRSGETEDATIADLAVGTAAGQIKTGSLCRSDRVSKYNQLLRIEEQLGAAVKYNGRSEIKGQ

SEQ ID NO: 32825 - protein, 993 aa, Saccharomyces cerevisiae
MVDESDKKQQTIDEQSQISPEKQTPNKKDKKKEEEEQLSEEDAKLKTDLELLVERLKEDDSSLYEASLNALKESIKNSTSSMTAVPKPLKFLRPTYPDLCSIYDKWTDPNLKSSLADVLSILAMTYSENGKHDSLRYRLLSDVSDFEGWGHEYIRHLALEIGEVYNDQVEKDAEDETSSDGSKSDGSAATSGFEFSKEDTLRLCLDIVPYFLKHNGEEDAVDLLLEIESIDKLPQFVDENTFQRVCQYMVACVPLLPPPEDVAFLKTAYSIYLSQNELTDAIALAVRLGEEDMIRSVFDATSDPVMHKQLAYILAAQKTSFEYEGVQDIIGNGKLSEHFLYLAKELNLTGPKVPEDIYKSHLDNSKSVFSSAGLDSAQQNLASSFVNGFLNLGYCNDKLIVDNDNWVYKTKGDGMTSAVASIGSIYQWNLDGLQQLDKYLYVDEPEVKAGALLGIGISASGVHDGEVEPALLLLQDYVTNPDTKISSAAILGLGIAFAGSKNDEVLGLLLPIAASTDLPIETAAMASLALAHVFVGTCNGDITTSIMDNFLERTAIELKTDWVRFLALALGILYMGQGEQVDDVLETISAIEHPMTSAIEVLVGSCAYTGTGDVLLIQDLLHRLTPKNVKGEEDADEEETAEGQTNSISDFLGEQVNEPTKNEEAEIEVDEMEVDAEGEEVEVKAEITEKKNGESLEGEEIKSEEKKGKSSDKDATTDGKNDDEEEEKEAGIVDELAYAVLGIALIALGEDIGKEMSLRHFGHLMHYGNEHIRRMVPLAMGIVSVSDPQMKVFDTLTRFSHDADLEVSMNSIFAMGLCGAGTNNARLAQLLRQLASYYSREQDALFITRLAQGLLHLGKGTMTMDVFNDAHVLNKVTLASILTTAVGLVSPSFMLKHHQLFYMLNAGIRPKFILALNDEGEPIKVNVRVGQAVETVGQAGRPKKITGWITQSTPVLLNHGERAELETDEYISYTSHIEGVVILKKNPDYREEE

SEQ ID NO: 32826 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 32827 - protein, 590 aa, Triticum aestivum
  misc_feature (95)..(95): Xaa can be any naturally occurring amino acid
  misc_feature (135)..(135): Xaa can be any naturally occurring amino acid
  misc_feature (142)..(142): Xaa can be any naturally occurring amino acid
  misc_feature (159)..(159): Xaa can be any naturally occurring amino acid
MAMVDEPLYPIAVLIDELKNEDIQLRLNSIRRLSTIARALGEERTRKELIPFLSENNDDEDEVLLAMAEELGVFIPYVGGVEHAHVLLPPLETLXTVEETCVRDKAVESLCRIGAQMKENDIVDYFIAVVKRLAXAGEWFTXARVSSCGLFHIAYPSAXPDPLKTELRTIYGQLCQDDMPMVRRAAASNLGEFAATVEQSHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILSPQLAIQHILPCVKELSSDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIREAAANNLKRLAEEFGPEWAMQHIIPQVLEKINNPHYLYRMTILQAISLLAPVMGAEITCQKLLPVVINSSKDRVPNIKFNVAKVLQSLVPILDQSVAEKTVKPCLVELSEDPDVDVRYYANQALQACDQIMMSS

SEQ ID NO: 32828 - protein, 335 aa, Arabidopsis thaliana
MSNLPRDLSDLPRNMAEEVLSRVPMTSLRRLRFTCKKWNTLSRCRSFAKKHLVCQAKVAAKKREYKVVMMMDFRVYLMRINLQNNVELCIKRERELLFPDASDQIYVRHVFHCDGLLLCIMKDNPRLVVCNPYSGQTRWIETTNNPQRLDAYSYALGYNSSTKSHKILSFGMMFDYVSSTSAEFKIYDFNSDSWRGDIWAAVCLRRPLSGIFKSSLLLSNVRDEQLAVLFQRMDTLQMEIWVTTKIEPNTVSWSSKFFLSVDMRELTGRYSMFSFSDASFFIDEEKKVAVVFDKGKKNLHRWRGWILEEVDLGESPNQNLRPLVCSYVPSSLQLD

SEQ ID NO: 32829 - protein, 457 aa, Clostridium perfringens ATCC 13124
MNKYEYIIIGFGKGGKTLAGYLGKLGKKVAIIEKSDKMYGGTCINVGCIPTKTLVHKAKVSLYKGLNTFEEKEREYRKAIEEKKSLIEALRNKNYNMLNNNENVDVFNGTASFISNTEILINSEKEDIILEGEKIFINTGATTIIPNIQGIKSSSKIYNSTTIMELKELPKHLVIVGGGYIGLEFASIYESFGSKVTVIEAFDRIAGREDEDISKSIKEILEKKGIEFLLGSKVKSFEEIHGEVEVSYENSLGELNKITGDAVLIAIGRKPNTEELNLEAAGVKVTNRGAVAVNNKLKTNVPNIWAIGDVNGGPQFTYISLDDFRIIKDNLFGEGKRSTDDRKFIPYSVFIEPNLSRVGLSEKEALEKGFEIKTAKLEVNNIPRAKVIGETEGMMKAIVDVKTNKILGCTLLCAESAEIINIVTLAMKADEDYTFLRDNIFTHPTMSEALNDLFSLI

SEQ ID NO: 32830 - protein, 391 aa, Methylococcus capsulatus str. Bath
MAFKRMTDIDLAGKRVLIREDFNVPVKDGRVTSDARIRAALPTIRHALDAGAAVMLMSHLGRPTEGEYAEEFSMKPVADRLSELLGQPVTLVKDYLGGADPAVGSVVLFENVRFNKGEKKDDEVLARQLAALCDVYVMDAFGTAHRAEASTHGVGKYAPTACAGLLLATELDALGRALHDPARPLVAIVGGSKVSTKLTVLDSLSQVVDQLIVGGGIANTFIKAAGFNVGKSLYEEDLVAEARRLMEAAKAKGGEIPVPVDVVVGKRFDAAEPAMVKSVADIAEDDMILDIGPETSRRYAEFIGRAGTVVWNGPVGVFEFDQFGEGTRRLGLAIAESHAFSIAGGGDTLAAIDKYGIADRISYISTGGGAFLEFLEGKQLPAVAMLESRAD

SEQ ID NO: 32831 - protein, 411 aa, Thermococcus kodakarensis KOD1
MFRITDFTYEGKTVFLRADLNSPVEKGRITSDARFRAVLPTIQHLLDNGAKLVIATHQSRPYKGDYITTEEHAQILSRLLGQEVEYVEDIFGKYARERISSLKPGEAIILENLRFSAEEVFNRSIEECEKTFFVRKLAPLIDYVVNDAFATAHRSQPSLVGFARLKPMIMGKLMETEVDALSKAYESEERPRVYVLGGAKVDDSLRVAENVLRKGKADLILTGGLVGQIFTLAKGFDLGDANIEFLHRKGLLELVDWAEKILDEFYPYVRTPVDFAIDYKGERLEVDLLGGEKRLFDQYPILDIGSRTVEKYREILIGAKIIVANGPMGVFEREEFAVGTVGVFRAIGESPAFSVVGGGHSIASIYRYNITGISHISTGGGAMLSFFAGEELPVLKALKISYERFKDRVKE

SEQ ID NO: 32832 - protein, 114 aa, Triticum aestivum
AAFGSASASKTAFVKSTVKAHDVVIFSKSYCPYCKRAKAVFKELELKKDPYVVELDQREDGGEIQDALSDMVGRRTVPQVFIRGKHLGGSDDTVDAYESGELAKLLNISVKDDL

SEQ ID NO: 32833 - protein, 197 aa, Bradyrhizobium sp. BTAi1
MLELRLPPVIAPIQDSAHCRAVIQRAVDELGGIDILVNNAAHQATFSEIGDISDDEWEMTFRTNIHAMFYLTKAAVPHMKPGSAIVNTASVNSDMPNPSLLAYATTKGAIQNFTGGLAQMLADKGIRANAVAPGPIWTPLIPSTMPEEKVTSFGQQVPMKRAGQPAELATAYVMLADPLSSYTSGTTVAVTGGKPFI

SEQ ID NO: 32834 - protein, 499 aa, Arabidopsis thaliana
MATRLLRTNFIRRSYRLPAFSPVGPPTVTASTAVVPEILSFGQQAPEPPLHHPKPTEQSHDGLDLSDQARLFSSIPTSDLLRSTAVLHAAPIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSVGCKSPVHDTIQDTHSCYNDCMTFLMEKASNGSGFGVVLATHNADSGRLASRKASDLGIDKQNGKIEFAQLYGMSDALSFGLKRAGFNVSKYMPFGPVATAIPYLLRRAYENRGMMATGAHDRQLMRMELKRRLIAGIA

SEQ ID NO: 32835 - protein, 357 aa, Exiguobacterium sibiricum 255-15
MNKPSIYGLTLEQMTEWLSHQGHKPFRAKQVWDWLYRKRVTTFAEMTNVNKDCLELLDQSFAIDSMTQAVKQESADGTIKFLFKLYDGSLIETVLMRHKYGLSVCVTTQVGCNIGCSFCASGLIKKSRDLSAGEIVEQIMNVQHHLDAVGKEERVSHVVVMGIGEPFDNFDNMVDFLNVIKDHNGLAIGARHITVSTSGLADKIYKFADLKLQVNLAISLHAPNNELRTQIMKINRAIPLEKLMPAIDYYVKTTNRKITIEYILLRGVNDQKAQAIELAKLFEDKRHLTYVNLIPYNPVDEHGQYQRSTSEDISTFYDTLKKNGLNCGVRLEHGTDIDAACGQLRSKQIKKDTVAAK

SEQ ID NO: 32836 - protein, 303 aa, Solanum peruvianum
TNSINDALSSSYLVPFESYRVPLVDLEEATNNFDHKFLIGHGVFGKVYKGVLRDGAKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSSNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32837 - protein, 240 aa, Zea mays
MTFVFIFFSFFLWTFHPFIYHSKRFYTILIWRRVLAFLVASQVLRIVTFYSTQLPGPNYHCREGSSMATLPPPNNVLEVLLINFPRGVNLGCGDLIFSSHMIFTLVFVRTYHKYGSKRFIKLLAWMMAIIQSLLIIAARKHYTVDVVVAWYAVNLVVFFVDTKLPEMPDRTNGSPLIPLSNKDKDGRPKDEKDVRLKDEFHKLLNGNHGDATDRRQRVQMNGRHAEEDMSMLSDATPNGT

SEQ ID NO: 32838 - protein, 303 aa, Solanum peruvianum
TNSINDALSSSYLVPFESYRVPLVDLEEATNNFDHKFLIGHGLFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLLEVLCARSAIVQSLPREMVNLAEWAVESHNNGQLEQIVDPNIADKIRPESLRKFGETAVKCLALSSEDRPSMGDVLWKLEYA

SEQ ID NO: 32839 - protein, 453 aa, Ammopiptanthus mongolicus
SDCYDSNVTASSQNKTSGQRCECPFGYSGDPYIAGSCTAIPRFYGETIRSKKWALVGVLSSLGSIILLFGLWWLYKVVRKRMIKKRKEKFFKQHGGLLLQQRLSSGEVSVDRAILFSLKDLERATDNFNINRVLGKGGQGTVYKGMLVDGRTVAVKKFKVQGKVEEFINEFVILSQINHRNVVKLLGCCLETEIPLLVYEFIPNGNLFQYLHDQNEDLPMTWDMRLRIATEIAGALFYLHSVASQPIYHRDIKSTNILLDEKYRAKVADFGTSRIVSIEATHLTTVVQGTFGYLDPEYFHTSQFTEKSDVYSFGVVLAELLTGRKPISLVSSEEAKNLASYFALSMEEDSLFEIIDKRVAKKGEKEHIMGVANLAYRCLELNGKKRPTMKEVTLELERIRGPDKKFNAQQNHEEIELARIEDYQPYSTSNTFPTLSRGSPSSEVMPVLTSDNW

SEQ ID NO: 32840 - protein, 408 aa, Zea mays
MSRPTGACLHAWRLGMATCTIPAAAAPRAHVGRHLPGIRQAARPALLLPSFSSSSSTTLLCHRLPPILPLVLQLLRVRANHAMAASAGTVYEADAEAVVRRITPALDRARHKGQAGKIAVIGGCREYTGAPYFAAISALKVGADLSHVFCTKDAATVIKSYSPELIVHPILEESYSVRVDERASVSSKILTEVAKWMERFDCIVVGPGLGRDPFLLECVSNIMRHARQANIPTVVDGDGLFLVNNNLNLVEGNPLAILTPNVYEYKRLVQKVLNCDVDEESASEQLIALCQKIGDVTIMQKGKADVISDGKTVTQVSTFGSPRRCGGQGDILSGSVAVFASWARHFVLTNEEPTEKRVNPMTLGCIAASLLLRKAASHAFEKNKRSTVTSDIIEFLGKSLEDICPAEH

SEQ ID NO: 32841 - protein, 303 aa, Solanum peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWRLEYA

SEQ ID NO: 32842 - protein, 303 aa, Solanum peruvianum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHVSTVVKGTLGYLDPEYFIKGGLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32843 - protein, 547 aa, Brassica napus
MKFRGLDLIVFLLAVVSCKANKEITCEENEPFTCNNTDRLNSKGFPKDFIFGVSSAAYQIEGGRGRGLNIWDGFTHRFPEKGGSDLGNGDTTCESYTMWQKDIDIMDEMNATGYRFSFAWSRIIPKGKVSRGVNKGGLEYYHRLIDGLIAKNITPFVTLYHWDLPQTLQDEYEGFLNRQVIEDFRDLADLCFKEFGGKVKNWLTINQLYSVPTRGYSTGADAPVRCSPKVDARCYGGNSSTEPYIVAHNQLLAHTAVVNLYRTKYRFQRGRIGPVMITRWFLPFDETNKASIDAAERMKEFFLGWYMEPLTRGRYPDIMRRMVGNRLPNFTEAEARLVAGSYDFLGLNYYATQFVQPTPNPLPVTSERYTAMMDPGTRLTFVNSRGEKTGPLFEELKGGNSYYYPPGIYYVMDYFTTKYRNPLIYITESGFSTSGDQTRQEAVADSKRIDYLCSHLCFLRKVIMEKRVNIKGYFAWALGDNYEFGKGFTVRFGLSYVNWTDVSDRNLKDSGKWYQRFINVTTKITAHQDFLRSGLSFEDKMKTLTDA

SEQ ID NO: 32844 - protein, 303 aa, Solanum peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSTNILLDENFVTKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32845 - protein, 557 aa, Pseudomonas fluorescens Pf-5
MYQYDDYDRALVLERVAQFRDQVERFMGGQLSEEEFLPLRLQNGLYMQKHAYMLRVAIPYGTLSARQMRTLASIARDFDRGYGHFTTRQNLQFNWIELAQVPDILQRLAEVEMHAIQTSGNCVRNITTEAFAGVAGDEYLDPRPLAEILRQWSTINPEFLFLPRKFKIAICSAKQDRAAIMMHDIGLYLYRARNGEMLLRVIVGGGLGRTPILGLQIRDGLPWQHLLSYVEAVLRVYNRYGRRDNKYKARIKILVKALGIEAFAREVEEEWQHLRDGPAQLTEDEFQRVASAFVPPIYERLADTDLEYGSHLAESPAFARWVARNVHPHKVPGYTCVVLSTKPGPASPPGDVTGQQMEAVADWSEDYGFGEIRIAHEQNIVLPDVPKSRLFELWQRACEHGLGTANAGLLTDIIACPGGDFCALANARSIPITLAIQQRFDDLDYLHDLGDISLNISGCMNACGHHHIGNIGILGVDKNGSEWFQVTLGGAKGRDSALGKVIGPSFSAEEIPEVIERIIATFVRYRESDEPFVETLQRIGLEPFKERVYPKALEALA

SEQ ID NO: 32846 - protein, 218 aa, Triticum aestivum
MVSLRRRRLLGLCSGKDSLPVDLPKPVENEKHGEVEHANVNPLSVHPLPLTRTSDVLPESSNGSDSLKEEKNQYYPGKEIKRRKRHRRKQYVDQEPCIMRGVYFKNMKWQAAIKVDKKQIHLGTVGTQDEAARLYDRAAFMCGREPNFELSEEEKNELVKYTWDDFLAITRNTITSKKQRKVGSLRHNKADLFIGDTEMVNGGGSSNSDDGDVDTSVS

SEQ ID NO: 32847 - protein, 333 aa, Oryza sativa (japonica cultivar-group)
MAPLRQQQQKQIPFSSSFSSSSSSSSFFFFFFFFLAVRLVLVGEGEGWGGGVVVVVVDLMTAPNIEMIASSLRNCSLNGGGGGGGGRRRGRRAAAAEGSDDSEGVTVELNSEVALPYHWEQCLDIRTGQVYYINWEDGTRTTIDPRSSSAYSPSPASRSASSSSRRCSRARGRGGGGGAAAAASTTTSSGYTSVSSVGAVTAAAAAWRSHDSSGHGYGYGYGYGSYGYGYGYDGRDGDDEESSSSSSSSSSSSSSASSSRGSAVSSTLSSFSPTDESASGAGSGYAVGDNGAHVLVAAGCRACFMYFMVPKTADVCPKCGSSGLLHLSRNGYV

SEQ ID NO: 32848 - protein, 467 aa, Arabidopsis thaliana
MEKDVMTDETCIVGRNPATIVNVNGLNISHQCMISLKLKCVIIFFGVVDAGDLLFRLITPERFIRIWQRMDRINEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKGPLSADRYEREYGLSCPVKVLEITEYGGKYEELEQMEHFLKKLPCLELVKVRASAINDKEKSRITKDLLMVPRSSNCNIKLKFC

SEQ ID NO: 32849 - protein, 596 aa, Glycine max
MSSSFSVRFLAPLPPSSSSCFPTSSLPKTWLCAAATPTVVRNHHLLLEVEASRLEPRVEERDGFWVLKEEYRGGISPQEKVKLEKDPMKLFMEGGIEELAKMSLEEIESSKHTKDDIDVRLKWLGLFHRRKQHHGRFMMRLKLKLPNGVTTSAQTRYLASVIRKYGKDGCADVTTRQNWQIRGVVHPECPEILKGLDEVGLTSLQSPMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELGIEVFRSEVEKRMPGKKLERASKEELVKKQWERRDYLGVHPQKQEGLSYVGIHIPVGRVQADDMDELARLADEYATGELRLTVEQNIIIPNLDNNKIDGLLNEPLLKGRFSPEPSLLMKTLVACTGNQFCGQAIIETKERALKVTEEVERQVAVTRPVRMHWTGCPNTCGQVQVADIGFMGCMARDDNGKATEGVDIFLGGRIGSDSHLAQVYKKGVPCKDLVPVVVDILVKHFGAVLRNREEGED

SEQ ID NO: 32850 - protein, 318 aa, Triticum aestivum
MAASCTLTVPAPFAAASSSSSTSARRYRRFGVVAMASAGQKVYAPGVAVSEGNGGLPKISLKSPHGSEAEIYLFGACVTSWKVPNGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFTSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELI

SEQ ID NO: 32851 - protein, 674 aa, Oryza sativa
LICRWECLKDILSGGYTDGILCSIGMPVIFKSVRYNCQVFCLNSKIVMIRPKISLANDGNYREFRWFSAWTFKDALVDFQLPLDISEVTSQDTVPFGYGFIQFLDVSLASETCEELFTANAPRIDLALNGVEVFVNASGSHHQLRKLSLRIDSMRNATLACGGVYMYANQQGCDGGRLYYDGCCCIAVNGDVVAQGSQFSLKDVEVLDALVDLDAVSSYRASVSSFREQASHRTKVPFVKVPYKLCKPFQSGMVPTGPVEVMYHRPEEEIAFGPSCWLWDYLRRSRASGFLLPLSGGADSSSVAAIVGCMCQLVVKDIENGDEQVKADAMRIGQYKDGEFPKDSRELAKRLFYTVYMGTENSSEGTRSRAKMLAEEIGSFHLDVPIDSIVSALLSLFERLTGKRPRYKVDGGSNTENLGLQNIQARIRMVLAFMMASLMPWVHNKSGFYLVLGSSNVDEGLRGYLTKYDCSSADINPIGSVSKQDLRAFLRWAAVHLHYSSLAEVEAAPPTAELEPIRADYNQLDEVDMGMTYEELSIYGRLRKIFRCGPVSMFQNLCHRWCGTLSPSEVADKVKHFFKYYAINRHKMTVLTPSYHAESYSPEDNRFDLRQFLYNARWPYQFRKIDELVQDMDKDGKWVNSTEGELRRRKGVRSAEGGGMGVVAVGSANPSAGS

SEQ ID NO: 32852 - protein, 303 aa, Solanum peruvianum
TNSINDALSSSYLVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32853 - protein, 240 aa, Ehrlichia ruminantium
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSESFPKNGKFIIAYEPVWAIGNNKIPSTDVIIEALEIIRSYDYVSDIIYGGAVNHTNVGDIVSINQLSGVLVGSASLDMESFFNIICSAINVRQS

SEQ ID NO: 32854 - protein, 303 aa, Solanum peruvianum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHFLHTRAVIHRDVKSINILLDENFVPKITDFGISKKGTELDQTHVSTVVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32855 - protein, 251 aa, Ehrlichia ruminantium
MMAKAISSVTNKPIIEVNHLEAHTLLIRMFHDIDFPFLVLIISGGHCQFLIVHDVGCYQRLGSSLDDSLGEVFDKVARMLNLGYPGGPIIEKKSIMGDSKSFFLPRALINRLGCDFSFSGIKTAVRNIVVNQKYIDNDFICNISASFQDCIGDILVNRITNAIHMSQAINCKINKLVVTGGVAANHLLRNRISICVKDNNFEVLYPPTELCTDNGIMVGWAGIENLSKGYVSNLDFVPKARWPLESIKRSS

SEQ ID NO: 32856 - protein, 305 aa, Solanum peruvianum
TNSINDALSSSYLVPFESYRVPLVDLEEATNNFDDKFFIGGGGFGKVYKGVLRDGTKVALKSCKPESSQGIEEFETEIEILSFCRHPHLVSLIGFCDERNEMILIYKYMENGNLKRHLYGSDLPTMSMSWEQRLEICIGAARGLHYLHTRAVIHRDVKSTNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 32857 - protein, 111 aa, Arabidopsis thaliana
WLNFQGKDPTLDFLSKGGKNQFDPPRFLRVITAFDHFLKVDQKLGNSVIGENTQGGGFARLGSEDQTIVAGTMNHLESVDFEAPLLGLGIVGKTHPGEKEMLKFYNSKGGT

SEQ ID NO: 32858 - protein, 234 aa, Glycine soja
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 32859 - protein, 303 aa, Solanum peruvianum
TNSINDALSSSYLVPFESYRVPLVDLEEATNNFDHKFLIGHGLFGKVYKGVLRDGTKVALKRRQPESSQGIEEFETEIATLSFCRHPHLVSLIGFCDERNEMILIYDYMENGNLKSHLYGSDLPSMSWEQRLEICIGAARGLHYLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 32860 - protein, 375 aa, Arabidopsis thaliana
MEREGKSDPIPIDIILDILSRLSTNSIAKFGLASKFCGSILRGQDFIELFLITRPLSRPRLLFAVQNSDKWCLYSSPQSQFPDENHSLVVSADFHMELRRDMGQEIFGLVSGLLYFPNTRTGEVPVICNPSTGQYARLTQRSSMNNLSSLLGYDPIGKKYKVITPSSSHFDPENILTLGTGKVAWRSIRCLVDHYPESEGICINGVLYYMASNKFQFSGVKIASFNVRYETLKFLNADVDVTFCPALAKLINYKGKLCVLSCLWDNQIYPKPLRWKVLMLWLWVLEDAEKEEWLKREYTLPVNIVHGNVSVVGVTATGEIILSMDYTSESFFVYYFNPERNTLEKVEIQGFEGSEKNLSSRVYTFVDYAEDVKFI

SEQ ID NO: 32861 - protein, 268 aa, Magnetospirillum magnetotacticum MS-1
AAPYIRVPYREIALSDPKEAPVRVYDPSGPYTEIDAGIDLEKGLPTAREPWIARRGYAAVKPREVKPEDNGFASADKLVAPCPAERTIRRAEPGQMVTQYEFARAGIVTEEMIYVAHRENACRAEMLKSAEAALADGQNFGAAIPPFITPDFVREEVARGRAIIPANINHLELEPMAIGRNFLVKINANIGNSAVTSSAAEEVEKLVWSIRWGADTVMDLSTGRNIHNIRSWIVRNSPVPIGTVPIYQALEKVGGDPLKLDWEVFKDT

SEQ ID NO: 32862 - protein, 74 aa, Arabidopsis thaliana
  misc_feature (34)..(34): Xaa can be any naturally occurring amino acid
  misc_feature (55)..(55): Xaa can be any naturally occurring amino acid
MATSMLSSATMVASPAQVITVDPFIGLKSPADFXSPVLVTFDIISIKSTSSRINXLHAWSQTVITKFVTRSYPP

SEQ ID NO: 32863 - protein, 676 aa, Oceanospirillum sp. MED92
MKVLMIVQARLGSSRLAGKVLKEVVGQPLLKIMLSRLSKSKCADQIVVATGEEHENASLIEAVKSWGYSIYAGSQHDVLKRFYDCAEQYNPEYVVRLTGDCPLIDVTLVDEVIESILNSDFEYVCNNYPATYPDGLDAEVFTFDALKNAYLNAVDSYDREHVTPYLRKPGFFKTHTLSADKNHSDKRWTLDQIEDLEVIKFVFEALAPDVHFGWKEVLELQCEQPAKFEANCEIQRNEGSTMSSGTKLWRRAKQLIPGGNMLLSKRPEMFLPDGWPTYFSEASGIVVKDLDGNSFTDMALMGVGTNTLGYGHPKVDEAVQRTVRQGNMSSLNCPEEVMLAERMVALHPWADMVRFSRAGGEANSIAIRIARAATGRDKIAVCGYHGWHDWYLSVNLSSDDSLDQHLLPGLDPKGVPKDLEGSVITFMPNDIERLRGIIEGDEIAVVKMEVKRNIEPEDGYLQAVRELCDKHGVVLIFDECTSGFRETFGGLHLKYGVNPDMAVFGKALGNGYPITAVIGTRDVMDAAQSTFISSTFWTERIGPSAALATLEVMEQEQSWLQITDYGCKVRDAWKHLAERYKLDIECFGLPALGGFSLKGEQAVVLKTLISQELLKQGILASNALYPSIAHTEDHLLSYLKHLEAVFSTFSSCIKQGDDPMGLLDGALCHSTFKRLN

SEQ ID NO: 32864 - protein, 511 aa, Arabidopsis thaliana
MFIVFSLLYITAERPANLDDRIQLSISQGFENPNLSMEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQVMKETA

SEQ ID NO: 32865 - protein, 160 aa, Cucumis sativus
MFPMVTGFMNYGQQTVRAARYIGQGFVITLSHANRLPVTIQYPYEKLIASERFRGRIHFEFDKCIACEACVRVCPIDLPVVDWKLETDIRKKRLLNYSIDFGICIFCGNCVEYCPTNCLSMTEEYELSTYDRHELNYNQISLGRLPMSVVDDYTIRTILN

SEQ ID NO: 32866 - protein, 304 aa, Corynebacterium efficiens YS-314
MVSMSTGLTAKTGVEHFGTVGVAMVTPFTESGDLDVAAGREIAAHLVDNGVDALILAGTTGESPTVTTAEKLTLLKAVREEVGDRAKLIAGAGTNNTRSSVELAEAFAEVGADGLLVVTPYYSKPSQEGLVRHFTEIAQATDLPICLYDIPGRSGIPIESDTIRRLSELPTILAMKDAKGDVVAAAPLIEETGLAWYSGDDPLNLVWLALGGSGFISVIGHAAPNALRELYTSFEEGDLARAREINATLSPLVAAQGRLGGVSMAKAALRLQGINVGDPRLPIVAPNEQELEDLRADMKKAGVL

SEQ ID NO: 32867 - protein, 303 aa, Solanum peruvianum
TNSINDALSSSYLVPFESYRVPLLDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHVSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32868 - protein, 303 aa, Solanum peruvianum
TNSINDALSSSYLVPFESYRVPLVDLEEATNNFDHKFLIGEGGFGKVYKGVLRDGTKVALKSCKPESSQGIEEFETEIETLSFCRHPHLVSLIGFCDERNEMILIYKYMENGNLKRHLYGSDLPSMSWEQRLEICIGAARGLHFLHTRAVIHRDVKSTNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32869 - protein, 418 aa, Arabidopsis thaliana
MKCFLFSGGDKRGEQKTPISVSLTSIFSDREINRSGSEFNSRDVSGTSTESSMGRKNSYPPVSTRASNLREFSITDLKSATKNFSRSVMIGEGGFGCVFRGTVRNLEDSSVKIEVAVKQLGKRGLQGHKEWVTEVNFLGIVEHTNLVKLLGYCAEDDERGIQRLLVYEYMPNRSVEFHLSPRSLTVLTWDLRLRIAQDAARGLTYLHEEMEFQIIFRDFKSSNILLDEDWKAKLSDFGLARLGPSEGLTHVSTDVVGTMGYAAPEYIQTGRLTSKSDVWGYGVFLYELITGRRPVDRNRPKGEQKLLEWVRPYLSDTRKFKLILDPRLEGKYPIKSVQKLAVVANRCLVRNSKARPKMSEVLEMVNKIVEASSGNGSPQLVPLNSVKASRDARGKNNGGGGEGGWFGKLWNPKTIRAC

SEQ ID NO: 32870 - protein, 303 aa, Solanum peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYDYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 32871 - protein, 305 aa, Solanum peruvianum
TNSINDALSSSYLVPFESYRVPLVDLEEATNNFDDKFFIGHGVFGKVYKGVLRDGTKVALKRRQPESSQGIEEFETEIETLSFCRHPHLVSLIGFCDERNEMVLIYKYMENGNLKRYLYGSDLPTMSMSWEQRLEICIGAARGLHYLHTRAVIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNKGQLEQIVDPNLADKIRPESLRKFGETAVKCLALSSEDRPSMGDVLWKLEYA

SEQ ID NO: 32872 - protein, 548 aa, Schizosaccharomyces pombe 972h-
MKGIKSKMLSRGKSQDTQKSSKKKESKKSNSHDSSKAPKESPSTDPNGSVIGAQNDFLTVPKHSGKKVPIDTTPTPRDEILLENVRTVRKQRSSLYHISENRNLVRLPSFTDVPVNKWHSLALEKLEQCCVVFDFNDPSTDLYGKEVKREALQDLIDLISVRKEAIDESLYPSIVHMFAVNVFRPLPPPSNPPGEIMDLEEDEPALEVAWPHLHLVYDFFLRFFESPSLNTSVAKVYINQKFIRKLLVLFDSEDPRERDFLKTTLHRIYGKFLSLRAFIRRSINNLFLQFVYENEQFNGIAELLEILGSIINGFALPLKEEHKIFLSRVLIPLHKAKSLPLYYPQIAYGIVQFVEKDSSVTEEVVLGLLRYWPKVNSSKEVLFLNEIEDIIEVMEPSEFLKIQVPLFHKLATSISSQNFQVAERALYFFNNDYFVHLVEENVDIILPIIYPALFEISKSHWNRVIHSMVCNVLKLFMDINPSLFDEVDAEYSESRRKKEDEEIIREERWTILENIAKENAMKLKSQNPTTVHSTTERLKKLSLDYTNG

SEQ ID NO: 32873 - protein, 549 aa, Saccharomyces cerevisiae
MTSQEYEPIQWSDESQTNNDSVNDAYADVNTTHESRRRTTLQPNSTSQSMIGTLRKYARFIGPGLMVSVSYMDPGNYSTAVAAGSAHRYKLLFSVLVSNFMAAFWQYLCARLGAVTGLDLAQNCKKHLPFGLNITLYILAEMAIIATDLAEVVGTAISLNILFHIPLALGVILTVVDVLIVLLAYKPNGSMKGIRIFEAFVSLLVVLTVVCFTVELFYAKLGPAKEIFSGFLPSKAVFEGDGLYLSLAILGATVMPHSLYLGSGVVQPRLREYDIKNGHYLPDANDMDNNHDNYRPSYEAISETLHFTITELLISLFTVALFVNCAILIVSGATLYGSTQNAEEADLFSIYNLLCSTLSKGAGTVFVLALLFSGQSAGIVCTLSGQMVSEGFLNWTVSPALRRSATRAVAITPCLILVLVAGRSGLSGALNASQVVLSLLLPFVSAPLLYFTSSKKIMRVQLNRTKELSRTTDKKPVADRTEDDETIELEEMGIGSSSQERSLVSPAPEYKDMSNGMIVTVLAIIVWLIISGLNFYMLLGFTTGKEVHL

SEQ ID NO: 32874 - protein, 388 aa, Yersinia pseudotuberculosis IP 32953
MTLSTIDLFNLSENEDYVYILDLDAMTQFVREFRGIWDKQFPHVIFAYSFKSNNIASVTQLMFREGFSAEVVSLHELKLAINDGFFGTNIFFDGPVKLDNEIEFALSNNVNIQCDNITEIERVLALAANTNAEPHISLRLSSDYRGQGLSRFGMDKDEWNEAIALLTTHGILCNGIHVHSGSNLSSCQGIVDTLESFQDEIGALKNHLRFIDIGGGYPASTCGSDTASILEQYSVKIALQLRRLGIDFHKTPLILEPGRALTEDFGYLVTRIVFAKCRYSTNVITTAVPGTNIRSAQYHNHRKVLIIPERPVNCEHSVADVYGSNCYENDIIAKNVPVPFDLSLDDKIAIFSCGAYDIMNSSDWIRKRPPIIVISNGKTYYEHYRFAG

SEQ ID NO: 32875 - protein, 514 aa, Mycobacterium tuberculosis CDC1551
MSQSHIGGVSRREFLAKVAAGGAGALMSFAGPVIEKAYGAGPCSGHLTDIEHFVFFMQENRSFDHYFGTLSGTDGFNTVSPLFQQKGWNPMTQALDATGVTMPYRFDTTRGPFLDGACVNDPDHSWVAMHESWNGGVNDNWLPAQAKTRSAAHTPTVMGYYTRQDIPIHYLLADAFTVCDRYFCSVLGPTLPNRLYWLSATIDPDGQNGGPELQSPTFQPVRRFGWRIMPQNLSDAGVSWKVYRNKTLGPISSVLTYGSLVTSFKQSADPRSDLVRFGVAPSYPASFAADVLANRLPRVSWVIPNVLESEHPAVPAAAGAFAIVNILRILLANPAVWEKTALIVSYDENGGFFDHVVPATAPAGTPGEYVTVPDIDQVPGSGGIRGPIGLGFRVPCFVISPYSRGPQMVHDTFDHTSQLRLLETRFGVPVPNLTAWRRSVTGDMTSTFNFAVPPNSSWPNLDYPGLHALSTVPQCVPNAALGTINRGIPYRVPDPQIMPTQETTPTRGIPSGPC

SEQ ID NO: 32876 - protein, 393 aa, Cucumis sativus
MNGPATRKDLMIVNMGPHHPSMHGVLRLILTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELVYDLFEAATGMRMMHNFFRIGGVAADLPHGWIDKCLDFCDYFLTAVAEYQKLITQNPIFLERVEGVGIISGEEVINWGLSGPMLRASGIPWDLRKVDRYECYDEFDWEVQWQKEGDSLARYLVRLAEMTESVKIIQQALEGIPGGPYENLEIRSFDRARSPEWNDFDYRFISKKPSPTFELAKQELYVRVEAPKGELGIFLIGDQGGFPWRWKIRPPGFINLQILPQLVKRMKLADIMTILGSIDIIMGEVDR

SEQ ID NO: 32877 - protein, 427 aa, Burkholderia thailandensis E264
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILGDRGMSTAVGDEGGFAPNFGSNDECLSTILQAIEKAGYRAGEDVLLALDCAASEFYHDGKYQLAGEGLQLSSAEFSDYLATLADKFPIVSIEDGMHESDWDGWKLLTDRLGKKVQLVGDDLFVTNTRILKEGIEKGIANSILIKINQIGTLTETFAAIEMAKRARYTAVISHRSGETEDSTIADIAVGLNAGQIKTGSLSRSDRISKYNQLLRIEEDLGDIASYPGKSAFYNLR

SEQ ID NO: 32878 - protein, 453 aa, Burkholderia thailandensis E264
MEFDYDLFVIGAGSGGVRLSRVAASYGARVGIAEEERIGGTCVLRGCIPKKLLVYASHYGHDVEDAAGFGWTFDIGLFSWPALIEAKDREIARLSGIYGDLLNKSGVEIHAGRATLVDAHTVDVAGRRITARHIGVATGSRPVLPPIPGIEHAITSREALDLPELPRRIAIVGGGYIAVEFAGIFNGLGADVDLFYRGAQILRGFDDDVRRALHGEMTKHGIAIHTHAGIDAIERGADGALTLRLAQGAYGPYDAVLYATGRVANGDGLGLEAVGVARDARGAIEVDAYSTTTVPSIHAIGDVTARPQLTPVATRDGMLLAANLFGGKRIAADHRYIPSAVFSQPEIATVGLTEADARAELGALDIYKTSFRALRHTLSGRDEKTFMKLVVARDSQRVVGAHMVGRDAAEIIQGIAIAIRAGATKAQFDETVGIHPTAAEEFVTLRQKEPDDA

SEQ ID NO: 32879 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 32880 - protein, 181 aa, Brassica rapa
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVELELEHGFVYREHGSTPGYYDGRYWTMWKLPLFGCTDSAQVLKEVQECKTEYPNAFIRIIGFDNNRQVQCISFIAYKPPSFTGA

SEQ ID NO: 32881 - protein, 868 aa, Pisum sativum
MFSGVAGIINRGQKLKGTGGLMQKNVLDINALTAIKSPTGIVTGAFGAIGGAIGTVVDTATSFIGRSVALKLISATSADGSGKGKVGKQTFLEGLLTSILTLGAGQSAYTIHFEWNSDMGIPGAFYIENFMQHEFFLVSLTLEDIPNHGSIHFVCNSWIYNDKKYKSDRIFFANKTYLPNETPAPLVHYRQEELKTLRGDGTGERKEWDRIYDYDVYNDLGAPDQKATLARPVLGGSSILPYPRRGRTGRKPAKKDPNSESRSDFVYLPRDESFGHLKSSDFLAYILKSASQNLIPQLRSIVTLQLKQPEFNTFEDVRSLYEGGIKVPTNFLSDISPIPLFKEIFRSDGAAALKFSKPKVVQVDHSAWMTDEEFAREMIAGVNPHIIKKLVEFPARSKLDTQLYGDNTSTVTKGHLEPNMGGVTVEQAIQNHRLYILDHHDTVFPYLRKINATDTKAYATRTFLFLQNNGTLRPLAIELSKPRPQDDSYGPISEVYLPASEGVEGSIWLLAKAYVVVNDSCYHQLVSHWLNTHAVVEPFIIATNRHLSVVHPVHKLLLPHYRDTMNINSLARNVLVNAEGIIESTFLWGGYSLELSAVVYRDWVFTNQGLPNDLLKRGVAVVDPASPHGIRLLIEDYPYASDGLEIWAAIKSWVEEYVNFYYKSDEAIAQDAELKASWKDLVEVGHGDLESATWLVKKETCAELIEACTILIWIASALHAAVNFGQYPYGGYILNRPTKSRRFMPEKGSPEYDELAKDYQKGYLRTITPKNDTLTDLTIIEVLSRHASDEQYLGQRIEGDLWTSDSQPIEAYKKFGKKLAEIEQKLVQRNNDESLRNRYGPVKMPYTLLYPSSEEGLTFRGIPNSVSI

SEQ ID NO: 32882 - protein, 477 aa, Frankia sp. EAN1pec
MKWETIPEMVLSAADRFDDAEAVVDGALRLTYTELVDRIRAAAGSFAAAGVGKGDRVAIWAPNSAEWIIAAFGLLTAGGVLVPVNTRYKAEEADDILRRSGAKMVLVQEGFLGQVYAGTTCVPAVDIKSGFLSSGAPLDGPVGQDGDETADILFTSGTTGRPKGVMMNHRQTLRLYEEWCELADLREGDRYLCVNPFFHNFGYKAGLVAALIRGATIVPMAVFEIDKLIELVEREKITMLPGPPTLYHSLLAVPDKTALASLRCAVTGSADIPVELIRRMRDELPFRSIMTGYGLTEAGTATASRPGDSFVDIATTVGTACDGVEVAVADDGEVLVRGYTVMQGYLDDPVATAEAIDPDGWLHTGDLGTLDERGHLRIVGRKKDMFIVGGFNAYPAEIEGFLLEHPAVAQAAVIGVPDERMGEVGKAFVVRRAPVTADELITWSKGRMAGFKVPRTVEFLESLPLNASGKVMKDNLR

SEQ ID NO: 32883 - protein, 210 aa, Bacillus licheniformis ATCC 14580
MIKADELTFNEAGLIPAIVQDAASKEVLTLAYMNKESFEKTLETKETWFFSRSRGELWHKGATSGNIQRVKDIRLDCDQDALIVLVEPAGPACHKGSYSCFSPGEHIRQTDGGRFDIINELETVIAKRQAEMPEGAYTTYLFREGVDKILKKVGEEAAEVIIAAKNRDPEELKWEAADLLYHLLVLLREQSLPLDDVLGVLKERHEGSES

SEQ ID NO: 32884 - protein, 176 aa, Manihot esculenta
MASSMLSTATVASINRVSPAQATMVAPFTGLKSTPVFPTTRKTNSDITSITSNGGKVQCMKVWPTLGMKKFETLSYLPPLTREQLAKPSCIGPCLEFELEHGLVYREHARVPGYYDGRYWTMWKLPMFGCTDAAQVLKELDELIKHHPDGYARIIGFDNVRQVQCISFLAYKPPGA

SEQ ID NO: 32885 - protein, 184 aa, Manihot esculenta
MATSMLSTATVASINRASPAQASMVAPFTGLKSTSAFPATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 32886 - protein, 198 aa, Zea mays
MATGPRSLHALLGGGAVADLLLCRRRNASAAAVVGATAVWFVFERAGYSFPSVLSNALLLLVAILFFWAKSALLLNRPLPPLPNLEVSDAVVEKAADYALVWINRLLAVGHDIAIKRNRKVFIKVILILWLVSFVGMLFNFLTLIYIGVMLSLLVPPLYEKYQDQVDEKVGVAHSIISRHINTIVIRAGQSAKEKKTE

SEQ ID NO: 32887 - protein, 1454 aa, Oryza sativa (japonica cultivar-group)
MAGMAPEGSQFDAKHYDSKMQELLHQGDNEEFFTSYDEVFESFDDMGLQENLLRGIYAYGFEKPSAIQQRGIVPFCKGLDVIQQAQSGTGKTATFCSGILQQLDYGLVECQSLVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANLFAIRTNFVLIGNVKSNLFREKVYVQLIKNSALSAFGGEKILCSYTLWINLVNIIAVLVGCVFLAVWSNHSKITIAKQDHSKITIAKQSLCISNGRLPQPQPPAKSKWKKKDEKKDDDLSEEDLALKEQLELYVVRAQDADPGVQKLALESMRQEIRSATSSMTSVPKPLKFLRPHYGTLKSYFETMPESSDLKRYMADILSVLALTMSAEGERESLKYRLLGSEGDIGSWGHEYVRNLAGEIAQEFQKRQDDDMPIDALMELVQQIVSFHMKHNAEPEAVDLLMEVEDLDLLVEHVDSTNYKRTCLYLTSSSKYLPAPDDMLALDIAYTIYMKFEDLTSALRIALLLDNKSMQYVKQVYTATEDLQLKKQFSFIIARHGLAMEIDDEIAADGNDKEGLQEIVNNSKLSEGYLTLARDIEVMEAKSPEDIYKVHLIDGRGASSSLDSARQNLAATFVNAFVNAGFGQDKLMTAPSDSSSSGASGNWLFKNKEHGKASAAASLGMILLWDTDSGLAQLDKYLHSNDAHVVAGALLGIGIVTCGVKNDCDPALAILMEYINKDDTNIRIGAILGLGIAYAGSQKEELKSYLSTVLGDSEKSTLEVLIFSAIALGLVFVGSCNEEIAQSIIFALMERSEAELAEPIIRLLPVALGLLYLGKQESVEATAEVSKTFDEKIRKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGFIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTSVLEGFVILKKNPEYNEERGILGNHAATWDRIFAYWVPSSAPPGVNRIGLLSLLPESRVLEQSSLNSEILFGCAMTDVTYHLYPNMGI

SEQ ID NO: 32888 - protein, 307 aa, Glycine max
MISPFTHNLSTSKIIDSHLHIWASPQEASEFPYAPGQEPPVPGNLHFLLQNMEEAGVDGVLIVQPIFHKFDHSYVTSALKKYPTKFVGCCLANPTDDGSGLKQFEDLVLKDGYRAVRFNPELWPAGEKMTNKVGKAIFQRAGELNVPVGFLCMKGIGLYMSEIEQLCTEFPSTVVLIDHLGFIKPPLNEEEGLVFSQLLNLSRFPKVYVKFSSLFQVSREKFPYLDLAPLLSQVVASFGANRVMWGSDFPYAAAECGYKAAKEAVLLIANQISLPPSDLEWIMGRTVAQLFPNQWTDAKQGFHRERE

SEQ ID NO: 32889 - protein, 290 aa, Legionella pneumophila subsp. pneumophila str. Philadelphia 1
MFSGSIVALVTPMRNDSVDVHHLRELVEFHIAKGTHALVAAGTTGEAGTLSHSEKLLVIKTVIEQAKERVPVIAGTAMNATKDCIELTQQAMEYGAHAALIMTPAYIKPTQEGLYLHYSHIAQSVAIPIILYNVPGRTACDMLPETVARLAKISNIIGIKEATGQMTRLQQILRLCEGSIDVYSGDDLTAAQWLLAGAKGVISVTANVAAKLMAKMCDLAMDDDQAGCLRIQEQLMPLHELLFVESNPIPVKWAMNKMGLIGGELRLPMTELSEKHHQALEKVLKNLELI

SEQ ID NO: 32890 - protein, 448 aa, Neurospora crassa
MASQHKVLMLGAGFVTRPTLDVLSEAGIPVTVACRTLASAQKLSEGVKNATPISLDVTNDEALDAEVAKHDLVISLIPYTFHATVIKSAIRQKKHVVTTSYVSPAMMELDAEAKAAGITVMNEIGLDPGIDHLYAIKTIDEVHQAGGKILSFLSYCGGLPAPEDSDNPLGYKFSWSSRGVLLALRNAGKWWQDGKIVEVEGKDLMKMAKPYFIYPGYAFVAYPNRDSTIYKERYNIPEAQTVIRGTLRYQGFPQFIKTLVDIGFLDDTARESLSKQTPWKEATKEIVGAASSSQADLEAAILSKATFESAEDQKRILSGLRWIGLFSDETITPRGNPLDTLCATLEQKMQFEEGERDLVMLQHKFEIEHADGSRETRTSTLVEYGDPKGYSAMAKTVGVPCAVAVKQVLSGQISGKGVLAPMSTDITEPLMKELHEKYGITMIEKTIS

SEQ ID NO: 32891 - protein, 248 aa, Pseudomonas fluorescens Pf-5
MDKVIVITGGGRGIGAATAVLAAQQGFKVCINYQADEQSALQVLEQVRALGVQAIAVRADVSIEDEVIGLFLRVDSELGRVTALVNNAGTVGHKSRLDEMSEFRIQKIMKTNVMGPILCAKHAVLRMSPRHGGQGGSIVNVSSVAARLGSPGEYVDYAASKGALDTFTIGLSKEVAGEGIRVNAVRPGYIYTDFHALSGDADRVSKLESAIPMGRGGRPDEVAEAIVWLLSDKASYATGTFVDLGGGR

SEQ ID NO: 32892 - protein, 611 aa, Oryza sativa
MAKQEQSRDTETNNVAAALQWLRHGELTTPYNGIGMSFGGFDPILSDVAAESAWDPRGPHMSDIHVHRGSAAGRVLAVALALAGRVPAPVRAARPRRPSPPRSPPYAPAYTRSTCTPWNLVLITGTCAPGTGWRLELGDSRRLRQRGGKRAEEVAVDVGWADDEHIDVGAAAVDAEVVGAEGEHQGGGLVGHAVGEHRAAVSSALSYRPSSRRRLSSRAVLSRSAGVGRLSRLAPPCHSVDQQPERSRIARRARPRQWRRTALLSAALVPRQPPATPALLPAASKETEWSSTESSAASGLDFEDTALTLRLPCSLAAAVPDPTASAPPPKPTRPTTPPPSPPPATTIGFPTAAAAATADRAMPTPASPRLRHGTSKKQYLYEELMSGHQPKTSSVNHPSCHSSRLKMQGITKALRFHGKQLKLTVLQHMNKGIFSWATLISRIQTESPTVIIPHIGLENIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 32893 - protein, 389 aa, Oryza sativa (japonica cultivar-group)
MIHHLQRRIVSLLLLHPASPHPVAAISLGRLLSTTAPVSSKPFAAEDYLVAACGLTRAQAARASERISHLRSPSKPDAVLAFLAGLGIPRPDIATAVAADPRLLCAGVEGNLAKRVAELGDLGIPRSQIARLVPLAKIPFRSSSLATNLAFWLPVFGSLDSILRALRKNSSLLSANLDKVVKPNLAFLKQCGIDARDVASNPNLYSSRLFTSNPMKLRDAVARVEELGMVRGSRVFHRGLVAVAFLSKEAVATKTRLLVELGFSQDDVSVIFRKMPSFLTASEKRIRRAVGFLKGDVGLEERYIARRPVLLLYSLERRLLPRYYLLKVLRTKGLLDCKLCYYSTAALGEKKFIERFVHPYEDHIAGLADAYGSICSGKVANGVAPLLGL

SEQ ID NO: 32894 - protein, 460 aa, Oryza sativa (japonica cultivar-group)
MIQFRRRILTLLLQPASPRPIAGIFLPPCSLRRLLSTTAPVSPKPFAVEDYLVAGCGLTRAEAAKASAKISHLSSPSNPDAVIAFLSDLGLPRPQIAAAIAADPRLLCADVEKNLAKRVGELGDLGFSRSQIARLLPLAGWCFRSSSLATNLAFWLPVFGSFDKILKALRMNKNLLSPGVQKSAKPILAFLEQCGINASDVARSSTMYSSRLLTANPEYLRDAVARVEELGLDRSSRRFHRGLVAVALVSKETAARKIRLMEELGFSQDDLLVIMRKLPNFLALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEEGNGVASLLSLQTEMDAWEIENGEDFLVRKKEGIVDYCQMILIDYAGANNAGELCCSAASAMMSPCVFWLLTIARILFDD

SEQ ID NO: 32895 - protein, 133 aa, Sulfolobus tokodaii str. 7
MVNLNPLANALTTIYNNEMRRNKQAIIMPASKLIINVLRAMQKEGYIGEFEFIDDGRSGKIVVQLLGRINKCGPIAPRYPLKYKDLLTLPDYVRRYLPSKEIGVLIISTNKGVMTHKDAIRERIGGVALGYVY

SEQ ID NO: 32896 - protein, 393 aa, Oryza sativa (japonica cultivar-group)
MIRLRERILSLLLQPASPRPIAGIFPPPCPLRRLLSTTAPVSPKPFAVDEYLVATCGLTRAQAAKASEKLSNLRSPSNPDAVLAFLSDLGLSRPDGIAAAVAADPRLLCADVGSSLARRVDELGGLGLSRSQIARLLPLAGRCFRSSSLATRLAFWHPVFGSFENILKALKMNAALLGSDLDKVAKPNLAFLAQCGINASDVTRTTLSLYSCRLFTVNPRFLQDAVARVEELGVARGWRTFHRVLSTVAFLSRETIASKMQLLDDLGFSQDDFLVIVRRAPQVLRLSDGRIRRSVEFLIRDVGLEQSYIAQRPTLLAYSLERRLLPRHCLLKVLKAKGLLNCDLSYYCIAAMSEEKFVQRFVDPFKDKIQGLADAYTSSCSGEANGVRSLVCL

SEQ ID NO: 32897 - protein, 184 aa, Manihot esculenta
MATSMLSTATVASINRASPAQASMVAPFTGLKSTSAFTATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 32898 - protein, 194 aa, Bacillus licheniformis ATCC 14580
MRKAERARKTNETDIKLSFHIDGEGKADIQTDVPFMTHMLDLFTKHGQFDLSIEAKGDVEIDDHHTTEDIGICLGQALLEALGDKQGIKRYGSSMVPMDEALAQVAIDLSNRPHLEFRAEFPSRKIGTFDTELVHEFLWKFALEARMNLHVIVHYGTNTHHMIEAIFKALGRALDEAALIDPRVKGIPSTKGML

SEQ ID NO: 32899 - protein, 468 aa, Pseudomonas syringae pv. phaseolicola 1448A
MGLNDQWMQRDLKVLWHPCTQMKDHENLPLIPIKRGEGVWLEDFEGKRYLDAVSSWWVNVFGHANPRINQRIKDQVDQLEHVILAGFSHQPVIELSERLVKLTPEGLNRCFYADNGSSCIEVALKMSFHYWLNRGQPDKKRFVTLTNSYHGETMAAMSVGDVPLFTETYKALLLDTIKVPSPDCYHRPEGMSWEEHSRNMFAAMEQTLAEHHASVAAVIVEPLIQGAGGMRMYHPVYLKLLRDACDRYGVHLIHDEIAVGFGRTGTMFACEQAGIRPDFLCLSKALTGGYLPLAACLTTDDVYDAFYDDYPTLRAFLHSHSYTGNPLACAAALATLDIFEQDNVIENNKALAQRMATATAHLVDHPHVAEVRQTGMAIAIEMVQDKATKTAYPWQERRGMKVFQHALERGALLRPLGSVVYFLPPYVITPEQIDFLAEVATEGIDIATRSSVSVAVRENFHPDFRDPG

SEQ ID NO: 32900 - protein, 360 aa, Zea mays
MAGQVQRTAPSSSSPSPRQLPVINLGRLGKDPATRALAIQDITRACREQGCFQAHAVTQADQLTYHGTLSGNSPVIKSTNSMLCKPRILVVNHGVSNSVMAGAFEAASEFFQLSPEHKELFASTDIGRPVRYDTSSRDGISRARSFLKHYANPLEDWVQYWPLHPPSYRKKMGEYAVEIQRVSMQLMDAILQGLGLKPLYMQEKLDKGVQFLALNSYPQFSHRGDKVGLAPHSDYGFLTILMQSSPGLEVMPHDRDTWTPVPAIPGALHVHVGDHLEVLSNGRLKSLVHRAILNPDEARISIASIHGLSKDEKVCCAEELVDEVNPAMYRESSFQDFLDFLPSNINNYKRFVESLKIDRA

SEQ ID NO: 32901 - protein, 558 aa, Oryza sativa (japonica cultivar-group)
MDFKVASFLLLLLIVTCGAAQGQGNDFVVLDLKTTEVGEDASPMYKEQIALTKIPVTLLRSKHSSLCSACENITSEAVNFLSEKQIQDKIMTILHDTCSQTFSFEQKCLETMDSYATLVFAKIAEIKPDEFCKQYGLCRDMALLSAMKSESTCVFCHHIIDEIMSKLKDPDAEFEIIQLLLKECNKIEGHQQQCKRMVLQYVPLVLVNGEKFLEKNDVCAMIQACDAGKRKAFNLFSARKLILSAYFAVLPLRDEGAISLGLSSLPGLFAGSLLLTLVAAPVASLAFSLPSIPKPRALVFIHRFFSLSLLVFFVLWFASTPGHSPSISQVSLLNLIAISSTWARVIDIMDSESGSRLFGFIGAGATLGQLFGSLFAATMALLGPCFWLIARSPYLMYISLFLWLSAVVSSFFYFQGRILTIAGVTVAICASPFIATLNMVALALWPTWVAVAVTETIRKVTTYVLTRPGRELLFTVVSQDEKYKAKVCIDVVVQRLGDATAAGIYSLLFSSLEKKASMVTLYALPLCFVWLLTAFHLGRLQTNLVKVQVASFASSIPR

SEQ ID NO: 32902 - protein, 81 aa, Triticum aestivum
MGCDDKCGCAVPCPGGKDCRCTSGSGAGGQREHTTCGCGEHCECSPCTCGRATMPSGRQNRRANCSCGPACNCASCASASA

SEQ ID NO: 32903 - protein, 457 aa, Bacteroides fragilis YCH46
MNRENKPLFLYTFITVFGGLIVGLNMAGISGAVPFLQEQFMLDDMALGLVVSILTVGCLCGALLGGGFSDRYGRQKVMFSSAVFFIVSSLGCALSGNLVSLLVFRLICGLGIGVISAVAPIYISEISPARLRGTLVSYNQLAIVIGILIAYIVDYILLDYERNWRLMLGFPFFFSVAYLLLLGILPESPRWLSARGKAGRARQVASKLNLEAGEMTVSDTNTQEGRDRIKVTELFKGNLAKVVFIGSILAALQQITGINVIINYAPSIFEMTGVAGDIALVQSILVGVVNLLFTLIAVWLVDKVGRKILLLCGSLGMGISLLYLVYTFVVPAANGIGALIAVLCYIGFFAASLAPLMWVVTSEIYPSRIRGTAMSLSTGISWLCTFLTVQFFPWILNNLGGSVAFGIFAVFSIAAFAFILFCVPETKGKSLEAIEKELGVDKEAEENVKEEHAFSKI

SEQ ID NO: 32904 - protein, 390 aa, Arabidopsis thaliana
MKETKPLSSLTSQLLLSLALSLSFLAMATGSTTDSARSPSSGVLQKLLLLFSVCIATSTYKAIQPPPSKLCGSPDGPSITGPRIKLRDGRQLAYKEHGVPRDEATHKIIVVHGSDSCRHDNAFAALLSPDIKEGLGVYMVSFDRPGYAESDPDPNRTPKSLALDIEELADQLSLGSKFYVIGYSMGGQATWACLKYIPHRLAGVTLVAPVVNYWWKNFPSEISTEAFNQQGRNDQWAVRVAHYAPWLTHWWNSQSWFPGSSVVARNLGMLSKADKEIMFKLGAARSQHEAQIRQQGTHETLHRDMIVGFGTWEFDPMELENLFPNNEGSVHLWQGDDDVLVPVTLQRYIAKKLPWIHYHEIPGAGHLFPFAPGMVNNIVKTLLTNDGVKK

SEQ ID NO: 32905 - protein, 95 aa, Triticum aestivum
  misc_feature (7)..(7): Xaa can be any naturally occurring amino acid
  misc_feature (11)..(11): Xaa can be any naturally occurring amino acid
  misc_feature (18)..(18): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (40)..(40): Xaa can be any naturally occurring amino acid
  misc_feature (45)..(45): Xaa can be any naturally occurring amino acid
  misc_feature (48)..(48): Xaa can be any naturally occurring amino acid
  misc_feature (50)..(50): Xaa can be any naturally occurring amino acid
  misc_feature (63)..(63): Xaa can be any naturally occurring amino acid
  misc_feature (67)..(67): Xaa can be any naturally occurring amino acid
  misc_feature (69)..(69): Xaa can be any naturally occurring amino acid
  misc_feature (83)..(85): Xaa can be any naturally occurring amino acid
  misc_feature (90)..(90): Xaa can be any naturally occurring amino acid
  misc_feature (93)..(94): Xaa can be any naturally occurring amino acid
NKENTLXSPFXGLAVHPXDGIXQAISHVXALFLLPXHFRXHIALXFRXAXWTANIHDCIHGKXWPVXGXGDHTSHHTTYRHNXXXYTVWXDWXXG

SEQ ID NO: 32906 - protein, 482 aa, Frankia sp. EAN1pec
MQDREQLFVGGTWVAPSADRFIEVISPHTEEPVGRVAAAGTADVDRAVAAARQAFDEGAWPHTDPAERVEAIRRLVTLYGKHRDELAELITTELGAPISFARRAQVALPGAMMSALTDIAADYRWRENRPGTYGQDIILRKEPVGVVAAVVPWNMPQFLTVTKVIPALLAGCTVVLKPAPESSLDALFFADLLDQTGLPPGVVNVIPADREVSAHLVAHPGIDKVSFTGSTAVGRQVAAASAPHLTKVSLELGGKSAAIALDDADPATVARAVRLSGMGMAGQICNSLTRVLAPARRIGDYAEALAATLSAIRIGDPADPGTEMGPLVARRQQERVREYIDTGVREGARLVLGGTDLPAGIERGWYVRPTVFSNVDNSMTIAREEIFGPVLAVIPYHDEADAIRIANDSDYGLAGSVFTADTEHGLDIASRVRAGTFGVNQGYSMDPAAPFGGLKASGYGRELGREGLEGYLDIKSISVAAP

SEQ ID NO: 32907 - protein, 719 aa, Candida albicans SC5314
MKLFDQFKDAILDEQKEDIALTTSYINNYPPKKLAQLGLGIINLQIVNIRTGLGGKTILELQFDSAFSDGEINTSTLRTGDIVKLAKMTSSALSNKSEKKKPSKNHKEESQTQDQSDVGIEAVVIKVSTQTISISVDESTDDSKILQYYNNTNDSARMWLVKLTNSITYKRMITTMDKVLAMKESDKNDIHKILLGESQYIPKSNGTSNNNNGEINFFNDKLNASQRQAIDFAINDSNITIIHGPPGTGKTYTLIELIQQLTSKGEKVLVCGPSNISVDTILERLGDKYEPMKLIRIGHPARLLMKNLQHSLEILSKTYGRDIINEILNDIQSVLTKIKKCKKYGERKALYSELKLLKKELRQRERKIVNELLVQAQVVVATLHGSGSYELKNSVGTNNNEGIVFDTIIIDEVSQSLEPQCWIPLLLSNRFKRLVIAGDNMQLPPTIKTQKSNSSSPSSSSSSASILATTLFDRLMKHCHGEKYKKLLDVQYRMNKSIMQFPSMQLYDNQLKCDDSVREISLVDLPGVEINDDTMTKCIWYDTQGGEFPEQISESIDGDSKYNDMELLVVKGHIKKLLSSGVQPQDIGVIAPYSAQVQNLKKQMGLGGEVGSSANGDKDGQIEISTVDGFQGREKEVIILTLVRSNDSREIGFLSEQRRLNVAMTRPKRQLCVVGDLELMNQSGNKFLQSWSKFVEDGNNDGDVIFEIEYPNLDDYIEN

SEQ ID NO: 32908 - protein, 714 aa, Saccharomyces cerevisiae
MSHLITLATCNLNQWALDFEGNRDRILQSIKIAKERGARLRVGPELEITGYGCLDHFLENDVCLHSWEMYAQIIKNKETHGLILDIGMPVLHKNVRYNCRLLSLDGEILFIRPKIWLANDGNYREMRFFTPWMKPGVVEDFILPPEIQKVTGQRLVPFGDAVINSLDTCIGTETCEELFTPQSPHIAMSLDGVEIMTNSSGSHHELRKLNKRLDLILNATKRCGGVYLYANQRGCDGDRLYYDGCALIAINGTIVAQGSQFSLDDVEVVTATVDLEEVRSYRAAVMSRGLQASLAEIKFKRIDIPVELALMTSRFDPTVCPTKVREPFYHSPEEEIALGPACWMWDYLRRCNGTGFFLPLSGGIDSCATAMIVHSMCRLVTDAAQNGNEQVIKDVRKITRSGDDWIPDSPQDLASKIFHSCFMGTENSSKETRNRAKDLSNAIGSYHVDLKMDSLVSSVVSLFEVATGKKPIYKIFGGSQIENLALQNIQARLRMVLSYLFAQLLPWVRGIPNSGGLLVLGSANVDECLRGYLTKYDCSSADINPIGGISKTDLKRFIAYASKQYNMPILNDFLNATPTAELEPMTKDYVQSDEIDMGMTYEELGVFGYLRKVEKCGPYSMFLKLLHQWSPKLTPRQISEKVKRFFFFYAINRHKQTVLTPSYHAEQYSPEDNRFDLRPFLINPRFPWASRKIDEVVEQCEAHKGSTLDIMSID

SEQ ID NO: 32909 - protein, 612 aa, Streptomyces coelicolor A3(2)
MTIKDARTPASTQNTAQADTAENTDTAEDTEAGKSIGWHKAYVEGSRPDLRVPVRQVHLTNGQSVTLYDTSGPYTDPLVDTDVRRGLAPLRENWIIARGDTEEYAGRPVRPEDDGIKHTSPRGGLRNLDAVFPGRPRQPRRGRDGNAVTQLAYARRGEITPEMEYVAVRENVSPEVVREEIAAGRAVLPANINHPEIEPMIIGKRFLVKVNANIGNSAVTSSIEEEVDKMTWATRWGADTVMDLSTGRNIHTTREWVLRNSPVPIGTVPLYQALEKVDGRAEELTWEIYKDTVIEQAEQGVDYMTVHAGVRLPYVPLTANRKTGIVSRGGSIMAAWCLAHHKESFLYENFEELCEILAAYDVTYSLGDGLRPGSIADANDEAQFAELRTLGELNRIAKRCSVQTMIEGPGHVPMHKIKENIDLQQEICDEAPFYTLGPLTTDVAPAYDHITSGIGAAMIAWWGTAMLCYVTPKEHLGLPNRDDVKTGVITYKIAAHAADLAKGHPGAQEWDDALSDARFEFRWEDQFNLALDPDTAREFHDETLPAEPAKTAHFCSMCGPKFCSMKISQSITEQFGGTAAAGATAEEVAAGMLQKSKEFAESGNRVYLPLAD

SEQ ID NO: 32910 - protein, 719 aa, Pseudomonas fluorescens Pf-5
MSRSKQPAATPESEPSRIREGLPFPLGATWDGLGVNFALFSANATKVELCVFDDAGEVELERIELPEYTDEIFHGYLPDAHPGLIYGYRVHGPYDPANGHRFNPNKLLIDPYAKQLVGELKWSEALFGYTIGHPDADLSFDERDSAPFVPKCKVIDPAHTWGNDQRVSVPWDKTIIYETHVRGFTMRHPSVPENLRGSFAGLMVDDVLEHIRKLGVSSVELLPIHAFVNDQHLLHKGMTNYWGYNSIAFFAPDPRYLASGKIAEFKEMVAHLHEAGLEVILDVVYNHTAEGNEQGPTLSMRGIDNASYYRLMPDDKRFYINDSGTGNTLDLSHPCVLQMVTDSLRYWATEMHVDGFRFDLATILGRYHDGFDERHSFLVACRQDPVLRQVKMIAEPWDCGPGGYQVGNFPPGWVEWNDRFRDTVRAFWKGDDGQLADFAGRMTASGEMFNQRGRRPYASVNFVTAHDGFTLHDLVSYNDKHNEANDENNQDGSNNNLSWNHGVEGPSDDPEINALRLRQMRNFFATLLLAQGTPMVVAGDEFARTQHGNNNAYCQDSEIGWVNWELDNDGKSLLKFVKRLIKLRLSYPILRRGRFLVGSYNEDIGVKDVTWLAPDGSEMTTEHWQDPHGRCLGMLLDGRAQETGIRRPGADATLLLVVNAHHDIVNFRLPEVPAGEFWTCMLDTNQPAVRGQERFAFGHEYSVTGRSLLLFELQHEEED

SEQ ID NO: 32911 - protein, 99 aa, Oryza sativa (japonica cultivar-group)
MESTSKVDDEQWLVYWILYSLITLMEMALHKVLYWIPLWYEAKVLFVAWLVLPQFRGASFIYDKFVREQLKKNRVKLHEHHGHGHGHADEHQSHVVRGI

SEQ ID NO: 32912 - protein, 247 aa, Triticum aestivum
  misc_feature (235)..(235): Xaa can be any naturally occurring amino acid
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLXPAFVDIINATKQ

SEQ ID NO: 32913 - protein, 504 aa, Synechococcus sp. CC9311
MAAEHFFLELEPPEERLRDAPHVVIVGGGFAGVRACKALAQADVRITLIDKRNFNLFQPLLYQVATGLVAPGDVATPLRQLVGKQRNVQVLLGEVTGLDAKKQQINFSEKILTYDHLVLATGSGSTYFGHEEWRTFAPPMKILEHAQEIRRRLLMAMEQAEQTPDPAARKFLQTVVIVGGGPTGCEMAGATSELMRNAMRREFKQLDPDDSRIIVIDPGDRLLRAMPESLSASAQKTLESLGVETLFKGRVQSMKPGEVSVGTPDGEQTIQAATVIWTAGVRPSHLGKTLAGSIDCELDRGGRVIVEPDFSVKDHPEIRVVGDLCSYKHTSTGNPLPGMAGPATQAGGFVGKDIAAIMSGGNRPNFKWFDFGSMAVLDRVAAVADLRGFKFSGSPGWAVWAAAHLAFMPDRENRWSLLIKWMFAVLSQQRSSMLLTGMPSQHIGLDSADAPFPMNSGSGPSIAAPDAALKAAMNYYANSVSGVSAQDGAEARDDSATGSDAAIK

SEQ ID NO: 32914 - protein, 251 aa, Coprinopsis cinerea
MTRSFFVGGNWKLNPTSLSAAKAPVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 32915 - protein, 109 aa, Bradyrhizobium sp. BTAi1
MSTSERIQKLIDSNDIVLFMKGVPAAPQCGFSAAVAQILAKLDVSYESVNVLADPFIREGIKEFSNWPTIPQLYVKGEFVGGCDIVREMFQAGELATLLADKGIKAPAS

SEQ ID NO: 32916 - protein, 220 aa, Chloroflexus aurantiacus
MYKTVGEATTLVRDLLAGLGELSDREAIVCPPFTALAAVALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGAL

SEQ ID NO: 32917 - protein, 461 aa, Corynebacterium efficiens YS-314
MTETKHYDLIIIGTGSGNSIPGPEFEDKSIAIVEKGTFGGTCLNVGCIPTKMFVYTADIAREISDSSKYGIDATYNSVDWPSIVDRVFTRRIDLIAEGGEAYRRGPETPNIDVYDMHARFIGEKTIATGQAGEEKVISGDQIVIATGSRPFIPPVIKESGARYHTNEDIMRLPTLPSSLVIVGGGFIALEFAHVFSSLGTKVTLINRSEVLLRDADADISARIAKITRERVDVRMSTSVTGVTDNADGSVTVSLDSEDPITADVLLVATGRTPNGDQMDLDTAGIEMDGRRIKVDEYGRTTAPGVWALGDVSSPFKLKHVANAEMRAVRHNLLHPDALQTMPHDHVPSAVFTNPQIAQVGMTEAEARAAGHNLTIKVQNYGDVAYGWAMEDTTGFVKLIADRDSGRLLGAHLIGPQASTLIQQLITVMAFDLDVREVATRQYWIHPALPEVIENALLGLEF

SEQ ID NO: 32918 - protein, 411 aa, Oryza sativa (indica cultivar-group)
MASVGVVRSSLGFQNETSTSGDADRLPNEMSNMSIRDDNKDIDDIVVNGNGTEPGHIIVTSIDGRNGQAKQTISYMAERVVGHGSFGTVFQAKCLETGETVAIKKVLQDKRYKNRELQTMRVLDHPNVVSLKHCFFSKTEKEELYLNLVLEYVPETAHRVIKHYNKMNQRMPLIYAKLYMYQICRALAYIHNTIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFYKRMPAEAVDLVSRLLQYSPYLRSTASEALIHPFFDELRDPNTRLPNGRFLPPLFNFKPHELKGMPMEFLVKLIPEHARKQCAFVGW

SEQ ID NO: 32919 - protein, 465 aa, Salinibacter ruber DSM 13855
MAIPIEMPKLSDTMEEGVLSAWLVDEGEEVSAGDVLAQVETDKATMDLEAFDEGVLLKQVIGEGDAVPIGELIAVIGEAGEDISDLVDDAGGDGAAEPEADPDAEVDSDADAEDASAEPEVEPEPAPEPSGDGQLSERMPEPVPAGTDAEGRRIKASPLARRIAQEHDVELAQVDGSGPEGRIVRRDVETHVEKQEAAPESTPEPEPTTEPEPAPQPEPSVPEAPSYAMPDEEAAYESEGITQMRETIARRLAESKYSAPHYYLTVDIDVERAIEVREDLNDLAEEQGRAKISFNDFITKACALSLHDHPYVNAAYRPDEGEIHKHNRVHIGIAVAIDEGLITPVIRDADRKGLSELARETRALAERARDRDLEPEEFEGATFTTSNLGMFGIEEFTAIINPPNSAILAIGEIRDTPVVEDGEVVPGKRMKVTLSCDHRVVDGAKGAHFLDTVKSYLEEPMNLLL

SEQ ID NO: 32920 - protein, 1053 aa, Schizosaccharomyces pombe 972h-
MIYKLAARYPIQVIAIVGILVSMAYFSFLEALTQEDFPVLIRALKRFGILDGFPNTRLPNEMILKLSSVQGEDASVWEQIPAAELGGEGFVDFDITQWYYPANAKVDVAQLVEPYRNDCIFHDASGACHFFFKEVGNWTVSSIALPSNLANPPIDYFLDSSSTVIQRILPAIREHGISWSWLLQLIARTWMNTLKIASQASKTELLIVGTAYACMLISIVSLYLKMRRLGSKFWLFFSVLLSTLFSVQFAMTLVRASGVRISLVSLIESLPFLINVVALDKAAELTRQVITRCSVSDSHSPMHEDIAKACRNAAPPILRHFSFGIVVLAIFSYCNFGIKQFFLFAAVMIYDLLLLFSFFVAILTLKLEMRRYNAKDDVRKVLIEEGLSESTARHVADGNDSSATTSAGSRYFKVRYGTKIILFIFIAFNLFELCSIPFKHYAATSAAAARLIPLVRSQYPDFKSQRLLDDGVFDDVLSAISSMSNIESPSVRLLPAVFYGAELSSTSFLSTIHSFINNWSHYISASFLSKWIVCALSLSIAVNVFLLNAARLNSIKEEPEKKVVEKVVEVVKYIPSSNSSSIDDIQKDEIAQESVVRSLEECITLYNNGQISTLNDEEVVQLTLAKKIPLYALERVLKDVTRAVVIRRTVVSRSSRTKTLESSNCPVYHYDYSRVLNACCENVIGYMPLPLGVAGPLIIDGKPFYIPMATTEGALVASTMRGCKAINAGGGAVTVLTRDQMSRGPCVAFPNLTRAGRAKIWLDSPEGQEVMKKAFNSTSRFARLQHIKTALAGTRLFIRFCTSTGDAMGMNMISKGVEHALVVMSNDAGFDDMQVISVSGNYCTDKKPAAINWIDGRGKSVIAEAIIPGDAVKSVLKTTVEDLVKLNVDKNLIGSAMAGSVGGFNAHAANIVTAVYLATGQDPAQNVESSNCITLMDNVDGNLQLSVSMPSIEVGTIGGGTVLEPQGAMLDLLGVRGAHMTSPGDNSRQLARVVAAAVMAGELSLCSALASGHLVKSHIGLNRSALNTPAMDSSAKKPATDALKSVNSRVPGR

SEQ ID NO: 32921 - protein, 437 aa, Robiginitalea biformata HTCC2501
MDSKIFKISLIAALAGFLFGFDTVVISGAEKKLQLLWETSDAYHGTVVIGMALFGTVIGAIFGGFPTNRFGRKRTLIWIGVLYSVSAIGSALSNDPVTFGIFRFLGGIGIGASTVAAPTYISEIAPADQRGRLVGMYQFNIVFGILVAYFSNYLLNGIGDNDWRWMVGVEAFPALIYTAFAFGIPKSPRWLVTQHREEEAAGILEKLGLKLSVGDIVRDLEANVQAGAETIFMKKYRFPLLLAFLIAFFNQFSGINAFLYYAPRIFELAGLEESTALLSSIGIGVTNLVFTLLGIYLIDRLGRRTLMYYGSFGYIVSLALVAAAFFFNWTGMAVPIFLFVFIASHAIGQGAVIWVFISEVFPNHLRGSGQSFGCSVHWVLAWLIPSSVPFLMSWIGPAPVFGFFAFMMVLQLLFVHFMMPETKGISLEELSKRLLRK

SEQ ID NO: 32922 - protein, 542 aa, Oryza sativa (japonica cultivar-group)
MGNQCQNGTLGSDYHNRFPREHAVGYVQGDSYLDLKKFDDTWPEVNNFKPTAASILRRGLDPTSINVLGRKTADLREHYIIGRKLGQAQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 32923 - protein, 444 aa, Arabidopsis thaliana
MATITVVKARQIFDSRGNPTVEVDIHTSNGIKVTAAVPSGASTGIYEALELRDGGSDYLGKGVSKAVGNVNNVIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETKDTFIADLAVGLSTGQIKTGAPCRSERLAKYNQLLRIEEELGSEAIYAGVNFRKPVEPY

SEQ ID NO: 32924 - protein, 337 aa, Sulfolobus tokodaii str. 7
MGFTVALIQGDGIGPEIVSKSKRILAKINELYSLPIEYIEVEAGDRALARYGEALPKDSLKIIDKADIILKGPVGESAADVVVKLRQIYDMYANIRPAKSIPGIDTKYGNVDILIVRENTEDLYKGFEHIVSDGVAVGMKIITRFASERIAKVGLNFALRRRKKVTCVHKANVMRITDGLFAEACRSVLKGKVEYSEMYVDAAAANLVRNPQMFDVIVTENVYGDILSDEASQIAGSLGIAPSANIGDKKALFEPVHGAAFDIAGKNIGNPTAFLLSVSMMYERMYELSNDDRYIKASRALENAIYLVYKERKALTPDVGGNATTDDLINEIYNKLG

SEQ ID NO: 32925 - protein, 356 aa, Mycobacterium tuberculosis
MAQREWVEKDFYQELGVSSDASPEEIKRAYRKLARDLHPDANPGNPAAGERFKAVSEAHNVLSDPAKRKEYDETRRLFAGGGFGGRRFDSGFGGGFGGFGVGGDGAEFNLNDLFDAASRTGGTTIGDLFGGLFGRGGSARPSRPRRGNDLETETELDFVEAAKGVAMPLRLTSPAPCTNCHGSGARPGTSPKVCPTCNGSGVINRNQGAFGFSEPCTDCRGSGSIIEHPCEECKGTGVTTRTRTINVRIPPGVEDGQRIRLAGQGEAGLRGAPSGDLYVTVHVRPDKIFGRDGDDLTVTVPVSFTELALGSTLSVPTLDGTVGVRVPKGTADGRILRVRGRVCPSAVGVAATYLSP

SEQ ID NO: 32926 - protein, 351 aa, Arabidopsis thaliana
MSPEMEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 32927 - protein, 416 aa, Oryza sativa (indica cultivar-group)
MVAEAEVMHQPVPVLEVPYHRCVAKGVEEVAAAAAVAPPPVVEVEVAVQVPHMVYYGVYCLSVYYTRLFSVRGCKRLTQFGLESAAGAPSISVDALQFVPSIRSGSFADIGPRRYMEDEHIRIDDLSAHLGSLLVCPLPSAFYGVFDGHGGLDAAAYMKRHAMRFLFEDSEFPQASQVDETYVQSVENSVRRAFLQADLALADDLDISRSSGTTALTALVFGRQLLVANAGDCRAVLCRRGVAMEMSRDHRANYAEECERVAASGGYIEDGYLNGVLSVTRALGDWDMKMPDGSISPLIAEPEFRQTMLTEDDEFLIMGCDGIWDVMTSQHAVSIVRRGLRQHDDPERCARELVMEAKRLETADNLTVIVVCFVSELGSPRREQVGGQAGVARPRSCKSLSAEALCNLRSWLETDR

SEQ ID NO: 32928 - protein, 260 aa, Brassica oleracea
QLMTWKTAVANIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFATEALLNEHGKSISGQRFVIQGFGNVGSWAAKLISEQGGKIVAVSDITGAIKNKDGIDIESLLNYTKEHRGVKGFDGAHPIDANSILVEDCDILIPAALGGVINRENANEIKAKFIIEAANHPTDPDADEILSKKGVVILPDIYANSGGVTVS

SEQ ID NO: 32929 - protein, 568 aa, Glycine max
MASSALISDTQPWKDLKAHVDDVKKAHLRDLLSDDKRCQSMLVEFDDILLDYARQQATPETIQKLFELAEAASLKEKINRMYSGEHINSTENRSVLHVALRASRDAVIESDGKNVVPEVWKVLDKIQDFSERVRNGSWVGATGKALKDAVAVGIGGSFLGPLFVHTALQTDPEAVESARGRQLRFLANVDPIDVARNITGLNPETTLVVVVSKTFTTAETMLNARTLREWISSALGPSAVAKHMVAVSTNLTLVEKFGIDPKNAFAFWDWVGGRYSVCSAVGILPLSLQYGFSVIEKFLRGASSIDQHFYSQPFESNIPVLLGLLSIWNVTFLGYPARAILPYSQALEKFAPHIQQVSMESNGKGVSIDGVPLPFEAGEIDFGEPGTNGQHSFYQLIHQGRVIPCDFIGVVKSQQPVFLKGEVVSNHDELMSNYFAQSDALAYGKTAEQLQKENVSPHLIPHKTFSGNRPSLSLLLPSLNAYNIGQLLAIYEHRIAVEGFIWGINSFDQWGVELGKSLATQVRKQLNASRTKGEPVQGFNFSTTTMLTRYLQASSDVPADLPTVLPKI

SEQ ID NO: 32930 - protein, 249 aa, Xanthobacter flavus
MTAERRPLIAGNWKMNGLRAAKSELRTVAAGLAGLSAETMICPPFTLIGAFAADVAGTQLMIGGQDCHPAESGAHTGDISAEMLRDAGAVAVILGHSERRIDHQEGDAIVKAKVKAAWRAGLLPVVCVGETLVERDAGEAAAVVTRQVRQSVPEGATAVSLVIAYEPIWAIGTGRTPTTDDVAEVHGAIRHILAERFGAEANGIRILYGGSVKPDNAAALLATANVDGALVGGASLKAADFLAIARAVG

SEQ ID NO: 32931 - protein, 369 aa, Bacillus licheniformis ATCC 14580
MKVTTVDSRQFEIGDDPMKVFNIASIPGDGVGKEVVPAAQRVLKAVSDVHGGLSFRFTEFPYSCEYYLEHGEMMPDDGLEQLKEFDSIFLGAVGNSKLVPDHISLWGLLIKIRREFEQVINIRPAKYLQGIKSPLANPKDFDLLVVRENSEGEYSSIGGRIFRDEDEIAIQNAVFSRKGAERAMRFAFELAAKRKKHVTSATKSNGIVYSMPFWDEVFENTAKDYPDITADSQHIDALSAFFVTRPEKLDVIVASNLFGDILTDIGAAIMGSIGVAPAANINVNGKYPSMFEPVHGSAPDIIGKGIANPIGQIWTAKMMLDHFGEEELGARLLDVIEDVLKSGYLTPDIGGSSTTDDVTEEIIKRVRTI

SEQ ID NO: 32932 - protein, 272 aa, Zea mays
MAMSDLTATVIPKPDGADDESVEIREVWADNLEEEFALIRDIVDEYPFVAMDTEFPGIVCRPVGAFRSPADYNYATLKANVDMLHLIQLGLTFSGPRGELPALGAGRRRCVWQFNFREFDDARDIFASDSIELLRRSGIDFRRNAERGVDARRFAELLMSSGVVLNDSVYWVTFHAGYDFGPGFLNSMKIYFPTVYDIKHLMKFCNSLHGGLNKLAELLDVERVGESHQAGSDSLVTSCAFWKLKDSFFAGSTEKYAGVLYGLNAENGVSAH

SEQ ID NO: 32933 - protein, 369 aa, Corynebacterium efficiens YS-314
MATPLPLVFSAPKRGMPPAHFADLSDEQRIEALSELGLPKFRLNQIARHYYGRLEADPMTMTDLPEAARAKVKDALFPTLMEPIRVVEADDENTQKTLWKLHDGTLLESVLMRYPDRATLCISSQAGCGMACPFCATGQGGLDRNLSVGEIVDQVRNAAATMQAEGGRLSNIVFMGMGEPLANYKRVVSAVRQITQPSPEGFGISQRSVTVSTVGLAPAIRKLADEDMSVTLAVSLHTPDDELRDELVPVNNRWSVAEVLDAARYYADKSGRRVSIEYALIRDVNDQGWRADMLGQKLHKALGSRVHVNLIPLNPTPGSKWDASPRERQDEFVRRVIAQGVPCTVRDTKGQEIAAACGQLAAEENSEEK

SEQ ID NO: 32934 - protein, 1210 aa, Gibberella zeae PH-1
MASILLPKRFRGETAPAEKTTPSWASKRLTPIAQFISRLACSHPIHTVVLVAVLASTSYVGLLQESFFSTDLPTVGKADWSSLVEGSRVLRAGPETAWNWKAIEQDSIQHAGADADHLALLTLVFPDTHSAESSSTAPRSSHVPVPQNLSITPLPSTKNSFTAYSQDSILAYSLPYAEGPDVVQWANNAWTEFLDLLKNAETLDIVIMFLGYIAMHLTFVSLFLSMRKLGSKFWLGICTLFSSVFAFLFGLIVTTKLGVPISVILLSEGLPFLVVTIGFEKNIVLTRAVMSHAIEHRRQIQNSKSGKGSPERSMQNVIQYAVQSAIKEKGFEIMRDYAIEIVILALGAASGVQGGLQHFCFLAAWTLFFDFILLFTFYTAILSIKLEINRIKRHVDMRMALEDDGVSRRVAENVAKSDGDWTRVKGDSSLFGRKSSSVPTFKVLMILGFIFVNIVNICSIPFRNPRSLSTIRTWASSLGGVVAPLSVDPFKVASNGLDAILAAAKSNNRPTLVTVLTPIKYELEYPSIHYALGSAINGNNAEYTDAFHHHFQGYGVGGRMVGGILKSLEDPVLSKWIVIALALSVALNGYLFNVARWGIKDPNVPEHNIDRNELARAQQFNDTGSATLPLGEYVPPTPMRTEPSTPAITDDEAEGLQMTKARSDKLPNRPNEELEKLLAEKRVKEMSDEELVSLSMRGKIPGYALEKTLGDFTRAVKIRRSIIARNRATSDLTHSLERSKLPFEKYNWERVFGACCENVIGYMPLPVGVAGPLVIDGQSYFIPMATTEGVLVASASRGCKAINAGGGAVTVLTADGMTRGPCVAFETLERAGAAKLWLDSEAGSDIMKKAFNSTSRFARLQSMKTALAGTNLYIRFKTTTGDAMGMNMISKGVEHALSVMSNEAGFDDMQIVSVSGNYCTDKKAAALNWIDGRGKGVVAEAIIPGDVVRSVLKSDVDALVELNISKNLIGSAMAGSVGGFNAHAANIVAAIFLATGQDPAQVVESANCITIMKNLRGALQISVSMPSLEVGTLGGGTILEPQSAMLDLLGVRGSHPTNPGDNSRRLARIIGASVLAGELSLCSALAAGHLVRAHMQHNRSAAPSRSTTPAPMTPVRSFDTKVRCQPNNKDIRNILLTQHPSKPTITYSKRVIKSTIHLNPLILALFDNSVQTRDVQLGDQVSTRGTLDAVGGPQGGGVAAGGVARRVVGS

SEQ ID NO: 32935 - protein, 445 aa, Zea mays
MFGTPSITPAFGNPSSTPVFGTPSATPAFGATSSTPAFGTLSSTPAFGTPSSTPAFGTPSSTPAFGTASTTPAFGASSSTPAFGTTSTTPPFGSLNFGTPSSTSAFGTPSSAPAFGALNFGTPSSTSAFGTPSSAPAFGATPSPSPFGFQQQATPCPSPFGLLGGGGAQITTQMAPVAPLPLSPSDRDIQAIVDAYKEDPGNPRYAFRHLLFSVTEPSQRVKPVAASDIMWAEAMGKLECMDSADRERLWPQLVQGFKDLSHRLKLQDEVLVSDTDRLSMTHSNVKKLQRHFQADTYPWIQRLKQQELAIQRRLLRFVRIVEALENRGYRCPLTKEEADLYERLVAILKRLKGHNADLSKRVNTLVSTSRLLASSGGAGGSVYIPSSAKVDERSVTKLLEALQQQTEAVAKLGNVLKRDIRDMEIIQSEGTDMAEDNVGRRAQKI

SEQ ID NO: 32936 - protein, 266 aa, Triticum aestivum
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 32937 - protein, 589 aa, Legionella pneumophila subsp. pneumophila str. Philadelphia 1
MNQEISNFSTFNFSNALNKALEDMKFITPSPIQAQTIPLILQGRDAIALAQTGTGKTAAFALPILQNLSPEISTTQALILAPTRELAIQVAEQFELLSKYQRNVTIAVLCGGQEYGRQLKQLRSGAQVVVGTPGRILDHIDKGTLLLNNLKTFILDEADEMLRMGFIEDVETILEKLPEKKQMALFSATMPYRIRQIANTYLNDPASIEIRMETATVKSIEQRFLFASVHQKPDALIRVLEVEDYQGVIVFVRTKSSTEEVAELLQQHGLRAMAIHGDITQSLRERIIAQFKQGAIDILVATDVAARGLDVERVTHVINYDMPHDNETYVHRIGRTGRAGRSGVTILFVTPKESRLISSIERHTRQRIEKVQVPNDHMIQMARQQRFMSNITTRLNHEHVYSYKRIVEEYIKEHDVSAVDVAAALALLLHKDMPWRKELNMPKAASAFKEERARAGEKGLDLRGRFKEDRKSSFADRKGARGSKKDFAKDFSNERKKFNDGRKAVNQESVAQDLFRIDVGKIHGVKPGNIVGAIANEAGLQSRYITGLKIHEDHSTVRLPKGMPKEVMKDLTKAWVCGRQLNLTLIGSA

SEQ ID NO: 32938 - protein, 380 aa, Schizosaccharomyces pombe 972h-
MQQSPTAGKIINCKAAVAWQPAAPLSIENVQVFPPRVHEVRIKIVNSGVCHTDAYTLSGKDPEGLFPVILGHEGAGIVESVGPQVTTVQVGDPVIALYTPECKTCKFCKSGKTNLCGRIRTTQGKGLMPDGTSRFSCNGNTLLHFMGCSTFSEYTVVADISVVAIERLAPLDSVCLLGCGITTGYGAATITADIKEGDSVAVFGLGSVGLAVIQGAVKKRAGRIFGIDVNPEKKNWAMSFGATDFINPNDLQSPIQDVLIHETDGGLDWTFDCTGNVHVMRSALEACHKGWGQSIVIGVAAAGQEISTRPFQLVTGRVWRGCAFGGVKGRSQLPDLVKEYLDHKLEIDKYITHRRPLKEINEAFTDMHNGNCIKTVLSIP

SEQ ID NO: 32939 - protein, 1481 aa, Aspergillus oryzae
MDVHHGHLSRDTASDLSSVSASSSNISSNSCPDQNAELNETEKSSRPGSLNRRLTEDEIVRVLSRRRTGGSGENTEGKSEDMTQIMKLVSRMFGHERKSNSDEEKTRHLGVVWKHLTVKGVGLGAAIQPTNSEILLALPRKIKSLLTRGRNKPPLRTIIDDFTGCVRPGEMLLVLGRPGSGCSTFLKVVGNQRSGYKSVEGDVRYGGADAQTMADKYRSEVLYNPEDDLHYPTLTVRDTLLFALKTRTPNKESRLPGESRKEYQETFLSAIAKLFWIEHALDTKVGNELIRGISGGEKKRVSIAEALVTRASTQSWDNSTKGLDASTALEYVQSLRSLTDMANVSTLVALYQASENLYKLFDKVIFIEEGKCVYYGRAESARHYFESLGFECAPRWTTPDFLLSVTDPQARRVRQGWEDRIPRTAEEFRKIYRKSDIYKAALADNESFEEELESHQEEREAARKQSEKKNYTVSFYQQVAILTHRQFLIMYGDKTTLIGKWVILTGQALITGSLFYDLPQTSAGVFTRGGVMFYVLLFNALLAMAELTSFFDTRPVILKHKSFSFYRPSAFALAQVIVDIPIIFVQVTLFELIVYFMANLSRTASQFFINFLFIFTLTMTMYSFFRTIGALCGSLDIATRITGVAIQALVVYTGYLIPPWKMHPWLKWLIWINPVQYAFEGIMSNEFYNLDIQCEPPSIVPDGPNASPGHQTCAIQGSSANQLIVRGSNYIKSAFTYSRSHLWRNFGIIIAWLALFIALTMLGMELQKPNKGGSAATIFKRGEEPETVRRALENKKLPEDVESGNKEKGVDGNMNESASEDSGEKVTGIAQSTSIFTWRNVNYTIPYKGREKKLLQDVQGYVKPGRLTALVGASGAGKTTLLNTLAQRINFGVVTGEFLVDGRPLPRSFQRATGFAEQMDIHEPTATVRESLRFSALLRQPKEVPIHEKYDYCEKILDLLEMRSIAGATVGSGGIGLSEEQRKRLTIAVELASKPQLLLFLDEPTSGLDSLAAFNIVRFLRRLADAGQAILCTIHQPSAVLFEHFDDLVLLQSGGKVVYNGELGQDSSKLISYFERNGGKKCPPHANPAEYMLEVIGAGNPDYEGQDWSEVWAKSSENKQLTEEIDSIIQSRRNKNEGDNDDDRREYAMPIGVQVVAVTKRAFVAYWRSPEYNLGKFLLHIFTGLFNTFTFWHLGNSYIDMQSRLFSIFMTLTIAPPLIQQLQPRFLHFRNLYESREANSKIYSWVAFVTSAILPELPYSIVAGSIYFNCWYWGVWFPRDSFSSGYVWMLLMLFEMFYVGFGQFIAALAPNELFASLLVPCFFIFVVSFCGVVVPYKALIHFWRSWMYWLTPFHYLLEGLLGVVTHNVPLRCVSREESQFSPPPGETCQSYAGPFAQQAGGYVHDTGNGLCSYCQYSDGDTFAAESFNVYYSHKWRAYGIFWAFVMFNFAAVYAFSWLYLHGIRDIKKWFSTRKTKRGAQA

SEQ ID NO: 32940 - protein, 205 aa, Saccharomyces cerevisiae
MSFRGGNRGGRGGFRGGFRGGRTGSARSFQQGPPDTVLEMGAFLHPCEGDIVCRSINTKIPYFNAPIYLENKTQVGKVDEILGPLNEVFFTIKCGDGVQATSFKEGDKFYIAADKLLPIERFLPKPKVVGPPKPKNKKKRSGAPGGRGGASMGRGGSRGGFRGGRGGSSFRGGRGGSSFRGGSRGGSFRGGSRGGSRGGFRGGRR

SEQ ID NO: 32941 - protein, 168 aa, Oryza sativa
AAATAFRGRTRPEISVRRYAERIYRYAGCSPACFVVARVYLDRLAGRSPEEESSPSPSPPATAAAAVCVDSYSVHRLLITSVMVAAKFMDDIHYNNAYFARVGGVEVAEMNGLELELLFALRFRLNVTPATFATYCAALEGEMAADDGPLPSPSPSPEEEGNDRRQPP

SEQ ID NO: 32942 - protein, 315 aa, Zea mays
MAKKRKRTDAPAEAAGAEKPDDSAPARPERTLFGFKDLVPDAEPASAGAEAAVAPFRNREKDVLSLLPHAKKDSKVESKQSKGNALNELLELRSCSSCLFFECRKQKDLYLWMVKSPGGPSVKFLVNAVHTMEELKLTGNHLKGSRPLLTFSTNFDEQPHWKLVKEMITQDFANIQQGQTPLRYFSTGCLNDRWTRTHLSLGHHVITHQMTKWSMQLPLSEFEPGCFTVTENLNLGWALAAGGWWREEGAEERRGGALAVGGWWREDVGGDAGGDGVGVAVLVCFRGSGGDAGGDEGGGQLRIHALERRAAGART

SEQ ID NO: 32943 - protein, 335 aa, Yersinia pseudotuberculosis IP 32953
MPTDDSNNGIIDYVSTGHLPDPETVVKLVQEAHKRFSTDTAGVVSNVYPALERIPADLFGICMVGTNGKIHSAGDVDYEFTIMSVSKPFVFALVCQAIGAKTAREKLGVNSTGMAFNSVTAIERASDGRTNPMVNSGAIATTSLVPGATSDEQWKFIYDGLCRFAGRELTLNEEVYQSACETNFRNRGIANVLQGYGRLGCDPIIATDLYTRQCSLNVSARDLAVMGATLADGGVNPLTRERVVDNDICHYALAVMVTAGLYETSGDWLYDIGLPGKSGIGGGIVTVSPGKGGLGTFAPLLDSAGNSIKGQLAARFLSRSLGMDMFVSEPYTEKN

SEQ ID NO: 32944 - protein, 548 aa, Prosthecochloris aestuarii DSM 271
MSLQQSPAWRALASHKQTLDCVLMRDLFADDPERFSRFSIRSGDLLLDYSKNRVTSETMALLADLAREAGVEACRDEMFAGSKINFTEKRAVLHTALRQPWGFQLLLEGGQEVGKDIAAVLGQMKGFTEQILSGKWKGYSGKAITDVVNIGIGGSDLGPYMVTEALRPFAHGAVKVHFVSNIDGTHISETLKRVDEETTLFIIASKTFTTQETLTNAHTARSWFLERAVDESFIARHFAAVSTNKEAVQAFGIDTGNMFGFWDWVGGRYSLWSSIGLSIALYLGFDRFLELLAGAHSMDEHFRSAPLDANIPVVLALLGIWYNNFFDFPSHAVIPYDQYLHRLPAYLQQLDMESNGKRVDRDGNVVDYATGPVIWGEPGTNSQHAFFQLMHQGTSCVPADFILPLKTQNPAGEHHDILAANCFAQTEALMKGKTAAEARAELGSAGMSEEEIDALVPHKVFPGNRPTNTLIFNEINPFNLGALIAMYEHKVFVQGVIWRINSFDQWGVELGKQLAKAILPELGSADDVATHDASTNALINLYRRSRNG

SEQ ID NO: 32945 - protein, 560 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWFHQTREVLTTTLMI

SEQ ID NO: 32946 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 32947 - protein, 680 aa, Prosthecochloris aestuarii DSM 271
MPENALKPPTIFLSYPSKEESFVARICYYLERQARVKCYFNPEQKIAGDFEQRIQQAAQESDYFVLFLSGNTTSSKWQKTELQHWRKAHPDMLTRIIVVNLHTMMLDDKPNELPPNLERIIISEPEKQGVYCSEQILKLFALPAAPFDGLPVTIQVLYEKEIINAYMRNNGQLPDTLISKGYPPTWPKVRKIQSSTTSNPLNEKKFGTYRAPDSSISVDARHQTGNNAHCTDTCQLDLTFPEAGPRQTIIIPSNPFNVAILVSGGIAPGINSIISAIAERHETYQNEYRNTYHIQHHTVNLNSCMEGFNALFEIGGQIFELDKQLINHEANNGGSVIPTARADDLLPHDPDKRYTKLRRIVHTLEQRDISILYIIGGEGSMRAAHAIWTIFHKRYPNKRLSVIGIPKTMDNDILWVWQSIGFPSAVEKARQIIIQLAIEATSNPRVCIMQLFGSSSGYVVSHAALASNMCDLALIPELEFSMHDVCEYMGAKLQERRNKPNTSPYGLIVMAETAIPSDFMDYIDNKNVGLTEDEITALHHFNVNNRKVIGQTPDHLRNAGLKIVSKILETYINQRLSIEYNDNYWKKYRVFTNAPRHIVRSVEPSTNDVAYGIRLGTMAVDMAMAGYTDCIVSQWLTEYVAVPLELVTLGRKEVPLDGIFWKTVIAKTGQIEFESLSGIK

SEQ ID NO: 32948 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 32949 - protein, 309 aa, Glycine max
MAKQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYTPSVQNTLYLMAKATLNRFPDIAYVSLKLPNLHFIPVNISNQDGPIVKFEDDVYLPTDEPHGSIQASLSRLWSKL

SEQ ID NO: 32950 - protein, 397 aa, Salinibacter ruber DSM 13855
MDRAASPSLAARADDLQQSDIRSVTRRVEEVDGINLGQGVCDLPTPEPIKARAHQAIRDDASIYSHYAGIEPLRRAILEKEQAHNEVPATSPEDVVVGVGSTGVFVSAAFTLLEDGDEVVLFEPFYGYHRNILELTGATIRYVPLGGPDATFDRSAMEAVLTDDTKAVVVNTPANPSGKVWTREELSTLAGLLHAHDLVAITDEIYEYMLYDGAEHVSLASLPGAYERTITLSGFSKAYNVTGWRLGYGVAPAPIAEKIGLMNDLLYICAPRPLQHAALAAFEDLDDDYVAQLQADYAERRELLCETLEAIGFDVPWPDGAYYVLAHFGDLAGTQAGFADDAAACDTLIEDAHIGSVTGRSFYHDPADGQHELRLCFAKELPVLRRACEQLRAAFGG

SEQ ID NO: 32951 - protein, 489 aa, Oryza sativa (indica cultivar-group)
MVKEGREALLGGYEMGRTLGEGNFGKVKYARHLATGGHFAVKILDRGRVVSLRAGDQIRREIATLKLLRHPHVVRLHEVAASKTKIYMVLEFVNGGELFQRIVSPCFNDLLRYFLAAKIFMPATMAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKIFKGDTQIPKWLSHSAQNLLRRILEPNPMKRIDMAGIKSHEWFQKDYIPILPYDDDDEDVQFGARLPAKEQINDEPGDKNSHQINAFQLIGMASSLDLSGFFEDEEVSQRRIRFTSTHPPKDAFDKIESSATELGFQVQRGHSKLKLMRNCKGSKNPESFMVSAEVFELGPSVNVVELRKSNGDPALYRQLCERISSDMGARNTEQIFATASLEDDLQNSNAGTPAVRFVTNAVFCKTAML

SEQ ID NO: 32952 - protein, 502 aa, Arabidopsis thaliana
MVRDIVDDPLDEDDIALVKTYGLVPYSAPIKKVEKEIKELTEKINDLCGIKESDTGLAPLSKQMMQEGQPLQVGYVSCFRYIPIDLLMDIFSRVPAKSIARFRCVSKLWESILCRPDFKELFMTMSSIRPPLLLFTFQDDDGNLFFFSSPHPQIPCNENTSLVPTRYHVQHTTDSFSEIGSPLCGFICRRGKRNLDTMVICNPVTGESVSLPKVELKSINTETRPYLGYDPVRKQLKVLCIKSDDIPNTCDEHQVLTLENGNHLWRTIQCKPHYPKSDGICIDGILYYTAGFDMRARVSMVVCFDVRSEKFSFINIHVFMLMNDSCTLINYKGKLGALQFTCLSPKRLRFWVLVNAEKNIWTKCIYALPPLWNNLVQHTELAIVGMTDGGEVVLSQYCLIYAFYIYYFNLESKSLTRVQIQDVEMFKLDKCLSYILLFQGLTMTEDSTHFLLKGGYFKSSLPLKLASFSWLAVSQTIPQLNRWADFILSQKRPQQTVLPPPR

SEQ ID NO: 32953 - protein, 370 aa, Oryza sativa
IKLNHPCFGCVACSARERTNTPSFALLFLCPKQPAMVVLAKGELEQIALPAAHPPPADVRAIDLSATGPARAAEARALVAACEEQGFFRVTGHGVPPGLVRAAEAAAARFFALPQPDKEAAAGAPLGYASKRIGSAGDLGWIEYLLLCLAPAAAAAALPCAATSPTPPCPLRELLREYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDGGRSRYREFTWKEYKGSGCKGRLADDRLCRFEN

SEQ ID NO: 32954 - protein, 441 aa, Schizosaccharomyces pombe 972h-
MFQRRSLLSVRSSGSQIAFRRFVSLTHKDPTPDTTSCNIIKKEGANIISVYARYPVVAAKGEGSYLFDKEGRKYIDFTSGVAVTSLGHAHPEVARLAADQCSKLVHSSNLFYNEPAIELSNVINNSLAKNSGIAGPTKIFFANCGTEANETALKFARKAAFEKYGEGKSQIVYFNNSFHGRSLGSLSITANPKYKRGFQPLLPDVVQAVYNDPASIEQFVNDKTAAVIVEPVQGEGGICPAKPEFLIALRKACDKVGASLIYDEIQCGLGRSGDLWAHSIVKDVASPDIITVAKPLANGLPIGATIVSSKIAAEIHPGEHGSTFGGNPVACRVGTFCVNELGSSKILQNVRKQHKALTSRFDDFVAKYPNLIRGYAGRGLLLGLQFTEPPAKFIELARQQGLLLLPGGNNNTRVLPSLNVKDEVIAKGLDIMESTLKALSK

SEQ ID NO: 32955 - protein, 320 aa, Aspergillus oryzae
MENYQKIEKIGEGTYGVVYKARELTHPNRIVALKKIRLEAEDEGVPSTAIREISLLKEMSDPNIVRLLNIVHADGHKLYLVFEFLDLDLKKYMEALPVSEGGRGKALPDGSGLSKSMGLGEAMVKKFMAQLIEGIRYCHSHRILHRDLKPQNLLIDRDGNLKLADFGLARAFGVPLRTYTHEVVTLWYRSPEILLGGRQYSTGVDMWSCGAIFAEMCTRKPLFPGDSEIDEIFKIFRLLGTPDEVAWPGVTSFPDYKPTFPKWKREETRALVPGLEENGLDLLDALLEYDPARRISAKQACMHPYFQYGSSHYSGRTRRH

SEQ ID NO: 32956 - protein, 482 aa, Arabidopsis thaliana
MLFKMRSFVAFVLLLSWFGSCCSLKDQAVDFLKSEDSLKKDLSSDEDSTYLKTLVRNPYKDLPSRKDRKNRVVAATTTPSSSPEPAPKHVSTKASTVSEPQKRSSTQDVSPSPSAPLANSPIPRNSHSSVPLVVGCVGGAFFLLLVATGLYFFTSKAGKTVNPWRTGLSGQLQKVFVTGIPVLKRSEIEAACEDFSNVIGSCPIGKLFKGTLSSGVEIAVASFATTTAKDWKDSTEIHFRKKIEMLSKINHKNFANLLGYCEEKEPFTRILIFEYAPNGSLFEHLHYKESEHLDWGMRLRIAMGLAYCLDHMHQLNPPIAHTNLVSSSLQLTEDYAVKVSDFSFGSSETETNINNNTVIDTHISALNPEDNIYSFGLLLFEMITGKLIESVNKPDSVDSSLVDFLRGETLAKMVDPTLESYDAKIENIGEVIKSCLRTDPKERPTMQEVTGWLREITGLSPNDATPKLSPLWWAELEVLSTA

SEQ ID NO: 32957 - protein, 440 aa, Picrophilus torridus DSM 9790
MQEDEGFYLERLKADKIDFLQIQFTDITGHLKSLTVPKNRFEDVLYDGITFDGSSIPGFKPIENSDMKAMPDLSTYTIISQNSLGKTARFISKIFNPDGTRFDGDPRYVLERQIDRLKKENKHFYIGPEIEYFIFKRDDKNRPTVIPSDQGVYFDKNTDSSILLKEEIVKRLEDIDYYPEASHHEVAPGQHEIDVKYADAITMADRLIVIKSIVKDVAAKHGYYATFMPKPIKGINGSGMHVHQSIFNGDNNAFYDENNRYGLSKYALSYIAGILKNIKGASPILAPLVNSYKRLVPGYEAPVYICWANRNRSALVRVPAPSGKAKRIELRFPDSTGNHYLQFAVMLGMGLDGIENKAEIPDPVERNVFEMPLNERAELGIETMPGSLGEAIKEMERSETIKEILGEHIFENYIKLKRMEWEDYTTYVTDWEINRYLEVY

SEQ ID NO: 32958 - protein, 355 aa, Arabidopsis thaliana
VAVERVESLAKSGIISIPKEYIRPKEELESINDVFLEEKKEDGPQVPTIDLKNIESDDEKIRENCIEELKKASLDWGVMHLINHGIPADLMERVKKAGEEFFSLSVEEKEKYANDQATGKIQGYGSKLANNASGQLEWEDYFFHLAYPEEKRDLSIWPKTPSDYIEATSEYAKCLRLLATKVFKALSVGLGLEPDRLEKEVGGLEELLLQMKINYYPKCPQPELALGVEAHTDVSALTFILHNMVPGLQLFYEGKWVTAKCVPDSIVMHIGDTLEILSNGKYKSILHRGLVNKEKVRISWAVFCEPPKDKIVLKPLPEMVSVESPAKFPPRTFAQHIEHKLFGKEQEELVSEKND

SEQ ID NO: 32959 - protein, 111 aa, Mesorhizobium sp. BNC1
MSGINEFIDNEVKTNDVVLFMKGTPGFPQCGFSGQVVQILDYLGVDYKGINVLTSDELRQGIKEYSSWPTIPQLYVKGEFVGGCDIVREMFQAGEMQSFLEEKGVSVRGAA

SEQ ID NO: 32960 - protein, 1080 aa, Saccharomyces cerevisiae
MTTKPQNSKQGLAEGEMDVSSLFKRTEVIGRGKFGVVYKGYNVKTGRVYAIKVLNLDSDSDEVEDVQREIQFLASLKQISNITRYYGSYLKDTSLWIIMEHCAGGSLRSLLRPGKIDEKYIGVIMRELLVALKCIHKDNVIHRDIKAANVLITNEGNVKLCDFGVAAQVNQTSLRRQTMAGTPYWMAPEVIMEGVYYDTKVDIWSLGITTYEIATGNPPYCDVEALRAMQLIIKSKPPRLEDRSYSTSLKEFIALCLDEDPKERLSADDLLKSKFIRAHKATPTSILKELISRYLLFRDKNKNKYKIEGSIPENEPSKPSEAPKPSQNGGGDEAQKSIASNDNEIKRVNEGDVEMKWDFDSLSSSDYIIENNINLDALAEDNNEWATAQHDLFNYAYPDEDSYYFDPTSHNTRPFVYQGTTIGKGYPGTIAQNSTLNAPVTNNYTNSKYPSKMVAGTTNTSGTHTAGPMTSSKRLESKAPKQLLELFEDNEIITAENDVNTEAPKISKSISSLNAGNSSRDDFIPSISNEVNGNINNNKMRPHLPPLSSGNNYYSQSTPALPLLQTKFNKTSKGPPTSGLTTAPTSIEIEIPEELPNSALPTPASADPVLIPSTKARSSTVTAGTPSSSSSIQYKSPSNVPRRLTVSNNRPEHCPSTITNQKLGSAVASNSGISSTPNNSNNYNNNTDSENSRGSSGSNTANSTQMGITNPGNVTKLSTHKASSPSRPLFGVGTSPNRKPAGSPTQNIGHNSTHTNLAPPPTMKPMANSKDNKDILLQPLNSIPSSSTLNTISGNSSNNLTSSNYFSNEKEGSRVNGDFKRNNPNLKLQMPLPTPVVRNKLLDPNTATSQNNNGMPGSAGISTNENINQFGFNTSSASNIPVSMTPISEKHIDFGGKIKRSQSISNRKNSSASEHPLNILGSSVSGNVSGIGNNNVGSNNNSGPNNSVPLSANTGNTTIKANSTTIATSSSAAASTTAPISQQTIPSGTQFNHILSSAATAANSVNSLGFGMCPPPQSLQMEMFLDLESFLPGKQRRVDRKPQVLKELENLLQMFEEGLPCIEHALKEQLISTPIKDNEH

SEQ ID NO: 32961 - protein, 334 aa, Nostoc sp. PCC 7120
MSDQANQGDLEIRPSPLLKVINDLHSKYKSLKEGIVANYIPELAKVNPDLFSISIVTVDGQVYQVGDYQQLFTIQSISKVFAYGLALEDHGRDYVLTRVGVEPTGEAFNAIILDEQSKRPYNPMVNAGAIATTSLIKGAGATERLNRVLEMFRRYIGHDVFVDISVFTSERSTGHRNRAMAHLMLNFGMIDRNIEEALDLYFQQCAVMVNCHDLAVMAATLANRGVNPITGEQAVNSRYIKDILSVMYTCGMYNFAGEWAYKVGIPAKSGVCGGIMAVVPNLMGIAVFSPPLDIRGNSVRGVKVCEELSQQLGLHLFECMKVGNGEWGVGNCEC

SEQ ID NO: 32962 - protein, 298 aa, Prosthecochloris aestuarii DSM 271
MRDVWIAFGLTLFAGMATAIGSIIAFAAKRTNYRFLSVTTGFSAGVMLYVSFVEIFPKGVDALVEPFGEAGAHWVNALSFFGGMLLIGLIDFLVPAAENPHEIHSEAEMLPLHDSSAPAPDFDRLSGVQKKQEGVHDHGAHHKLLRMGMFTALAIGIHNFPEGLATFLAALQDPALGVAIAIAIALHNIPEGVSVSVPIYYATGSRKKAFIYSSLSGLAEPIGAVIAYGAILFFLGGETGVIPQEVMGILFGGVAGIMVYISLDELLPTSRAYGKGHDSLFGLAGGMVVMALSLLLMQ

SEQ ID NO: 32963 - protein, 420 aa, Burkholderia xenovorans LB400
MTRSAFDYVDGVLHAEGVSAVSLAEQFGTPLYVYSRAALTAAWNAYAGACAGRRASVHVAVKANSNLAVLNVFARLGAGFDIVSGGELARVLAAGGKAENTVFSGVGKNANEMREALAAGVKCFNVESIPELDRLNAVAAEMGKKAPVSLRVNPDVDAKTHPYISTGLKSNKFGVAFEDARATYQAAAGMANLEVVGIDCHIGSQITEAAPYLDAVDKVLELVEQIEQDGLKIRHIDVGGGLGITYDDETPPEIGEFVRTVLDRIEARGHGHREVYFEPGRSLVGNAGVLLTRVEFLKPGAEKNFAIVDAAMNDLARPAMYEAYHAIDPVVKRDVPAHVYDVVGPVCESGDWLGRERLLAVEPGDLLAIRSAGAYGFVMSSNYNTRPRAAEVMVDGTQVHVARAREEVRQLFVGETILPA

SEQ ID NO: 32964 - protein, 951 aa, Burkholderia thailandensis E264
MTLDTLAQPIAQPTPGAVRETRSTCCYCGVGCGVVIETRRDANGRDAIVGVRGDSDHPANFGRLCSKGGTLHLTATPERYAQTRATHPELRASRDAARTRVSWDDALDHVAQRLARIVERHGPDAVGFYISGQLLTEDYYVFNKLAKGLVGTNNIDSNSRLCMSSAVVGYKKTLGADAPPCSYEDLDHAGTVLIAGANPAYAHPILYRRLEAARARNPRMKVIVADPRRTDSASDATLHLALQPGTDTMLFNAMLHVLIWDGALDSAFIDAHTQGFDALRDAVRDATPAAAAQVCGLRADDIVQAARWFGAGPSLSLYCQGLNQSASGTAKNVALINLHLATGQIGKPGAGPFSLTGQPNAMGGREVGGMATLASAHRDLANPAERAEIARLWGVPGLPAQPGLTAVEMFEQLAAGALKAIWIVCTNPAHSIPNQALARAGLERAEFVVLQDAYAHTGTAPYADVLLPAATWGEKDGTVTNSERRISRVRAATQPYGDARADWRIAADVGRRLEARLAPGRPTLFPYEDAEAIWKEHRATTVGRDCDIGGLSWPLLARDGPQQWPFPAGAAQGFARLYADGRFPTADGRARFVPTPYQPVAEAVDARYRFALTTGRLRDQWHGGSRTGTVAKLFAHAPQPCVELDPGDCARLELGAHDFVHLTSRRGSALLPARADDAVAPGQAFAPMHWGDEYVSGVAGNRAAMGINALTTPARDPYSQQPELKHAAIKLLKADLPWRWLIAARVPAGDVLARQRAARAFFARFPYASCVPFGTDAYAGLAWRVAAYEPAPAELQREIEALFELPAQAADVMSYGDARRGTGRRVRIVDGALVAFSVAGAAGATEDSAAVLREYVDSGASVGALGRLLLFAGRVPLQTAPARGRTICNCVGVSEREIGAVLAADAPSAAPGERLANLQERLKCGTQCGSCIPELRRLIAETATAAAPSPR

SEQ ID NO: 32965 - protein, 299 aa, Bordetella bronchiseptica RB50
MQYPAQSPFQGIWIPLVTPFADGAVDLPALRKLVRDYKAAGVDGLVACGSTGEAAALDEAEQLAVLDAVLEEAGALPVAMGLAGNHQGHVLRRLARLGERPLAGVLAPAPYYVRPSQAGAQAYFRALADASAAPLILYDIPYRTGAQLDTATLLALAEHPNIAAVKDCGGSVDKTLALIAHGGMAVLAGEDLQGLGTLCLGGTGMIAAAAHVRPDLFVAMHRAVRAQQLGQAQRLFLALAPVIRLLFAEPNPAPLKALLASQGRLRNEMRAPMLPAAEALAARLRAELDALDRAFAPGV

SEQ ID NO: 32966 - protein, 406 aa, Frankia sp. EAN1pec
MPDSPARPRAASAGAARLPVLDLRDYTAPDGRADRRDFLDALRAACRDPGFLQLTGHGVPSGLTERIIAVSRAFFDLPLAAKLEIENVHSPHFRGYTCLGHEITRGRPDLREQIDISDERPARVLGPDDPPYLRLDGPNQWPAALPELRVAALVYLAELGRVARVLVRALAESLGLPPDHLDPTFSAEPRSHLKLLRYLPTPAGSATGHDAAGHDAAEPNAAADGQNVDQGIGQGVGAHKDGGFLTFVLQDGVRSARQDGAHPAPRSPTGPSGLQVADGAGGWIEAAAVPGAFVVNIGEMFELATRRYYRATVHRVVSPPPGHERVSVAFFFGPRLSATLEPMPLPDALLAEIPDAEPPDPENPIFAQHGTNTLKSWLRSHPEVARRHYADVAPPAGVAPTAGGGA

SEQ ID NO: 32967 - protein, 472 aa, Zea mays
MPKPPPPTSDPSLPTTTTTSTPKSSSRPAPAGLLDPLAASGRSLLASARRSPVTTLAGAFFLLALVMYGEDARTIAELSIDDYLYPDADLYNVSGLPPLALPPPTCDLSSGRWVFDNASVPAYREKDCTFLTKQVTCLANGRPDDMWQYWRWQPSDCSLPTFDARRFMEAMRGKRLMFVGDSLNRNQWESLVCLVQPILSKGRKKIVKRGSLNTFYAKEYRATLEFYWAPFLVESNSDNPNFHSIKERIISPERIEAHARNWKDVDYLIFNTYIWWMNTADIKVRRPNSRYWSENDEVPRIEAYGRVFKTWSDWLNNNIDPARTSVFFMTISPIHISPQNWGNPGGIRCVKETLPYQNYSQPLDLYHDMRLYDLVIKVASSMEKVPVSVINITKMSDYRKDAHASVYTIRQGKLLTPKQKADPEKFADCIHWCLPGVPDVWNQILYTRILSKSPWRSNFSPPPSQSTPLPPQ

SEQ ID NO: 32968 - protein, 443 aa, Synechococcus sp. CC9311
MLTPLPKHHFPGEGREGNSTVQLLREELLLDGNSKQNLATFCQTYQAQSAMELMTLGVDKNLIDKDEYPQTAELEGRCVSMMADLWNAPGAAVGCSTIGSSEAAMLGGMAAKWRWRKRREAAGLPTDKPNMVCGSVQICWKKFARYWDIEMRELEMLTGELCVSPERVLEAVDENTIFVVPTLGVTYHGLYEDIESISKALDDLQARTGLDVPIHVDAASGGFLAPFCAPDLPLWDFRLERVKSINASGHKFGLAPLGVGWVLWRSQEDLPDELVFHVTYLGGDMPTFQINFSRPAGQVIAQYHEFVRLGREGYRMLHMASHANAQYFAEKLREMDLFRIIHDGTPDKGIPTVVWTLDDNPKYGFNLYDFADRLRMRGWQVPAYPFTGELESTAFQRILVKRDFTRDMADLLLEDIRQAIQHFQKHPITSNLAATEGASYNHL

SEQ ID NO: 32969 - protein, 164 aa, Wolbachia endosymbiont of Drosophila ananassae
MDSGDQERERGITILAKCTSIMWGDEKINIIDTPGHADFGGEVERVLCMADGVLLLVDAAEGPMPQTKFVLSKALKANLKPIVIINKVDRPDSRIDEVLNEIYELFFNLDATNEQLDFPVLYASGRNGWCAKELSDERKDLSPLFSTVIDYIKPSVYDQNALFR

SEQ ID NO: 32970 - protein, 383 aa, uncultured archaeon GZfos35B7
MTVIADRVSQIEGSGIRKFFDIAQRMEGVISLGVGEPDFVTPWTIREACIFSLEKGYTSYTSNWGLLELREAISDKIYEESGVFYDPEGGILITTGVSEAFDLALRAIINPGDEVILHEPCYVSYKPCTVFAGGTPVCVATGVEDKFELRAEEVAEKITDKTKAIILSYPNNPTGAALSKKDLEEIADVATEHDLIVISDEIYDKLTYEGEHTCFSSLNGMEERTILLNGFSKAYAMTGWRIGYAAGNKAIIEAMMKIHQYIMLCAPITAQMAAIEALRCDDETDRMVSEYNRRRRLMVAGLRELGLSCFEPKGAFYTFPSIEDTGLTSEEFAERLLKEEKVVVIPGSVFGDCGEGYIRCSYAVSQYELKEALERMGRFLDTL

SEQ ID NO: 32971 - protein, 412 aa, Thermus thermophilus HB8
MEYTTLAVLAGLPEDPHGAVGLPIYAVAAYGFKTLEEGQERFATGEGYVYARQKDPTAKALEERLKALEGALEAVVLASGQAATFAALLALLRPGDEVVAAKGLFGQTIGLFGQVLSLMGVTVRYVDPEPEAVREALSAKTRAVFVETVANPALLVPDLEALATLAEEAGVALVVDNTFGAAGALCRPLAWGAHVVVESLTKWASGHGSVLGGAVLSRETELWRNYPQFLQPDLKGQIPWEALRARCFPERVRTLGLSLCGMALSPFNAYLLFQGLETVALRVARMSETARFLAERLQGHPKVKALRYPGLPEDPAHRNARKYLASGGPILTLDLGDLERASRFLGAIRLLKAANLGDARTLLVHPWTTTHSRLKEEARLQAGVTPGLVRVSVGLEDPLDLLALFEEALEAV

SEQ ID NO: 32972 - protein, 115 aa, Triticum aestivum
AEQAEFFFLGTNDLTQMTFGYSRDDVGKFIPIYLAQGILQHDPFEVLDQRGVGELVKFATERGRQTRPNLKVGICGEHGGEPSSVAFFAKVGLDYVSCSPFRDPIARLAAAQVLV

SEQ ID NO: 32973 - protein, 464 aa, Arabidopsis thaliana
MTRVNQLPCDCVSTAEESLTSGTCITPTHVTSLSSPLDRSGDVDPLPVSDESGGSKADESMTDADETKKRKRILSGDCEADENNKSDGEIASLNDGVDAFTAICEDLNCSLCNQLPDRPVTILCGHNFCLKCFDKWIDQGNQICATCRSTIPDKMAANPRVNSSLVSVIRYVKVAKTAGVGTANFFPFTSNQDGPENAFRTKRAKIGEENAARIYVTVPFDHFGPIPAEHDPVRNQGVLVGESWENRVECRQWGVHLPHVSCIAGQEDYGAQSVVISGGYKDDEDHGEWFLYTGRRGRHFANEDQEFEDLNEALRVSCEMGYPVRVVRSYKDRYSAYAPKEGVRYDGVYRIEKCWRKARFPDSFKVCRYLFVRCDNEPAPWNSDESGDRPRPLPNIPELETASDLFERKESPSWDFDEAEGRWRWMKPPPANHEQRERMKMAMTCLLLFVLIILVGSSSILYQY

SEQ ID NO: 32974 - protein, 297 aa, Synechococcus sp. CC9311
MISGTTALVALLGQPVSHSLSPAMQNAALKAMGLDWSFLALPCSADDLANVLKGLEAVGCRGLNVTIPHKQAVSQLCNELSPLAQRLGAINTMTPLPSGGWHGHNTDVEGFLAPLLHNNANWSGTRTVVVGCGGSARAVVAGLQDLNPSEITIVGRRDKTLQPFCSDLQQGRPANSVQLQPLLDNDPQLQTRIQQADLVVNTTPIGMSSHQPDQGPVLPLGEDIWNNLTAHTVLYDLIYTPRPTPWLQRGEALGCRTYDGLEMLVQQGAAALRCWSGMDEVPVDAMREAALKNLSHP

SEQ ID NO: 32975 - protein, 299 aa, Salinibacter ruber DSM 13855
MEHPHPVLFSVPSSPMPPSGETGTFRTHDGLSLATRRWTPSAAPEAHVLLVHGYAEHCGRYDHVATALTEQGAAVHAYDQRGHGRSDGRRAYVDRFEQYLADLDAFRLHVAPLEDKPVFLFGHSMGGLVTVLYVLNRRPHVDGLLLSAPAIEVNPDLAPVLRRMAQALGRVAPTLPTVRSPQGSISRDPAVLEDARNDPLNYHGRTLARTGAELLRAGNDAQCRLHELTIPFLVFHGTADPLVSPAGSRHLHERAAAPDKTLKLYDGLYHETFNEPERERVLGDVSTWLAERLPTDPAR

SEQ ID NO: 32976 - protein, 330 aa, Synechococcus sp. CC9311
MADLSALAPRVMCLGEALVDRLGPLGGDPVTAAPESCDDRLGGAPANVACALARLGTPVGLVGRLGEDSIGSAFRDLFQQRGVAVQALQRDVSHPSRVVLVRRHANGERVFQGFAGDHALGFADQMLNLGELEAVWPMVSKQARWLLVGTIPLATPTSADSLQWLLAQAQAASLALAVDVNWRPTFWDPEADPAAGPTADALAVIKPLLEQASLIKLAREEALWFFGSDDPAAVAKDLPQQPDVVVTDGANPIRWFIEHEAGSMPVFQPSQVIDTTGAGDAFTAGLLHCWDRPVNERLYFASACGALVCSGAGAIDPQPQEQDVLTFLNR

SEQ ID NO: 32977 - protein, 135 aa, Yersinia pestis KIM
MPQHHNRNRRMIIKTQNAPAAIGPYSQGVVAGNLLFISGCCPFSEKDGSVVGIDITEQTIQAMKNLKAIVEATGSYMNDVVKTTCFISDMNNFQSFNTIYAGYFPSGTFPARSCVEVARLPKDVLIEVEAIVSLK

SEQ ID NO: 32978 - protein, 328 aa, Shigella flexneri 2a str. 2457T
MSHVELQPGFDFQQAGKEVLAIERECLAELDQYINQNFTLACEKMFWCKGKVVVMGMGKSGHIGRKMAATFASTGTPSFFVHPSEAAHGDLGMVTPQDVVIAISNSGESSEITALIPVLKRLHVPLICITGRPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRQLSIADVMTPGGIRVRPGILAVEALNLMQSRHITSVMVADGDHLLGVLHMHDLLRAGVV

SEQ ID NO: 32979 - protein, 128 aa, Corynebacterium efficiens YS-314
MPPGSSFPNCQRTVYMNILDKVDSAYLRDDVPAFRPGDTLDVHVKVIEGTNTRTQLFKGVVIRRQGSGIRETFTVRKVSFGIGVERTFPVHSPNLEKIEVVRRGDVRRAKLYYLRELRGKAARIKEKR

SEQ ID NO: 32980 - protein, 313 aa, Arabidopsis thaliana
MVRGDDQLNGLQGGKRALDILCVATERTVSAFAYEEIGETSTEGDKRRERLRRLRRLINYSLSTTMNSSLSKRLKIDECKNQDPEQNPNRVASSPSSCHLESKRPQKVVSNKPVRNRKPVIVTDEDRTPTEWLIDVMREVNGMDAKLIFVKVLPNSDVDELQTRLMMPWKQILDMDFLNEEELEKIDRHHKKISASDKGADVIVVNSKGLQRKLKLKRWDMTSTSNYVLGLGWNKVVTDNILQRGTRLRIWSFHSPDMLFFAFVLSDPDPAPTECLNLLAKLCEETTCLEALQEANRMSSLVSDTELDLELRL

SEQ ID NO: 32981 - protein, 469 aa, Neurospora crassa
MAPVMRLGSAALRSSIHLTSRQTAFTAARCYSSKTQTLKERFAELLPENIEKIKALRKEHGSKVVDKVTLDQVYGGARGIKCLVWEGSVLDAEEGIRFRGKTIPECQELLPKAPGGKEPLPEGLFWLLLTGEVPSEQQVRDLSAEWAARSDVPKFIEELIDRCPSDLHPMAQLSLAVTALEHTSSFARAYAKGINKKEYWGYTFEDSMDLIAKLPTIAARIYQNVFKGGKVAAVQKDKDYSFNFANQLGFGDNKDFVELLRLYLTIHTDHEGGNVSAHTTHLVGSALSSPFLSVAAGLNGLAGPLHGLANQEVLNWLTEMKKVIGDDLSDEAITKYLWDTLNAGRVVPGYAHAVLRKTDPRYSAQRKFAQEHLPEDPMFQLVSQVYKIAPKVLTEHGKTKNPYPNVDAHSGVLLQHYGLTEANYYTVLFGVSRAIGVLPQLIIDRAVGAPIERPKSYSTDKWIEICKKL

SEQ ID NO: 32982 - protein, 149 aa, Neurospora crassa
MADSLTEEQVSEFKEAFSLFDKDGDGQITTKELGTVMLSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 32983 - protein, 422 aa, Sinorhizobium meliloti 1021
MNHFQYRDGILYAEDVPLTEIARAVGTPFYCYSTATLERHYKVFSQAFADVDAMVCYAMKANSNQAVLKTLGRLGAGLDVVSEGELRRALAAGIPAGRIMFSGVGKTAREMDFALEAGIYCFNVESEPELEVLNQRAVRAGRRAPVSFRINPDVDARTHAKISTGKKENKFGISWERARGVYAHAAELPGIEVTGIDMHIGSQITELQPFDDAFKLLRELVDTLRSDGHVIEHVDIGGGLGIPYREDNNPPPLPDAYADIVKNQLKGLDCKIVTEPGRLIVGNAGILVTEVVYVKDGGDKTFVIVDGAMNDLIRPTLYEAYHEIRPVKISAASAPRIKADVVGPVCETGDYLALDREMAMPKPGDLFAIGSAGAYGAVQAGTYNSRLLVPEVLVKGDRFHVIRPRRDYDELIGLDSVPDWLD

SEQ ID NO: 32984 - protein, 239 aa, Triticum aestivum
GDIIEPVLSKKAGWFRSRIPGKFVNPRVPGRLGDWSTRTLTWTEGIEKFRVPPPSRLYTYIVQPWPPTVMAWSATSVAPSKGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 32985 - protein, 217 aa, Burkholderia xenovorans LB400
MSFLLHQSRFFTTVNHLQDLPATSQPEICFAGRSNAGKSTAINILCNQKRLAFASKTPGRTQHINYFSVGNADEPTAHLVDLPGYGYAEVPGAAKAHWEALLSAYLQSRSQLRGMILMMDSRRPLTDLDRRMIEWFVPTGKPIHTLLTKCDKLTRQESVNALRATQKGLAEYRAAGYRGELTAQLFSALKRIGIDEAHALIESWLIPEAKGETDTPQ

SEQ ID NO: 32986 - protein, 414 aa, Yersinia pseudotuberculosis IP 32953
MEQPSPVTRQSFDEWLVPTYAPADFIVVRGEGSTLWDQQGKSYIDFAGGIAVNALGHGHPAVRAALIEQADKVWHLGNGYTNEPVLRLAKQLIDATFAEKVFFCNSGAEANEAALKLARKYALDNFANKAGQQGEKNQIVAFRNAFHGRTLFTVSAGGQPKYSQDFAPLPGGIHHGIFNDLASAEHLITDQTCAVIVEPIQGEGGVLPADKEFLHGLRALCDRHNALLIFDEIQTGVGRTGELYAYMHYGVSPDVLTSAKALGGGFPIGAMLTTTKYASALSVGSHGTTFGGNPLACAVAGTVLSLINQPTLLAGVKARHQWFIDELAEINARHNVFAEIRGRGLLIGCVLNAQYAGKSKEIVQAAAQYGLIALIAGPDVVRFAPSLIISPKEIKEGLARLAMGIEQVCQKVTS

SEQ ID NO: 32987 - protein, 583 aa, Aspergillus oryzae
MSRRATPGQAAQNQQTIKGLLKLEHNKICADCKRNKHPRWASWNLGIFVCIRCSGIHRGMGTHISRVKSVDLDSWTDEQLQSVMRWGNARANKYWEAKLAPGHVPSEAKIENFIRTKYESKRWIMDGPMPDPSTLDDGDDDVPLAVVQEKAKIERSASQRVAASSQPPAAHRQQASIDLFADDDIAPPARPSTTDPTPRAAPKQPQSAPKPTRPGDSLLGLDFFGSAQPAANSHPSSTASTPGGSTGISRPDLKQSILSLYSKPQPAPAQHGRTSSFGDFGDLASPAPPSASPSSNLGGLTDAFSGLSFPSTTSPPPQKPAEKSSPFANLTSFATKKSSPAAPKVSSPTASAGSGGGSLFDSLASPTIPAAKPQSRTTSISSNGFDSGFTSFASPPPSKPNPPPSSSLSNDLFGLSSPAPVAPSKVSSPPAPTAISPQNELKAAFNLNPPVPAPVSAAPKPSMSATTASIASALPASIDPWGGGNAWSTPDPAPAAEPSGPSMMKVPDTLTANDIGAGWGATASTSGGSKQAPTVAADEDFGGWTSAAPISSTTAATTTNMSVPSKPAGGFSGADDLFSNVWE

SEQ ID NO: 32988 - protein, 355 aa, Ralstonia metallidurans CH34
MKIAVLPGDGIGPEIVAEAVKVLNALDEKFEMETAPVGGAGYEAEGHPLPDNTLKLAKEADAILFGAVGDWKYDSLDRPLRPEQAILGLRKHLQLFANFRPAICYPELTGASSLKPELVAGLDILIVRELNGDIYFGQPRGVREAPDGLFKGAREGFDTMRYSEPEVRRIAHVAFQAAAKRGKKLCSVDKANVLETFQFWKDIVIDVSKEYPDVELSHMYVDNAAMQLVKAPKSFDVIVTGNMFGDILSDEAAMLTGSIGMLPSASLDANNKGLYEPSHGSAPDIAGKGVANPLATILSAAMMLRYSLNRAEQADRIENAVKKVLAQGYRTADIVTPGCKQVGTREMGEAVLAAL

SEQ ID NO: 32989 - protein, 354 aa, Staphylococcus aureus subsp. aureus MW2
MKNLVLLGGGYGNMRIMSRILTTSLPQDYTVTLVDRMPFHGLKPEFYALAAGTKSDKDVRMKFPNHPQVNTVYGEINDIDLDAQIVSVGNSKIDYDELIIDLGCEDKYHNVPGAEEYTHSIQTLSKARDTFHSISELPEGAKVGIVGAGLSGIELASELRESRSDLEIYLYDRGPRILRNFPEKLSKYVAKWFAKNNVTVVPNSNINKVEPGKIYNCDEPKDIDLVVWTAGIQPVEVVRNLPIDINSNGRVIVNQYHQVPTYRNVYVVGDCADLPHAPSAQLAEVQGDQIADVLKKQWLNEPLPDKMPELKVQGIVGSLGDKQGFAYIMDRTVTGRLASILKSGVLWLYKYHNG

SEQ ID NO: 32990 - protein, 252 aa, Idiomarina baltica OS145
MSSVLANNISGKVVVITGGSSGLGETTARHLASLGASVVLGARRIDKLEAIAADIRTAGGEVAVQATDVTSQDEVKALVNLAQERFGKVDVVINNAGLMAIAPLAETRVDEWDRMIDINVKGLLYGVAAALPIFQAQGTGHFINISSVAGVKVFSPGGTVYSGTKFAVRAIAEGLRHEVGGEIRSTIISPGAIESELKHGSSDTQGAAFVKDFYQQNEIPSESVARAIAYAIEQPADVDINEIVLRPTVQEF

SEQ ID NO: 32991 - protein, 519 aa, Craterostigma plantagineum
VDHYTYCILGDGCQMEGVSNEACSIAAHWGLGKLIALYDDNHISIDGDTDIAFTEDVDKRFEALGWHVIWVKNGNNGYDKIRAAIKEAQAVKDKPTMIKITTTIGFGSPNKSNSYSVHGSALGAKEVEATRQNLGWPYEPFHVPDDVKKHWSRHTPQGASLESEWNAKFAEYEKKYPEEAAELKSIITGELPLGWEKALPTYTPENPGDATRNLSQQNLNALAKVLPGLLGGSADLASSNMTLLKSSGDFQKNTPEERNVRFGVREHGMGAICNGIALHSPGLIPYCATFFVFTDYMRAAMRISALCEARVIYVMTHDSIGLGEDGPTHQPIEHLASFRAMPNILMLRPADGNETAGAYKVAVQNLKRPSVLALSRQKLPQLPGTSIEGVEKGGYVISDNSSGNKPDVILIGTGSELEIAAKAGEVLRKEGKGVRVVSFVSWELFDEQSKEYKESVLPSSVTARVSIEAGSTFGWGKIVGSKGKAIGIDRFGASAPAGKIYEEFGITVEAVVAAAKELI

SEQ ID NO: 32992 - protein, 676 aa, Craterostigma plantagineum
MAPKTTLIAEPELVSKSVNTIRFLAIDAVEKAKSGHPGMPMGCAPMGHVLYDEFMRFNPKNPYWFNRDRFVLSAGHGCMLQYALLHLSGYDSVKEEDLKSLRQWGSRTPAHPENFETPGVEVTTGPLGQGIASAVGLAVAEKHLAARYNKPGFEIVDHYTYVILGDGCQMEGVSNEACSLAAHWGLGKLIALYDDNHITIDGDTDVAFTEDVDKRFDALGWHVIWVKNGNDGCDEIRAAIEEAKSVKDRPTMIKVTTTIGYGAPSKANTYGVHGNALGPKEAEATRKNLGWPYEPFHVPDDVKKHWSRHIAEGAALESAWNAKFAEFQKKFPEEAADLKSIITGELPTNWESIFPTYTPENPGLPTRTLSHQILNGLGDVLPGLLGGSADLTLSNMAFLKNSGDFQKKSPGERNVKFGAREHAMGSICNGLALHSPGLLPYCATYFVFTDYMRAAMRISALSKARVLYIMTHDSIGLGEDGPTHQPVEHLASFRAMPNILTLRPADGNETAGAYRAAVQNGERPSILVLARQKLPQLPGTSIEGVSKGGYVISDNSRGGNSKPDVILIGTGSELEIAARAGDELRKEGKKVRVVSLVCWELFAEQSEKYRETVLPSGVTARVSVEAGSTFGWERFIGPKGKAVGIDRFGASAPAERLFKEFGITVEAVVAAAKEIC

SEQ ID NO: 32993 - protein, 679 aa, Craterostigma plantagineum
MAKTTPSSPSAAAAAELVVKSVNTIRFLAIDAVENVKSGHPGMPMGCAPMGHVLFDEFMKFNPKNPYWFNRDRFVLSAGHGAMLLYGLLHLAGYDSVKVEDLKGLRQWGSKTPAHPENFETPGVEVTTGPLGQGVGSAVGLALAEKHLGARYNKPDFEMVDHYTYMILGDGCQMEGISNEASSLAAHWGLGKLIALYDDNHITIDGDTDLAFTEDVGKRFEALGWHVLTVANGNDGYDEIREAIKVAKSVTDKPTLIKVATTIGFGSPNKANTYGVHGNALGPKEAEATRQNLGWPYETFHVPDDVKKHWSRHISEGAELESAWNAKFAEYEKKYPKEAAELKSIITGELPLGWEKALPTYTPESPGNPTRTLSHQNLNAVAAVLPGLIGGSADLTASNMAFLKSSGDFQKETPTGRNLKFGAREHGMGAICNGVALHSPGLVPFSATYFVFTDYMRAAIRIAALSKARVVYIMTHDSIGLGEDGPTHQPVEHLASFRAMPNILVLRPADGNETAGAYKVAVENAGRPSILSLSRQKLPQLPGTSVEGVGRGGYVISDNSKDGEKPEVILMGTGSELEIAARAGEELRKEGKKVRVVSLVSWELFGEQSKEYKEMVLPSEVTARVSVEAGSTFGWERFVGLKGRAVGIDRFGASASAERLYKEFGITVEAVVAAAKELC

SEQ ID NO: 32994 - protein, 289 aa, Glycine max
  misc_feature (166)..(166): Xaa can be any naturally occurring amino acid
  misc_feature (189)..(189): Xaa can be any naturally occurring amino acid
  misc_feature (203)..(203): Xaa can be any naturally occurring amino acid
MNFNNVNAPKVPGGGVAALLKVGIIGGLVVYGAANSLYNVEGGHRAIVFNRVVGVKDKVYPEGTHIMIPWFERPVIYDVRARPHLVESASGSRDLQMVKIGLRVLTRPVPDQLPTVYRTLGESYNERVLPAIIHETIKAVVAQYNASQLITREGECSREIRKILTXRPSSLTMVLDDVSITSLTFGKEXTAAIEAKQVVVQEXERLKFVVEKADQDKRSAVIRAQGEAKSAQLIGEAIANNPAFITLRKIEAAREIAHTISNSANKVYLNSDDLLLNLQELNLEPSGKR

SEQ ID NO: 32995 - protein, 389 aa, Streptomyces ansochromogenes
MTESYDVVVVGGGPVGLATAWQVAERGHRVLVLERHTFFNENGGTSGAERHWRLQYTQEDLFRLTLETLPLWRALESRCERRLIHEIGSLWFGDTDVVTNEGQISGTAAMMDKLSVRYEWLKSADIERRFGFRGLPRHYEGFLQPDGGTIDVRGTLAALFTLAQAAGCTLRAGETVTELVPDADGVSVTTDRGTYRAGKVVLACGPYTNDLLEPLGARLAYSVYEMAIAAYRQATPVTQAPFWFAFQQPTPEDTNLFYGFGHNPWAPGEFVRCGPDFEVDPLDHPSAATGVADRRQTDRLSGWLRDHLPTVDPDPVRTSTCLAVLPTDPERQFFLGTARDLMTHGEKLVVYGAGWAFKFVPLFGRICADLAVEDSTAYDISRLAPQSAL

SEQ ID NO: 32996 - protein, 741 aa, Solanum tuberosum
MASSSSLTLSQVIFSPSLPRHGSSSSSSPSLSFSTFSGLKSTPFTSSHRRILPSTTVTKQQFSVRASAAVETLEKTDAAIVEKSVNTIRFLAIDAVEKANSGHPGLPMGCAPMGHILYDEVMKYNPKNPYWFNRDRFVLSAGHGCMLQYALLHLAGYDSVQEDDLKSFRQWGSRIPGHPENFETPGVEVTTGPLGQGIANAVGLAVAEKHLAARFNKPDAEIVDHYTYVILGDGCQMEGISNEVCSLAGHWGLGKLIAFYDDNHISIDGDTEIAFTEDVSARFESLGWHVIWVKNGNTGYDEIRAAIKEAKAVKDKPTMIKVTTTIGFGSPNKANSYSVHGSGLGAKEVEATRNNLGWPYEPFHVPEDVKSHWSRHTPEGAALETEWNAKFAEYEKKYAEEAADLKSIITGELPAGWEKALPTYTPESPADATRNLSQQNLNALAKVLPGFLGGSADLASSNMTLLKMFGDFQKNTPEERNLRFGVREHGMGAICNGIALHSLGLIPYCATFFVFTDYMRGAMRISALSEAGVIYVMTHDSIGLGEDGPTHQPIEHLASFRAMPNILMFRPADGNETAGAYKVAVLKRKTPSILALSRQKLPQLAGTSIEGAAKGGYIVSDNSSGNKPDVILIGTGSELEIAVKAAEELKKEGKTVRVVSFVCWELYDEQSAEYKESVLPSSVTARVSIEAGSTFGWQKFVGDKGKAIGIDGFGASAPADKIYKEFGITAEAVVAAAKQVS

SEQ ID NO: 32997 - protein, 1542 aa, Candida glabrata
MNTPDDSSVSSVDSHQPYMGFDDNVEKRIRELARSLTQQSLTSSNRSVNKEAPADGSAPLDRVSTRASSIFSADFKGVNPVFSDEEEDDYDARLDPNSDEFSSKAWVQNMAKITTGDPEFYKPYSIGCCWKDLSASGESADVSYQSTFLNLPVKLLNAVWRKARPARESDTFRILKPMDGLLKPGELLVVLGRPGSGCTTLLKSISSTTHGFQISKDSVISYNGLTPNEIKKHYRGEVVYNAEADIHLPHLTVYQTLVTVARLKTPQNRVKGVTREDFANHVTDVAMATYGLSHTRDTKVGNDLVRGVSGGERKRVSIAEVWICGSKFQCWDNATRGLDSATALEFVRALKTQAHIAKNVATVAIYQCSQDAYNLFNKVSVLYEGYQIYFGDAQHAKVYFQKMGYFCPKRQTIPDFLTSITSPAERRINKEYLDKGIQVPQTPLDMVEYWHNSEEYKQLREEIDETLAHQSEDDKEEIKEAHIAKQSKRARPSSPYVVSYMMQVKYILIRNFWRIKNSASVTLFQVFGNSAMAFILGSMFYKIQKGSSADTFYFRGAAMFFAILFNAFSSLLEIFSLYEARPITEKHRTYSLYHPSADAFASVISEIPPKIVTAILFNIIFYFLVNFRRDAGRFFFYFLINVIAVFAMSHLFRCVGSLTKTLQEAMVPASMLLLALSMYTGFAIPRTKMLGWSKWIWYINPLAYLFESLMVNEFHDRRFPCNTYIPRGGAYNDVTGTERVCASVGARPGNDYVLGDDFLKESYDYENKHKWRGFGVGMAYVIFFFFVYLILCEFNEGAKQKGEMLVFPHSVVKRMKKEGKIRDKTKMHTDKNDIENNSDSITSNATNEKNMLQDTYDENADSESITSGSRGGSPQVGLSKSEAIFHWQNLCYDVPIKTEVRRILNNVDGWVKPGTLTALMGASGAGKTTLLDCLAERTTMGVITGDVMVNGRPRDTSFSRSIGYCQQQDLHLKTATVRESLRFSAYLRQPSSVSIEEKNEYVEAVIKILEMETYADAVVGVPGEGLNVEQRKRLTIGVELAAKPKLLVFLDEPTSGLDSQTAWATCQLMKKLANHGQAILCTIHQPSAMLMQEFDRLLFLQKGGQTVYFGDLGKGCKTMIKYFEDHGAHKCPPDANPAEWMLEVVGAAPGSHANQDYHEVWRNSEQFKQVKQELEQMEKELSQKELDNDEDANKEFATSLWYQFQLVCVRLFQQYWRTPDYLWSKYILTIFNQLFIGFTFFKADHTLQGLQNQMLSIFMYTVIFNPLLQQYLPTFVQQRDLYEARERPSRTFSWKAFILAQIVVEVPWNIVAGTLAYCIYYYSVGFYANASQAHQLHERGALFWLFSIAFYVYVGSLGLFVISFNEVAETAAHIGSLMFTMALSFCGVMATPDAMPRFWIFMYRVSPLTYLIDALLSTGVANVDIRCSNTELVTFTPPQGLTCGQYMTPYLNVAGTGYLTDPSATDECHFCQFSYTNDFLATVSSKYYRRWRNYGIFICFIVFDYVAGIFLYWLARVPKTNGKIAKNGKTAKVNFIRRLIPF

SEQ ID NO: 32998 - protein, 272 aa, Staphylococcus epidermidis ATCC 12228
MIKVKFAVIGNPISHSLSPLMHHANFQSLNLENTYEAINVPVNQFQDIKKIISEKSIDGFNVTIPHKERIIPYLDDINEQAKSVGAVNTVLVKDGKWIGYNTDGIGYVNGLKQIYEGIEDAYILILGAGGASKGIANELYKIVRPTLTVANRTMSRFNNWSLNINKINLSHAESHLDEFDIIINTTPAGMNGNTDSVISLNRLASHTLVSDIVYNPYKTPILIEAEQRGNPIYNGLDMFVHQGAESFKIWTNLEPDIKAMKNIVIQKLKGEL

SEQ ID NO: 32999 - protein, 388 aa, Salinibacter ruber DSM 13855
MPRDYYDILGVDEDASDKEIKKAYRKKAMEYHPDRNPDDPEAEQKFKEASEAYEVLSDPEKRQRYDQFGHDGVDSGAGGGRRGRGRGFHDIEDIFDAFSDIFGGAPGGGRGRGRSERGRGRPGSDLRVSLSLTLEEIAEGTEKNLRLQKYLECESCDGTGAEGGMGGQNFSMCPKCDGTGEIRQVSRSVFGQVVNVQPCPRCEGEGRIIDNLCDDCGGEGRVQGEESISINVPPGVMEGNYLTLGDAGNAGLRGGPSGDLRIEIEEEPHEHFERDGLDIYYDLHLSFPEAALGTEVDVPTLEGEARLEVDPGVQAGKILRMRDRGLPDLEGSGQGDQMIRVHVWTPQELTAEEEELLDQLRAHDNFQPRPPEEDTQKSFFRRVSDVFS

SEQ ID NO: 33000 - protein, 321 aa, Picrophilus torridus DSM 9790
MTEMNMVKALNSALDTMLERDKNVILLGEDIAKDGGVFRVTDGLYAKYGGERVISTPLSELGIVGMGIGMAMDGLRPVPEIQFLDFIYTAMDQIVSQMAKIRYRTNGDYTLPMVLRTPYGGGVSGGPYHSQSSEAYFAHTAGLVVVTPSNPYDAKGLLISAIESNDPVMFLEPKRIYYSIKNDVPDNYYKVDIGRAKRILEGDDVTLITYGPMVPLVKSVVQKNNVNADVIDLITLNPFDVNSIINSVKRTGRAVIVHEAPKMFGAGAEIAATIAEKAIDYLQAPILRVTGMDIPVPFILEDYYVPNEKRIMNAINKVINY

SEQ ID NO: 33001 - protein, 333 aa, Picrophilus torridus DSM 9790
MIEEDISKEDIISAYRNMVLERFLDKKLLGINRQGFLPFYIPNIGHEALHAAIGMAIRDDDFFYPYYRDLGSDIARVGLDFVLAQMFSTEMDNELGRDMPLHISNKAKRVGPVITTVGGHLMAATGVAYSYKYQKKPGIVITTFGDGATSTPDFHVSMNFAAVYSLPLLFICENNQWAISYPVEEQTKVEISKKAEAYGFTGIKIDGNNFIEAYHAIRNAIKDVEKNKMPLLIDAVTYRMGPHTTADDPNKYRKTIINEGDPLDPLSIIEDDIKKMKILNDEEISNIKNEINNMVSKEVERYEKMNKPGKETLFKNIYENEPWYITEERGEIE

SEQ ID NO: 33002 - protein, 376 aa, Oryza sativa
  misc_feature (206)..(206): Xaa can be any naturally occurring amino acid
  misc_feature (223)..(223): Xaa can be any naturally occurring amino acid
MPASDPAPAAAAAAYDRTAELRALDATLSGVRGLVASGATHLPRIFHNVVHGDQEPPEATAPSSAATTTTTVPVIDISGSRAAVVDAVRRAAAEWGFFQVTGHGVPLAAMDAAAGAARAFHESGGGEGSDKARLYSREPGRAVKYHCNFDLYQSPVANWRDTLYLRMAPDPPPAADLPEICRDALFEYAKQHEDLGNTLFELLSEXALWLKPRYLTDIECNQXQIILCHYYPPCPQPELAIGTSRHSDSGFLTILLQDDIGGLQILHEDRWVDVTPTPGAFIVNVADLLQLISNDNYKSVEHRVVAKNTEPRVSIACFFSTHFHPISTRMYGPIKELLSDENPPLYREALVRDYTARYYSVGLDGKFKTTLSEFRL

SEQ ID NO: 33003 - protein, 186 aa, Arabidopsis thaliana
MGSRDQKVKWSWSSALIGAASATAAASLLSAKPKDPTFHLISIDLTSLKLNLPVLDAELMLTVHVTNPNIAAIHYSSTKMTILYDGTVLGSAEVKAGSQPARSCQLLRLPARLDGMELAQHARQFFSDVAKREMKLEAKLTIEGAAKVLWWDHSFRVHVDSFVTVDPVFLDVIGQENKSQMDLFLT

SEQ ID NO: 33004 - protein, 364 aa, Mycobacterium avium subsp. paratuberculosis K-10
MVQQLVFSEPRPGKPPRHLADLDADGRASAVAELGLPAFRAKQLAHQYYGRLIADPRQMTDLPAGLRDAIADTMFPILLTAASEVTCDAGQTRKTLWRALDGVTVESVLMRYPHRNTVCISSQAGCGMACPFCATGQGGLSRNLSTAEILEQVRAGAAALRDDFGDRLSNVVFMGMGEPLANYARVVAAVRRIVAAPPQGFGISARSVTVSTVGLAPAIRKLADERLGVTLALSLHAPDDELRDTLVPVNNRWKIAEALDAARYYADVTGRRVSVEYALIRDVNDQPWRADLLGRRLHRALGPLVHVNLIPLNPTPGSQWDASPKPVEREFVRRVRAAGVSCTVRDTRGREISAACGQLAAEGG

SEQ ID NO: 33005 - protein, 402 aa, Staphylococcus aureus subsp. aureus MW2
MAQDRKKVLVLGAGYAGLQTVTKLQKAISTEEAEITLINKNEYHYEATWLHEASAGTLNYEDVLYPVESVLKKDKVNFVQAEVTKIDRDAKKVETNQGIYDFDILVVALGFVSETFGIEGMKDHAFQIENVITARELSRHIEDKFANYAASKEKDDNDLSILVGGAGFTGVEFLGELTDRIPELCSKYGVDQNKVKITCVEAAPKMLPMFSEELVNHAVSYLEDRGVEFKIATPIVACNEKGFVVEVDGEKQQLNAGTSVWAAGVRGSKLMEESFEGVKRGRIVTKQDLTINGYDNIFVIGDCSAFIPAGEERPLPTTAQIAMQQGESVAKNIKRILNGESTEEFEYVDRGTVCSLGSHDGVGMVFDKPIAGKKAAFMKKVIDTRAVFKIGGIGLAFKKGKF

SEQ ID NO: 33006 - protein, 548 aa, Sulfolobus tokodaii str. 7
MFKHINPDCMQDFVWPPEGEFDEIIELPTTCPVCGKAGQFKLIEDRSEFIDWQKAVIQERPEEIPPGQLPRQLEVVFEDDLVDSARPGDRVKIVGILEIKKDSQIKRGSKAIFDFYLKVNSIEISQKVLDEVKISEEDEKKIRELSRDPWIREKIISSIAPSIYGHWEIKEAIALALFGGVPKIMEDGTRVRGDIHVLIIGDPGTAKSQILQFAARVAPRAVYTTGKGSTAAGLTATVTRDKNTGDYYLEAGALVLADGGVAVIDEIDKMREEDRVAIHEAMEQQTVSIAKAGIVAKLNARATVVAAGNPKLGRYIAERGIAENINLPPTILSRFDLIFILIDKPGVEDQLLASHILNVHAGKTKSTEIIDVDLLKKYIAYARKNVFPKLSDEAKSLLQDFFVEMRKKSSESPDSPIIITPRQLEALIRISEAYARMALKNEVTREDAERAINIMRIFLENVGLDVESGKIDIDTIMTGKPKSAREKMARILEIIDTLAGTNECAKVKEIVKEAEGIGIDKASVEKLLTDMRKQGLIYESRPDCYRKV

SEQ ID NO: 33007 - protein, 415 aa, Glycine max
MATLSDHRRRMLPPENVDAQPITSDSVSNNHRTTHRRDAGNNGLRHRLVRQESLRRNIEHVAAETYLVSRLAFTLLRYLGIGYRWITQLLALGCYAMLLMPGFLQVAYYYFFTSKVKRSIVYGDQPRNRLDLYLPANIGEPKPVLIFVTGGAWIIGYKAWGSLLGLQLAERGIMVACIDYRNFPQGTISDMVNDTSRGISFIINNIANYGGDPNRIYLMGQSAGAHISSCALLEQAARESEKEDSVSWSISQLKAYLGLSGGYNLLDLVDHFHNRGLDRSIFLSIMEGENSLKEFSPEIKIQDPCLKSSIPHFPPVYLVHGTADYSIPSVASERFAEALKKAGVRAELILYEGKTHTDLFLQDPLRGGKDDLFDLAVAIMHSNDSDALANDAIAPPRRRFVPEILLKLARKISPF

SEQ ID NO: 33008 - protein, 530 aa, Nostoc sp. PCC 7120
MLTKKESISQVIVTAAQMREIEGRIFAAGMPVPALMEKVAGLIASRIQDFSSNFEQGRQREQVRILPPFPCVGILVGPGHNGGDALVVARELHFRGYAVWVYLPFDKLKELTSQHLQYAQSIGIPCYGEIEQLPDCDVLVDGLFGFGLERTITDPIASVINQLNEWNKPIISIDLPSGLHTDTGEVLGTAIRATYTLCLGLWKQGLLQDQALDYVGKAELIDFDIPWADVQAVLEDVPKVKRITPATALSTLPLPRPPVTHKYKEGHLLLICGSRRYAGGAILTALGARGSGVGMLSIAVPESLKQLLVSHLPEALVIGCPETESGAIAQLQLPEKTELSSFSAIACGPGLTKDATSIVEEVLASDRPLVLDADGLNILAQLGTIPTLQQRPAVTVLTPHTGEFQRLFPDVADAKHDRVKAVQEAATQSGAVVLLKGARTAIANPQGSVWINPESTPALARGGSGDVLTGLLGGLLAQVANKEIPVEDIVATAAWWHGQAGILAASERTELGVDAFTLSQYLLKVIVGRS

SEQ ID NO: 33009 - protein, 170 aa, Oryza sativa (indica cultivar-group)
MASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 33010 - protein, 515 aa, Oryza sativa
  misc_feature (342)..(342): Xaa can be any naturally occurring amino acid
MDAGAEPLLPPPASAVDHLGRPASRRTSGRWLAALFIIGVEISERFAFGGISGNLITYLTGPLGQSTASAAAAINAWNGAALLLPLLGAAVADSWLGRYRIIICASLLYILGLGMLTLSPVLVPHQQAESGDNADNNASSSMDIHVAFFYLSLYIVAFAQGGHKPCVQAFGADQFDENDPEECASRSSFFNWWYFGIYGGNVITVSILNYIQDNIGWQLGFGIPCIAMSLSLAVFLLGTKSYRFYPLRSNTSLFDQVGKSLLAKIRWWCASWCSKSSGDLHCTQASSSQGDHNDAEKACFPDEATAVLKLFPIGATCLIYAIVFAQWITLFTKQASTLDRWXRRYSKNPRGITTLQRIGIGLIISVILMVVSALVETRRLMVARDFGLVDNPEATIPMSFWWVVPQFILTGLADMFTMVGLQEFFYDQVPDGLRSLGLALYLSIFGIGSFISSFLVYAIDKVTSMTGDSWFSDNLNRGHLDYFYWLLAVLSVLGLAAYLHFSRVYVHKKKGISVQ

SEQ ID NO: 33011 - protein, 480 aa, uncultured archaeon GZfos1C11
  misc_feature (121)..(121): Xaa can be any naturally occurring amino acid
  misc_feature (266)..(266): Xaa can be any naturally occurring amino acid
MRRGKNVKMAGQLGGIPILVLKAGSERTRGKDAQIANINAAKAVGDAVRTTLGPKGMDKMLVDSLGDVVITNDGVTILKEMDIDSPAAKMMVEVAKTVEDVAGDGTTTAVVLGAELLKKAXELLELKLHPTVITLGYRLAAEKAKKVLDEIGKDIDIEDVKELKKIAETAITGKAADASRDFLAEIAINADKAVAEEVSKGKRVVDVDNINVEKKVGGRMSETELVQGMAIDKEIVHPGMPTKIEDAKIALINASLEVKKTEMSAXIKIQSSGQLKSFLAEEEQMLHQMAERIKESGANVVICQKGIDELVQHYLAKAGIAAVRRAKKSDMEKLEKATGGNVVNAVELISKTDLGYAGLVEERKISGSKMLFIEQCKNPHAVSIIVRGGTEQVVDEVDRSLDDTLRVVGCIIEDGKAIAGGGAVETEIALRIREYSTSLKGREQLAVEKFAEAMEIIPRTLAENSGLDPIDKLVELKSST

SEQ ID NO: 33012 - protein, 433 aa, Ralstonia metallidurans CH34
MTPSDVKATLSFSDGSPSVELPIYKGTVGPDVIDIRKLYGQTGKFTYDPGFMSTASCNSKITYIDGDKGELLYRGYPIEQLAQKCDHLETCYLLLKGELPNAKQKEEFVNSVMNHTMVHEQLQFFLRGFRRDAHPMAVLTGLVGAMSAFYHDAMDIDDPHQREISAIRLIAKMPTLVAMAYKYTMGQPYIYPQNDLSYSGNFMRMMFATPCAPYTVNPVLERALDRIFILHADHEQNASTSTVRLAGSSGTNPFAAIAAGVACLWGPAHGGANEAALKMLEEIGSVDNIGEFIKQVKDKNSGVRLMGFGHRVYKNYDPRAKLMRETCYEVLNELGLHNDPLFKLAMELEKIALEDEYFVSRKLYPNVDFYSGIVQRALGIPTSLFTCIFALARTPGWISQWEEMITDPEYKIGRPRQLFNGAAAREVPDLAKR

SEQ ID NO: 33013 - protein, 175 aa, Oryza sativa (indica cultivar-group)
MAPSVMASSATSVAPFQGLKFTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 33014 - protein, 299 aa, Oryza sativa (japonica cultivar-group)
MAERVTKALMRPLLCYIIVVAVAPAGCAAFNPRMLFLVKPDPIVLKDHHGVVLSGNVTVNVLYYGRFTPAQRAVVAGFVRSASAAQHPRVPSVAAWWSTTSLYRGGGARLRLGMQVMDERMSLGRSLSLDNVTALTRAAGHHRGAVTAVLTAPDVLVAPFCMSRARYAYLWAGNPAQQCPGQCAWPFHQPVYGPQAPPLVPPNGDVGVDGMVISLAALLAGTVTNPFGDGYYQGDAGAGMEAATACAGVFGSGAFPGYPGKLLKDPVTGASYNAVGLAGRKYLLPALWDPTTSQCKTLV

SEQ ID NO: 33015 - protein, 300 aa, Oryza sativa (japonica cultivar-group)
MAKKQSLLLAMMLVVAGLAVSAMADRKLMSLVKPQPNQLTYHNGAVLSGDIPVSILWRRRRRRCRSGGVVFTGCTSPRRWPSARTGARTAAAAAAGAKNARVVLSGQVSDEGCSLGKTLKLSQLPTLAARARPGKGGVALVLTAQDVAVEGFCMSRCGTHGPVSRAGAAYAWVGNSATQCPGQCAWPFHQPVYGPQAAPLVPPSGDVGMDGMVINVASMVAGAVTNPFGDGFYQGERGAALEAATACTGVYGKGAYPGYAGALLVDKATGASYNAHGAHGRKYLLPALFDPDTSACSTLV

SEQ ID NO: 33016 - protein, 322 aa, Oryza sativa (japonica cultivar-group)
MASCMMIPIIVLILVSMAANALADDRRQLQLMQDPAAGDVLSYHGGAVLSGDIPVSIVWYGKFAPSQKDIVVDFVQSLTSTSSSSQRAATPSAAQWWSTLATVYLSNATTGGGGKPAAATRVVLSGQVSDEEYSLGKTLTLVQVFQLAAGAAPKRGAVVLVLTDPDVVVEGFCSVRCGVHGSDAGARVRLRLGGERRAPVPPDSARGRLRRRPYGPQGSPLGAPNGDVGTDGMVVTLASTLAGAVTNPFGDAYYQGDKDAALEACTACAGVYGSGSYPGYAGKVLVDEANGGSYNAIGGGGKRFLLPAIYNPATTGCCSTTV

SEQ ID NO: 33017 - protein, 479 aa, Zea mays
HVSPSIGQKQHQPPGRLPRLRLYATHERRGSNAKKKRPQRPLHRPITRRRAMAAAAGDSVKQPLLHRAYPSHAASASSPALPSVPPGAGGRRFPGGLDVPNLKKRGGGTRSWIRVEAVTASVQTLEIDKATMMRRCELPARDLRLLDPLFVYPSTVLGRERAIVVNLEQIRCVITADEVLLLNSLDSYVLQYAAELQRRLLQRAEGDQLPFEFRALELALEAACSFLDAQAAELEIEAYPLLDELTSKISTLNLERVRRLKSRLVALTRRVQKVRDEIEQLMDDDGDMAEMYLTEKKMRMESSVFGDQSLLGYNSAGAVGASVSAPVSPVSSPTESRKLEKSFSLCRSRHDSTKGSDNTMTEHIQELEMLLEAYFVVIDSTLNKLTSLKEYIDDTEDFINIQLDNVRNQLIQFELLLTTATFVVAIFGVVAGIFGMNFETSVFEIENAFQWVLVITSVTGVFIFCSFLWFFKYKRLMPL

SEQ ID NO: 33018 - protein, 622 aa, Streptomyces avermitilis MA-4680
MPATPNNVPEPSRTDPALIRNFCIIAHIDHGKSTLADRMLQLTGVVDQRQMRAQYLDRMDIERERGITIKSQAVRLPWAPTQEPGNTHILNMIDTPGHVDFTYEVSRSLAACEGTVLLVDAAQGIEAQTLANLYLAMENDLKIIPVLNKIDLPAAQPEKFSEELANLIGCDPEDVLKVSAKTGLGVEALLDKVVAEVPAPVGVADAPARAMIFDSVYDSYRGVVTYVRVIDGQLNKRERIRMMSTGATHELLEIGVSSPEMKPADGLGVGEVGYLITGVKDVRQSKVGDTITTLNKGATEALGGYKDPKPMVFSGLYPLDGSDYPELRDALDKLQLNDAALVYEPETSAALGFGFRVGFLGLLHLDVIRERLEREFGLDLIATAPNVVYRVLMEDGSEHTVTNPSEFPEGKISEVYEPVVRATILAPSEFIGSIMELCQTRRGTLLGMDYLSEDRVEIRYTLPLAEIVFDFFDQLKSKTRGYASLDYEPTGEQASSLVKVDILLHGDKVDAFSAITHKDAAYAYGVRLVAKLRELIPRQAFEVPIQAAIGSRVIARETIRAIRKDVLAKCYGGDISRKRKLLEKQKEGKKRMKMVGSVEVPQEAFIAVLSSDDSGGSAKGKK

SEQ ID NO: 33019 - protein, 300 aa, Oryza sativa (indica cultivar-group)
MASQQFPPQKQETQPGKEHAMDPRPEAIIQSYKPANKLKDKVAIVTGGDSGIGRAVCLCFALEGATVAFTYVKGQEEKDAEETLRALRDIRARTGAKDPMAIPADLGYDDNCRKVVDEVAGAYGGAIDILVNNAAEQYERPSITDITEDDLERVFRTNIFSYFFMSKHAVKRMRDRRGGAGAGGCSIINTSSINAYKGNKTLLDYTATKGAIVAFTRALALQLAEEGIRVNGVAPGPIWTPLIPASFAEEKVRQFGSQVPMGRAGQPSEVAPSFVFLASDDASYMSGQMLHVNGGVIVNG

SEQ ID NO: 33020 - protein, 638 aa, Lupinus albus
MGYYSIYCLIVLVNVLVFCDGGKTSSFVRESERAIDMALDSDVFHVPRGYNAPQQVHITQGDLVGKAVIVSWVTVDEPGSTKVSYWSDKHSHDKKSAHGKIVTYRFFNYTSGFIHHTIKHLKYTTKYHYEVGSWNTTRHFWVYNFPIQFGLDVPCTFGLIGDLGQTFDSNQTLTHYQHNPRKGQAVLYVGDLSYADNYPNHDNVRWDTWGRFTERVVAYQPWIWTAGNHELDFVPEIGETKPFKPFTHRYPVPFKPSESTEPFWYSIKRGPAHVIVLASYKAYGKYTPQYQWLEAELPKPKVNRKETPWLIVLVHSPWYNSYNYHFMEGETMRVMFESWLVQYKVDVVFAGHVHAYERSECVSNVEVRHCKWQVYPCKDQSAPVYITIGDGGNIEGLANNMTEPQPKYSAYREASFGHAIFDIKNRTVLGLFSENYRLHTKQEEDEKNLASKGAMVKGVILQQVVQAVVATLLFAVTGNDSQDTNQNASLLVSARQFVIAMLVIDTWQYFMHRYMHHNKFLYKHIHSQHHRLIVPYSFGALYNHPLVGLILDTIGGALSFLISGMSPRISIFFFSFATIKTVDDHCGLWLPGNLFHIFSTTILLTMMFTISFSATSTTTHSHSLLCGIKSWVPTCLTH

SEQ ID NO: 33021 - protein, 325 aa, Arabidopsis thaliana
  misc_feature (138)..(138): Xaa can be any naturally occurring amino acid
  misc_feature (295)..(295): Xaa can be any naturally occurring amino acid
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTXVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPXKIHERSPIFLGSYDDVEEIKALYAEEEKKN

SEQ ID NO: 33022 - protein, 449 aa, Gibberella zeae PH-1
MGQEESSMGYSGPPVTLSERSLAAVAASIKSGRSKNIVVLTGAGISTAAGIPDFRSPGTGLYANLARLNLPYAEAVFDISYFREHPEPFYVLANELYPGKFHPTVSHAFIALLARKNLLQMLFTQNIDCLERVAGVPSDRIIEAHGSFAKQRCIECKEEYPGDKMKEHVFGGKVPHCDKEGCKGLVKPDIVFFGEPLPKAFDNNTFQVAMADLVLVVGTSLSVYPFAALPGLAQEGKPRVLFNMEQVGQLGSRSDDVIELGDCDAGIRKFADELGWRDELEALWREIVGDAEADRQNSGREKEAVQDEVERLAAEVGAVVIDDGEGKADAKLEDTKKDVLSYNAPAKLDEEKPKTGHNISEPAADTSSTTATEDKTKESPKTEQLKPENLEKIEAEATKTESLVTEPPRSPPSEEQTSQTETQTETSKDEPTAEPTDSTTKEGESKSTL

SEQ ID NO: 33023 - protein, 249 aa, Brassica napus
  misc_feature (211)..(211): Xaa can be any naturally occurring amino acid
  misc_feature (234)..(234): Xaa can be any naturally occurring amino acid
MSNYSAGLGKPGSGKRRIRDLLNQPDNRVCADCGAPDPKWASANIGVFICLKCCGVHRSLGTHISKVLSVTLDDWSDEEVDSMIEIGGNASANSIYEAFVPEGSSKPGPDVSHDQRLRFIRSKYELQEFLKPSLRITSGKTTSTKKPPSFLSSSLSTKFMDSFRTNSSSKKIFEEGMVEFIGLLKVTVKKGTNLAIRDMMSSDPYVVLNLXGKQKLQTTVVNSNLNPVWNQELXLSVPESYGPVNLQCM

SEQ ID NO: 33024 - protein, 74 aa, Solanum lycopersicum
VERSTAYQPWIWTAGNHELDFAPEIGETKPFKPYTHRYHVPFRASDSTSPLWYSIKRASAYIIVLSSYSAYGKY

SEQ ID NO: 33025 - protein, 986 aa, Oryza sativa
MQMLLHANSLLLLAPTTSRLSASASPGRSGTARPLPPPQGTRIPPAPPLAGHGGRPPSPQPRRGRDGVGEECAAAVASQGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYPENQYYLYEVKVYHPSTSQVEKCLADDPYARGLSANGTRTWLVDINSETLKPASWDELSDEEPNLESFSDISIYELHIRDFSAHDSTVDCNSRGGFVHLHFRLFRLNLLNDFCSPPITKHPGRIMETVMQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLTVDDLLNWAINYKVDGFRFDLMGHIMKSTMIRAKSAIRSLTRDVHGVYGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDGECRINHLASSMIALSQGIPFFHAGDEILRSKSLDRDSYNSGDWFKKLDLHMNQPIGCRLLQEIRMKNMHLIKPRLENPSFRPLKNHILSCFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 33026 - protein, 251 aa, Francisella tularensis subsp. holarctica
MSNSNVDFSSVATLYQKARPSVPVEIINFLKQKIPSNQKAWDCSTGNGQIAIKLAEFINEIHATDISSAQLAKAFKHNSIKYFKADEANSMFADRCVDLITVSQVAHWFDMSKFEKECLRILKPNGIVAIWAYHHNISVNTAVEIIYQEFYRTIRPYFPQGREHIDNFYKDINIDLPKLDSPEFRQTKEMNFDDFIEYLKSFSAYAEYLRNHNKCPIVKLGFYDKFRESWGDSKKVYTVVWPIIFKCYINK

SEQ ID NO: 33027 - protein, 435 aa, Schizosaccharomyces pombe 972h-
MVSEISDLSLAKEKSEAQFIARNPKSNDFHCKACDSLPGGNTRTVLHGAPFPIFIEAGYGSKLRDVDGHEYTDFLNELTAGIYGHSNPVIKKALMQGFDEIGISLGGTTTCELNYAEALKSRFLSIEKIRFCNSGTEANITAIIAARKFTGKRAVIAMHGGYHGGPLSFAHGISPYNMDSQDFILCEYNNSTQFKELVNSSQDIAAVIVEAMQGAGGAIPADKEFMQTIQLECEKNDIVFILDEVMTSRLSPGGLQQIYCLKPDLTTLGKYLGGGLPFGAFGGRADIMSCFDPRLPGSLSHSGTFNNDTLTLTAGYVGLTELYTPEAVKRLNALGDGLRKDIESYCHNTKMSITGLGSIMNIHFTESGRVNSYNDTAGEVIELKDLLWMDLLKEGFWIARRGMITLSLVLTESELEAFKLTIKAWIHRRMSLIRI

SEQ ID NO: 33028 - protein, 314 aa, Aspergillus oryzae
MASPTTKESQAAMDFLHHPYTRAALPFINGGLAGMTATTVIQPIDMIKVRLQLAGEGVRTGPRPTAFGVARDIIAGGKILDLYTGLSAGLLRQAVYTTARLGFFDTFSKTLNKRAEAANRKITFAERAGAGLTAGGIAAMIGNPADLALVRMQSDGLKPLEARANYRSVVDALFRISKNEGIPALWAGALPTVVRAMALNVGQLTFFAESKAQLKAHTSLSAQNQTFAASAIAGFFASFLSLPFDFIKTRLQKQQKDPKTGQVPYKGVLDCARKVAKDEGWLRFYRGFGTYYVRIAPHAMVTLIVADYLNLITK

SEQ ID NO: 33029 - protein, 218 aa, Picrophilus torridus DSM 9790
MFENEKRMAAMEALKFVRNDMRIGIGTGSTAYYFIEGLSELVKNGLRITGIPTSKKSEELCRSFNIPVDYNIKDIDIDFDGADEFDPYGNLIKGGGGALVREKIVAYNSREFYVLVDHSKYSERLHKFPLPVEVLPFMSEKTLENIERLGCRASFRDDKKFISDNGNYIIDCVFSYTDPELESQIKMIPGVVEVGIFRHLSTKIFQGTIDGCRIIDVK

SEQ ID NO: 33030 - protein, 296 aa, Oryza sativa (japonica cultivar-group)
MVAALVVMSLAGVSMAARRVPALLKSHVGDGISYHGGAVLGGDIPVTLVWYGKFKPAQKAIVVDFLLSLTATPPNATTPSAAQWWGAIAAGYLSSNATNVTTAARVVLANQTSDEEYSLGKSLTLVEVFQLAAGVVPDRGNLVVGFCSARFGVQGSDARRRVTAYAWAGDAERQCPGQCAWPFAKPPYGPKGEAALVPPNGDVGADGVVATLAGVLAGAVTNPFGDGYYLGDKDAALEACSACAGAYGSDSYPGYAGKVLVDETTGGSYNAVGAHGRKYLLPAVYDPATSRCTTLV

SEQ ID NO: 33031 - protein, 313 aa, Oryza sativa (japonica cultivar-group)
MGSLPVSSPECAPGRRVTVAASDLAPLFGAQRRHLDHFFDRLDLSQAAAFAQALVDAPGAVFFTGVGKSGIVARKLAQTLASPRSGASDELLALAPCARAKGAHLISLTSAASGADCPLAAVCDLNVHLPLQAEVCPFGLAPVTSTAIQMVFGDTVVAAIMEARRLSRDQYASNHPAGKIGKSLIFKVKDVMKKQNELPLCKEGDMIMDQLTELTSKGCGCLLVVDDEYHLIGTFTDGDLRRTLKASGQAIFNLTVGEMCNRHPRTITADAMAVQAMEKMESPPSPVQFLPVVDSNNVVCGIITLHGLVSAGL

SEQ ID NO: 33032 - protein, 293 aa, Nostoc sp. PCC 7120
MDLYSSIFRCLCIVEAQVNSYMTNTVIITGASQGIGKATALLFARHNYNVVLAARQLDRLEAIATEIREMGQQAIAISTDVKDATQVNNMMQKAIAHFGQVDVLINNAGIFCLGSVENFSLEDWHQIIDTNLWGYIHTIHAILPHFLQRGAGTIVNVSSIGGLEPIPYHVPYTASKYAITGLTKSLHAELSPKNIHVSGIYPSFISTQLMERAIFRGKDEEMAQARTELVGKAIQMPVLEKPEDVAKAIWSAVKEKRSDVVVGSANFWKAAYQLTPSLIQSLVRRVFGMEERK

SEQ ID NO: 33033 - protein, 442 aa, Nostoc sp. PCC 7120
MMRNRRVVIVGAGFGGLQAAQSLAHSGADVLLIDRHNYHTFVPLLYQVATGQIEPEYIAYPIRTILRRFSFNYRRQHHKPQVQFLMAEVEQIDFSGQIVKTAKGAIDYDFLVLATGSRTQFWGVNGAEEYAFPMRSLEEAVALRNHIFSCFEQAIQESDAAKRQQLLTFTIVGGGATGVEMAGALVEMLRGCLRRDCPTIDFGEVKIILVQSGDRLLVEFPKKLGNYTYKKLHQLGVEVYLQTRVSQLTEGFVHLDNAEIIPCASVIWTAGLEANLPGVSEELPVAHKGKIVVHPTLQVLEHPNVYAIGDLAYVEKNGKSLSGVAPEALQQGVAVARNIQQQIRGKSPKPFSYFNKGRLAIIGCYSGVGKIGAFAFTGFLAWLMWLGVHLVYLPGYRSRLLVLLTWLHTYLGSDRHVRVILSSKTMSVLHRPADLPYLQESR

SEQ ID NO: 33034 - protein, 222 aa, Solanum habrochaites
MNIFETYNSDSLISTESSSSSSSSSSSLFSEEEIILASNNPKRPAGRKKFRETRHPIYRGIRKRNSGKWVCEVREPNKKTRIWLGTFPTAEMAARAHDVAALALRGRSACLNFSDSAWRLPIPASSNSKDIQKAAAEAAEIFRPLKESEEVSGESDNSTSPETSENVQESSDFVDEEAIFFMPGLLANMAEGLMLPPPQCAEMGDHYVETDAYMITLWNYSI

SEQ ID NO: 33035 - protein, 331 aa, Arabidopsis thaliana
MGNKNSMCGLKRFPNYKKSPIGSFAKNSSSHDGIKTIEAVNSCSFSRKADLCIRIITWNMNGNVSYEDLVELVGKERKFDLLVVGLQEAPKANVDQLLQTASSPTHELLGKAKLQSVQLYLFGPKNSHTLVKELKAERYSVGGCGGLIGRKKGAVAIRINYDDIKMVFISCHLSAHAKKVDQRNTELRHIANSLLPRDKRKRDLTVWLGDLNYRIQDVSNHPVRSLIQNHLQSVLVSKDQLLQEAERGEIFKGYSEGTLGFKPTYKYNVGSSDYDTSHKIRVPAWTDRILFKIQDTDNIQATLHSYDSIDQVYGSDHKPVKADLCLKWVNS

SEQ ID NO: 33036 - protein, 512 aa, Nicotiana attenuata
MDGSTVQGGSSVESFLRNYKLGKTLGIGSFGKVKIAEHTLTGHKVAVKILNRRKIKNMDMEEKVRREIKILRLFMHPHIIRLYEVVETPSDIYVVMEYVKSGELFDYIVEKGRLQEDEARKFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMYTLPSHLSAGARDLIPRMLIVDPMKRMTIPEIRMHPWFQAHLPRYLAVPPPDTMQQAKKIDEDILQEVVKRGFDRNSLVASLCNRVQNEGTVAYYLLLDNRFRASSGYMGAEFQETMEYGYHQINSSEAVASPVGQHLPGIMDFQQVGARQFPVERKWALGLQSRAHPREIMTEVLKALQGLNVRWKKIGPYNMKCQWVPGVPGHHEGMSNNSIHNPFFGDDSTIIENGGVTIPNAVKFEVQLYKTREEKYLLDLQRVQGPQFLFLDLCAAFLAQLRVL

SEQ ID NO: 33037 - protein, 510 aa, Solanum tuberosum
MKIATRFSHSIPKLVCLDNGDQDGLLISTKFLNKIIRIDEENMMITVESGVTLRQLISEAGKAGLVLPYTPYWWGLTIGGLIGTGAHGSSLWGLGSSVHDYIVQLRIVTPADAANNYAKVRILENGSPDLNAVRVSLGVLGVVSQVTLKLERVFKRSITFSERDDSNLGEDAVTFGRQHEFADFTWYPSQRKVIYRIDDRVPNGTPGNALNDFLGFRPTDQNLLAIFRTLEEIQESTNDAGGKCAVAIISTSILKYLSYGWRNNGTGYPMVGFQNQVQASGTCLDSLEGATCPWDHRVKGLFFHQTTFTISLSKVKGFIEDVQRLVALEPKALCVLDLYNGILMRYVTTSNAYLGKQEDSLDFDITYYRSKDPMSPRLFEDFLEEIEQLAFFKYGALPHWGKNRNVAFIGAINKYKNVDKFLQVKQSYDHLGLFSSEWTDQVLGLKDGLSIVKEGCALEGLCICSKDIHCAPNKGYFCRPGRIYKDARVCTNPSLSTIDIQTRKTICTSM

SEQ ID NO: 33038 - protein, 179 aa, Synechococcus sp. CC9311
MRSRLTITALALLAGLAAAPVQVFAQSSDGTNSSVSKVLASSGAGFNVAAVRTLLNRGDSAVASGNLDQAKTDYDNARTAAKQLLAFYRDLSGAFRGLDARIPREMDSKGREALSLLAQANLRLAALFRRQNQPEVAVPVLVEVVRLMTPASNEGQKAYQSLVELGFVETPFAGAKSAK

SEQ ID NO: 33039 - protein, 537 aa, Oryza sativa (japonica cultivar-group)
MGYLPSLGGKAAHLVSDLATVILNPVSERESQRHPSHLPEATEVQENIYEDDDDDNSVKNSEIPNGPDTSSFRAFLMSFMSSSNSSSDSIEIIPEHNMNMEYPTLTPVGKGSNGRKGLFSRGKHSIGKIINKAGRIGGFRQKPSYSIDGETVQTEYDAPGLELKGSKESASHDKLPAMSEPSMLLSETMRTVLYTSLPVLVQGRNWMLEATEVQENIYEDDDDDNSVKNSEIPNGPDTSSFRAFLMSFMSSSNSSSDSIEIIPEHNMNMEYPTLTPVGKGSNGRKGLFSRGKHSIGKIINKAGRIGGFRQKPSYSIDGETVQTEYDAPGLELKGSKESASHDKLPAMSEPSMLLSETMRTVLYTSLPVLVQGRNWMLVYSTWRHGISLSTLYRRSMLCAGYSLLIVGDRKGAVFGGLVEAPLQPLIKKKYQGTNNCFVFTNIAGRPVIYRPTGANNYFTFCSTDYLAMGGGGHFALYLDGDLLNGSSSTSETFNNPCLSRSREFEVKDVELWGFVNASKYDEMLTICRTEKQGIWNL

SEQ ID NO: 33040 - protein, 351 aa, Pneumocystis carinii
MTASSRNVRFNVSDDYEILDVIGEGAYGIVCSAIHKPSGQKVAIKKISPFDHSMFCLRTLREMKLLRYFNHENIISILDIQQPQDFESFSEVYLIQELMETDMHRVIRTQDLSDDHCQYFIYQILRALKAMHSADILHRDLKPSNLLLNANCDLKVCDFGLARSAVSTEDSSSFMTEYVATRWYRAPEIMLTFKEYTKAIDIWSVGCILAEMLSGRPLFPGKDYHHQLMLILDVLGTPTMEDYYGIKSRRAREYIRSLPFKKRVSFASIFPRANPLALDLLEKLLAFNPAKRVTAEEALQHNYLEPYHDPDDEPTAPPISPSFFDFDRIKDSLTKNDLKILIYKEIMSMNN

SEQ ID NO: 33041 - protein, 381 aa, Zymomonas mobilis
MSKNGRPDRIVVVGGGAGGLQLVRALGERFGKEADVILVDRSPTHVWKPLFHEVATGALDADLDEVSYRYHGKHWGYHYVRGTLEDIDRKNHEIILEPLVDEEGHKISDQERLRYDYLVLALGSVANDFNTPGVRENCLFLDSRAQADRFREHLFDACASASRTMIAQPGMEKPVRVTVIGAGATGVELSAELYNTAIELGNFGLEKFGANCMQVTLVEAAPRILAPLPEFMAEDAHTVLQRLGVDIKTNTMVVEAGEGFIKTKDGQTIESDIQLWAAGVKAPDFLSKVEGLEVARSNQIIVKPTLQSTTDDRIFAMGDCCSCKLPEAERPVPPRAQAAHQMADTVFENIVRLRKGEPLKDFLIAIMARCFLLAGLPLLAI

SEQ ID NO: 33042 - protein, 378 aa, Streptomyces avermitilis MA-4680
MATDYYAVLGVRRDASQDEIKKAFRRLARELHPDVNPDPKTQERFKEINAAYEVLSDPQKKQVYDLGGDPLSQSGGGGAGGFGAGGFGNFSDIMDAFFGTASQRGPRSRTRRGQDAMIRVEIELDEAAFGTTKDIQVETAVVCTTCSGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHQTFQRRGDDLHCTVTIPMTAAALGTKVPLETLDGMEEVDIRPGTQSGQSIPLHGRGITHLRGGGRGDLIVHVEVTTPTKMDPEQERLLRELAKLRGEERPTGQFQPGQQGLFSRLKDAFNGR

SEQ ID NO: 33043 - protein, 397 aa, Zymomonas mobilis
MKPKLPLNRRQNPVRIMFLRLLSEQPQVKRRPLSRPMISQQQWPNWMLPRRLWQPMMINMLSVLSVMIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITQKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQVPSMSIRAFPSLLARKPHQVKSLKKTWISQAI

SEQ ID NO: 33044 - protein, 117 aa, Streptomyces avermitilis MA-4680
MAGEPQDDCLFCKIVAGHIPATLVRETETTVAFRDINPQAPTHVLVIPKVHHPDAAALAAAEPAIAADVLREAGEVARDEKLESYRVVFNTGSGAGQTVFHAHAHVIGGRGMQWPPG

SEQ ID NO: 33045 - protein, 204 aa, Glycine max
MFSLFYGLWKYLFSKMELHVLILGIDKAGKTTLLEKMKSVYSNIEGIPPDRIIPTVGLNIGRIEVANSKLVFWDLGGQPGLRSIWEKYYEEAHAVIFVVDASCPSRFEDAKSALEKVLRHEDLQGAPLLILANKQDIPEAVSADELARYLDLKKLDERVSMFEAVSAYDGMGIRESAEWLVEVMERSKRTEMLRARAGAMGPGP

SEQ ID NO: 33046 - protein, 217 aa, Bacteroides ovatus
MNDNKLMNRAADNIRILAASMVEKANSGHPGGAMGGADFVNVLFSEFLVYDPENPRWEGRDRFFLDPGHMSPMLYSTLALTGKFTLDELKEFRQWGSPTPGHPEVDIMRGIENTSGPLGQGHTFAVGAAIAAKFLKARFDEVMNQTIYAYISDGGIQEEISQGSGRIAGALGLDNLIMFYDSNDIQLSTETKDVTVEDTAMKYEAWGWNVLSINGND

SEQ ID NO: 33047 - protein, 131 aa, Glycine max
MVRISVLNDALKSMYNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVREARVLGFFY

SEQ ID NO: 33048 - protein, 397 aa, Francisella tularensis subsp. holarctica
MASLNKKIQNVSTSPTNAMAALAKQIKDQGNDVISLAIGEPGFSTPDIIKAAGIEAINKDITKYTNVDGLKELREAIVARYKREYGIEFAADQVCVTSGAKHSLHNIFNCILEAGDEAIFFAPYWVSYPDMIALTGAKPVVVETKFENNFEIDVTDLEKHITAKTKAVIINSPNNPTGLIYSKKCIEDLANLLRKYPNIWIIGDDIYDQLYFKDRVTLITEVAPDLADRYVIASGVSKNFAMTGWRVGFTIAPKLLNDALKKFQSQSATCACSISQYAAITAMNMPAQDLQYFVESYKQKAQFITKYLEAMPYIDVKSAEGTFYLFPDLRKLLEHTNFSTDVELCNALLREEYVAMMPGVAFGLSGFARISCANEMPELEEAMTRVARFINKHVSTK

SEQ ID NO: 33049 - protein, 388 aa, Bacillus clausii KSM-K16
MEMFSKSVKKGVAVFALAAVTISLISIFFVQSWRYTEAGKVPPKTAVLLHAVNNRLLPEGKLEAPAFLAVKAPPTIERHQVTVPTRDGEDIPATVYQPIAAGPHPIIVYYHGGAFLEGYGDLDTHDNIIRSLAARTGAIVVAPAYRLAPTYAFPTAVNDSYDALTWAYEHADVLDGDRDRLAVAGDSAGGNLAAAVAIMSGEEGGPALSGQALLYPLATFEDTKFPSRDMYASGFYFLSRAVMEMAQQSYAPNEADWTSPYTSPLNAEDVSMMPSTLVITGEFDPLRDEGEALAKRLYNEGIYVQAQRFNGVMHGFISFYEVMERGDKGLQSAAAFLKEALNKELPEPQNSQPFAVEVIDGRDSWRDEAEAYVIGVYLLFKHMIQVFE

SEQ ID NO: 33050 - protein, 342 aa, Nostoc sp. PCC 7120
MTLLLAGDIGGTKTILRLVEISNSSELHNIYEESYQSGDFPDLVPMVQQFLVKANIPSHPEKACFAIAGPVVNNTAKLTNLVWFLDTERLAQELSIPFISLINDFAAVGYGIFGLNKQDLLTLQAGKHQPEAPIAIIGAGTGLGQGFLIKQGNQYQVFPSEGGHADFAPRNELEFQLLKYLLDKHDIQRVSVERVVSGQGIVAIYQFLRDRKLATESPEIAQVVRTWEQQAGQAEKTVDPGAAIGKAAVQGSDRLSEQALQLFIDAYGAEAGNLALKLLPYGGLYIAGGIAPKILPLIENSNFLLNFSQKGRMRPLLAEIPVHIILNQQVGLIGAALCAARL

SEQ ID NO: 33051 - protein, 437 aa, Aspergillus oryzae
MLQVPVREHTNVASTKAIILVGGPSRGTRFRPLSLDLPKPLFEVAGHPIIYHGLKALAKIPDIRDVYLVGYYDETVFRDFIKDSTKEFPQFRIQYLREYTSLGTAGGLYHFRDAILKGKPERIFVLNADVCCSFPLGEMLRLFEEKDAEAVILGTRVNNDAATNFGCIVSDSHTKRVLHYVEKPESHISNLINCGVYLFATECIFPSIRSAIKRRTTRPRLVSYPSSENLESSFVAAEEDSEKSEVLRLEQDILSDLADSNRFFVHETKDFWRQIKTAGSAVPANALYLQKAFQAQSDELTPPSATIVPPVFIHPSATVDPTAKLGPNVSIGPRAVVGAGARVKDSIVLEDAEIKHDACVMHSIIGWSSRVGAWARVEGTPIANGTHSTSIVKHGIKVQSITILGKECAVGDEVRVQNCVCLPYKELKRDVANEVIM

SEQ ID NO: 33052 - protein, 110 aa, Zea mays
  misc_feature (14)..(14): Xaa can be any naturally occurring amino acid
  misc_feature (48)..(48): Xaa can be any naturally occurring amino acid
  misc_feature (84)..(84): Xaa can be any naturally occurring amino acid
CPDYADHPVTTPPXKDRTLQHIETLITHFLQVSWGPVMPVNKSFHMIXSTNGINRYYLTSDGGTMSYRTRIRTPSFPHLQQIPXVIKGEMVADLIAYLRSIDFRMADVDR

SEQ ID NO: 33053 - protein, 351 aa, Oryza sativa (japonica cultivar-group)
MPGSSGRAPLFACRGAAAVSASSMLGGGGAAYQAAVGGARGAGCQLSGRAPAGSSRPCARRRRHGPPPPRSTPSTTRGRFEQVAAAASGKRVVVFLDYDGTLSPIVADPDMAFMSDEMRAAVRDVAEHFPAAIVTGRCVDKVQSFVGLPELYYAGSHGMDIKGPSSNEEEDTKILLQPAREFLPVINKAYKALMEKTKSTPGARVENNKFCLSVHFRCVDEKRWNPLAEQVKAVLRDYPELKLTQGRKVLEIRPSIMWDKGKAVEFLLKSLGFDDDRRDVLPVYIGDDRTDEDAFKVLRKRGQGLGILVSKCAKETDASYSLQDPAEVMEFLVRLVQWKLRRSSSAMRPRV

SEQ ID NO: 33054 - protein, 574 aa, Photobacterium sp. SKA34
MISGILASPGIAFAKALLLQEEEVVLNKALISADQIDNEIQRFFDARKKSSEQLEVIKEKARVTFGEEKEAIFEGHIMLLEDEELEEEIIALIKDKMSADYAIYSVIEEQAQTLESLDDEYLKERASDIRDIGSRFVKNALGINVINLSAISEEVILVANDLTPSETAQINLDYVRGFITDIGGRTSHTSIMARSLEIPAIVGTNDITSKVKSGDMLVLDAINNQVVINPTDDELNKFKAISDAHKAEQEELAKLKDLPAITLDGKQVEVCGNVGTVKDCDGVNRNGGEGVGLYRTEFLFMDRDSLPTEEEQYQAYKEVAEAMHGEPVIIRTMDIGGDKDLPYLDLPKEMNPFLGWRAIRISLDRREILRDQFRAILRASAHGKIRIMFPMIISVEEVRTLKAVIEEFKVELTAEGLAFDTDIEIGVMVETPAAAAIAHHLAKEVSFFSIGTNDLTQYTLAVDRGNELISHLYNPLSPAVLTVIKQVIDASHVEGKWTGMCGELAGDERATLLLLGMGLDEFSMSAISIPRIKKVIRNANFADVKAMAEHALTLPTAAEIEEHVEKFIAEKTIC

SEQ ID NO: 33055 - protein, 525 aa, Photorhabdus luminescens subsp. laumondii TTO1
MTTNIHQHRILILDFGSQYTQLIARRIREIGVYCELWAWDVTEEQIREFNPSGIILSGGPESTTAQGSPRAPEYVFNAGVPVLGVCYGMQTMSVQFGGKVEDSTEREFGYAQVEIKAESALFRGIQDSLNEQGKPSLDVWMSHGDKVTAIPEDFITIASTDTCPFAIIANEEKRFYGVQFHPEVTHTHQGQRILERFVLDVCQCEALWTPASIIEDTVVRLREQVGEDHVILGLSGGVDSSVTALLLHRAIGNRLTCVFVDNGLLRLNEATQVMEMFAGKFGLNIVHVPAEDRFLTALAGINDPEEKRKTIGRVFVEVFDEEASKQAQVKWLAQGTIYPDVIESAASATGKAHVIKSHHNVGGLPEEMKLGLVEPLKELFKDEVRKIGLELGLPYDMLNRHPFPGPGLGVRVLGEVKKEYCDLLRQADAIFIEELHKADLYNKVSQAFTVFLPVRSVGVMGDGRKYDWVVSLRAVETIDFMTAHWAHLPYDFLGRVSNRIINEVNGISRVVYDVSGKPPATIEWE

SEQ ID NO: 33056 - protein, 257 aa, Salinibacter ruber DSM 13855
MDLGLQDRTAIVTGASRGIGKYIAQALAREGCDVAICARTASDLDEAAAEVREEGAEVLALPMDVTEAGEPERLVEETYDRFGRIDTYVGNVGGNRRGSFEELSDEDWEDLMDLNFMSHVRVSRAAVPHMREVEGASICYISSIFGRELGGAGLSLYNTTKSALISVSKVMAQDLAPEIRVNSVAPGSIRFPGGSWDRRVKENPEEMEQFVEENIAIERFGRATEVADAVTFLCSERASLITGACINVDGGQSQSLI

SEQ ID NO: 33057 - protein, 172 aa, Staphylococcus epidermidis ATCC 12228
MDLKQYVSEVKDWPSAGVSFKDITTIMDNGEAYGYATDQIVEYAKEKNIDIVVGPEARGFIIGCPVAYSMGIGFAPVRKEGKLPREVIRYEYNLEYGTNVLTMHKDAIKPGQRVLITDDLLATGGTIEAAIKLVEQLGGIVVGIAFIIELKYLNGIDKIKDYDVMSLISYDE

SEQ ID NO: 33058 - protein, 443 aa, Oryza sativa (indica cultivar-group)
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNSNGLDIAKLMKHSSENRGIKGFDGGDAIDPRSLLTEECDVLIPAALGGVINKDNANEIKAKYIIEAANHPTDPEADEASTSDSIWQTNTPTATKCTICLKCFLSEFLLQILSKKGVLILPDILANSGGVTVSYFEWVQNIQGFMWDEEKVNNELKTYMTRGFRDVKEMCRSHHCDLRMGAFTLGVNRVARATVLRGWEA

SEQ ID NO: 33059 - protein, 744 aa, Candida albicans SC5314
MSYERIETIDNPFNDGNIIDNDTSTLFVTENNDDDDDNTITTTTTTMQKNNDDNQSSGFQESSNQDVTTVSSSSPSNSNNNITNNNNNNNRFSNQRNNNKDNFQKPTTNHNEFKDEDEEEEEEEDDDDMFEPIQFKNSDDDDEEEGDGLSSSSLSSDINSFTDNFGNSYHNIDFDNKRYTLKLNFKGKRLVYFTSGFVSLFVSLFGYSQGVVSSLLAFDTFNKYFNQPSAATIGIVISIQEIGAMISSIMVAKLSDKFGRKRTLLLGTFIFMIGGSLQAFCPNIFILAIGRVFSGMGVGILSTIVPSYQCEISPSEERGKLVCGEFTGNITGYALSVWVGYLSYFIQDIGDSRNQPHSFTANLSWRLPLFIQVVIAFVLFLGGFFIVESPRWLLDNDMDQQGFHVLALLYDSHVESTKPKSEFFMIKNSILQERITTPKSQRTWKHLLTHYKIRVFVACSSLIFAQFNGINIISYYAPLVFEQAGFDNANALLMTGINGIIYLLSTIPTWFLVDSWGRRPILITSGIAMAICLFLVAAFMHINKSYTPSVVAVFVIIYNASFGFGFGPIPFLLSSESYPLSVRSKGASLAVSCNWFSNFVVGLMTPILKQEIKWAMYLFPASSCVLSVIVVLLFYPETKGVELEDITRIFDEFYATSPTKRVKIRGLRTKRKDKGKRSGEKYKAKYNPLSGGGGTGTGTSSSTTTTGDFIDDQEAFEMRALNEFDFESDNDDDINVSHTRRQML

SEQ ID NO: 33060 - protein, 448 aa, Burkholderia mallei ATCC 23344
MTTVFHRAPRASLPIAVAGDGIEIVDSTGKRYIDACGGAAVSCLGHSNQRVIDAIKRQAQQLPYAHTSFFTTQPAEALADRLVAAAPAGLEHVYFVSGGSEAIEAALKLARQYFVEKGEPARRHFIARRQSYHGNTLGALAIGGNAWRREPFVPLLIEAHHVSPCYAYREQRADETEEAFAQRLADELESRILALGPDTVAAFVAETVVGATAGAVPPVREYFRKIRAVCDKYGVLLILDEIMSGMGRTGYLFACEEDGVAPDLLTIAKGLGAGYQPIGATLVSDAIYRTIVDGSGFFQHGHTYVGHASACAAALEVQRVIDEERLLENVKARGEQLRASLAARSAEQPHIGDVRGRGLFVGVELVRDRDTKAPFDPRLKLNALVKREAMQRGLMVYPMGGTVDGHLGDHVLLAPPFICTAPQIDTIVERLGDAIDAALASIGAAALR

SEQ ID NO: 33061 - protein, 162 aa, Mycobacterium avium subsp. paratuberculosis K-10
MSPAVAGRLGHFPPAARCARKPETIGRATASHPRVGGCRRPRPQGSVSHMNRLDFVDQASLRDDIPVFGPGDTVNVHVKVIEGAKERIQVFKGVVIRRQGGGVRETFTVRKESYGVGVERTFPVHSPNIDHIQVVTRGDVRRAKLYYLRELRGKKAKIKEKR

SEQ ID NO: 33062 - protein, 540 aa, Aspergillus oryzae
MAMLSADSPTASVMKDEQGRPFIVVRDQGKKKRQHGTDAVKSHIVAAKTVANIVKTSLGPRGLDKILISPDGDITVTNDGATILSQMEITNNVAKLLVELSKSQDEEIGDGTTGVVVLAAAMLEQASDLIDKGIHPIRIADGYDQACEIAVAELDKISDEIPFTKEDTSNLLKVAKTSLGSKIVSKSHDQFAKIAIDAVLSVADLERKDVDFELIKVDGKVGGALEDSMLVKGVIVDKDFSHPQMPDEVKDAKLAILTCPFEPPKPKTKHKLDITSVEEFKKLQDYEREKFTEMIQHLKDSGANLVICQWGFDDEANHLLLQNNLPAVRWVGGPEIELIAIATNGRIVPRFEDLNAEKLGTAGSVREMTFGTTREKMLVIEDCANSRAVTVFVRGSNKMIIDEAKRSLHDALCVVRNLVRDNRVVYGGGAAEIACSIAVEDAAVKSPGIEQYAMRAFADALDAVPLALAENSGLSPIETLASIKSRQVKEKNTRLGVDCMMTGNNVLDMREHFAIDPLIGKRQQLLLATQLCRMVLKKVD

SEQ ID NO: 33063 - protein, 1354 aa, Francisella tularensis subsp. holarctica
MNDLLNHSGEYPISKEIMNIYKYWLIDEKEAMTKLVEKAHMSSVQKAQVRERAYGLVEKVRKNRLKKSGIDAFMIEYDLSSEEGVVLMCLAEALLRVPDKYTIDLLIKDKLTSAAWKNHVGMEKHLFVNAATWSLMLTGKILKDPHRSYRKVFQNFLKKTSEPVIRQAMKQAMKIVGKQYVLGETIEEALKVSEAKVARGYSYSYDMLGEAAMTMDDAEYYYSQYLHAIHELAKYATNTEIKKNPGISIKLSALHPRYEVAKHQRVHTELYPKLLKLTQLAKDYNVGMNIDAEETERLQISLELVERLAHEPSLEGFNGIGIVVQAYQKRAPYVLDYLANLAKKTNRRFMIRLVKGAYWDAEIKHAQEQGLAGYPVFTRKYHTDVSYQACVKQLFENHQYIYPQFATHNAQTVAVVFELANGNRDFEFQCLHGMGDALYDNVVGKEGYEDIPCRIYAPVGGHKHLLAYLVRRLLENGANSSFVNRIVDENLPIEELIEDPVKKAIDHGCGQHPNIPYPKDIVSPRLNSQGHNTNDFAVLADMYKQIEKYTHKNTYKAKPIVSGIDLDKTITESVINPNTNEVIGSVINADAKIAKRALKNAQSAFEEWSNTPATKRADILEKFADLLEQDTNKFIAIAMIEAGKTLANAIDEVREAVDFCRYYAAQARKEFNGPIELPALSDHLKQIEFTGRGAMVCISPWNFPLAIFLGQITAVLAAGNTVVAKPAEQTPIIAYKAVKLLFKAGLPKNVLQFTPGDGATVGSALVKSPVCKGVIFTGSTEVAAIINQTLANKSSEIVPFIAETGGQNAMIVDSSSLPEQVTADVIRSAFDSAGQRCSALRILCLQEDIADNYIKMIVGAMKELKIGDSKYIDTDVGPVIDKEAADNLNAYIEEKKSQFKLIYQSQPNQDTQKGTFVMPTAFEIDKISDLGREQFGPILHILRFKANQLDKLINDINATGYGLTAGVHSRINEVMNYVKNNLKAGNIYVNRNIVGAVVGVQPFGGQGKSGTGPKAGGPYYMHRLANEKLSGVGAVEEIYNPEKIAEYEKQTNKLIKDKYTITNIVAGEKAKKDKYTNLKAANGKTIGKKYVASVNTVDNAIEIASKEVEIWNHVNAEQRAATIEKFLELLEKERYLIASSLVVESNISVEDAHIQIDKTIQQVAYYCLQAKKEFAHPQLLPGPTGEIDELSLKGRGVVVSMCSSSDLLIRFVGQTAAALLAGNTVVAKPAYTGNLTAYNIVKLMLKAGIDSKVLHLVLSDDEEITSALLFNSKVALVSFSGSVSAVKQVHQALVLRRGAIIPFVAESIAKNGKCTSLAIETASPLYLRRFVVEKTVSVDTTASGGNASLMSLEE

SEQ ID NO: 33064 - protein, 485 aa, Mesorhizobium sp. BNC1
MLKKTSHFLREANFIAGEWVNADSGATIEVINPATRQTIGTVPKCGRAETRRAIEAAQEAFQSWKKTSANDRAKLLRKLHDAIMDNQDALAELLVMEQGKPLAEAKGEVGTSAAYILWFAEEGRRIYGDIVPAPWTDRRILVTKEPVGVIGAITPWNFPSSMLARKLGPALAAGCTTVAKPASQTPYSGLAWGVLAEEAGFPKGVVNIVTGSASEIGDELTENPLVRKITFTGSTEIGKLLMEKAAGTVKKVSMELGGNAPFLVFDDADLDRAVKGAMIAKYRNAGQTCVCTNRFFVQDGIYDRFLEKFVEASRKLKVGSGLDEGVEQGPLIDGGAVEKVEELIADAVSKGGKVVTGGKRHALGGSYFEPTVIAEATPQMRFMEEEIFGPVAPVFRFKDEADGIRMANDTSFGLACYFYTSDLGRAFRVMEGLKYGLVGVNEGLITTVEAPFGGLKESGLGKEGGRQGIEDYLDTKYVCIGGLGL

SEQ ID NO: 33065 - protein, 383 aa, Listeria monocytogenes str. 1/2a F6854
MMNHSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVAETFQKRLEYIAKRVEKIPYLSLHPLKGSIYAFINISKTNMDSVSFTEYVLKETQVLVIPGLAFGESGDNYVRLAATQDISVLEEAFNRLAKLTF

SEQ ID NO: 33066 - protein, 177 aa, Oryza sativa
MGPLLLCTEILSYGVSVHLGIPCTLPCFSFYDRSAPIYTQPRYLPPSKVLDADVTDSVIGEGCVIRPCTINHSVVGLRSRISEGAVIEDSLLMGADYYETETDKKALSETGGIPIGIGKNAHIRKAIIDKNARIGENVKIINVDHIPEASRETDGYFIKSGIVTVIKDALIPSGTVI

SEQ ID NO: 33067 - protein, 1204 aa, Mesorhizobium sp. BNC1
MPALDALRDEIRKHYLADEDVLLRRLIESADLSPARREAISAKAAELVRAVRAGSTRHLMESFLAEYGLSTSEGVALMCLAEALLRVPDAETMDDLIADKIAPHDWSAHSGESASIFVNASTWALMLTGRVLDDEGNGIEATLRGMVRRLGEPVIRAAVAAAMREMGEQFVLGRTIAEAIKRGRAMTAKGYTYSYDMLGEAARTEADARRYFQAYRNAIAALKGEAKSEDIRANPGISVKLSAIHPRYEATQRERVMPVVTERLLLLAQDARAARMGLNIDAEEADRLDLSLDVIERVLADPSLEGWDGFGIVVQAYGRRAPFVIDWLYALAERLDRRIMVRLVKGAYWDTEIKRAQVMGLSSYPVFTRKVNTDISYIACARKLLSLTDRIYPQFATHNAHTVAAILAMAENRNAFEFQRLHGMGEALHDIIKRREGTRCRIYAPVGAHEDLLAYLVRRLLENGANSSFVHQIVDEEVSAEEIARDPFALAEAAGSAPNPAIPLPALIFGRQRINAKGWDITDETALREIETARRPFQAPHRWEGRPITRARGQGEARIIVNPARTSEIVGTVFDASPGQVSESVRLAVAAQPGWAATPVTERAEILRRIADLYEAHAGEFFALCAREAGKTLPDGIAELREAVDFLRYYANEAAQAEEGTGARGVIACISPWNFPLAIFTGQIAAALVTGNAVVAKPAEQTCLIATRAVALMHEAGVPEDVLHLLPGDGPSVGAPLTADPRIAGVCFTGSTEVARAIERQLAKTAAPDAMLIAETGGLNAMIVDSTALPEQAVRDILASAFQSAGQRCSALRILYIQKDVEARVTAMLRGAMQALTVGDPWQVPTDVGPVIDDEALSGISGYCEEMERKGRLLARIERPEGGRFVAPAAFQVSGIEEMEREVFGPVLHVATFEAEDLGHVISAVNAKGYGLTFGLHTRIDARVQEVVDGIHAGNIYVNRNQIGAVVGSQPFGGEGLSGTGPKAGGPHYLRRFRRGKAGPDLAPADAPAIAAEELVRAMPDAQKSGWADRTDRIVALRRALRGRWADVLASAAALDLGPVDLPGPTGEANTLQLAPRGRVLCLGADADALAAQVIQALAAGNAVLAVAKDAPAILQPLTRAGFPLAAFHGNVAPQTLETLALDLVAATGERQWLTAVRTALSAREGRIVPLVTELVYPAAYAHERSVCVDTTAAGGNASLLAAA

SEQ ID NO: 33068 - protein, 467 aa, Thermoplasma acidophilum
MLYGVCRRKHLIIDGYLFSMIMEDQERTERYNEDALRYSEYFKGKIQTISKVPVRSLDDFSIWYTPGVAAVSRKIASDPDLSFELTGRWNSIAILTDGTRVLGLGNIGPEAAMPVMEGKALIFNYLGGVNAIPIPIRVQSKEEFVKVAKALEPSFGGINLEDIESPKCFFLLETLQNEMNIPVWHDDQLGTASITLAGVINSLRIVGKKIDQVKVVFNGAGAANIAAAYLFKAAGFKMKNMILVDSKGILHPEREDIDALMINNPWKYQLAIETNGERVKGDLSNAIEGADLLISAAKSGPDTIDSRIVKKMNNDAIVFVLANPIPEMWPQEAKENGARIVATGRGDFPNQINNSLVFPGVFRGVLDARAKGVNFDVMVAASYEIANFVEDPTEEKIVPTMEEWELYPRLASAVASKTVELGLARKSDSKEGFYRRAREIIESNRNIYSKLMDLGLIKRMPNGEHKN

SEQ ID NO: 33069 - protein, 1134 aa, Oryza sativa
MADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVLRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICVEQCALLPEAEPSTGSKSGGRGGWPAAFFLLAAVFAERVGFNGVQGNLIMYLTGQLGMSTAAAAAGVNAWGGTAFMLPLLGALAADSWIGRPRAVVASGVLYLLVAAVCSSPAAAPAGRVAFCYVALYLLALGQGFHRPCVQAMGADQFSESNPGGLASRSSFFNWINFAVSCGYVLSTAGISYVQDNVSWGIGFGACWAMMLVSLFVFLLGTGTYRPEQPRTFAETRRGDAMDDTASTMDRRIVIGTGGGGGVLLVPPAALKSLVSFAVMVTIPAYDRALVPLARRVTKHPSGITTLRRVGTGMVTACLAMAVAALVEAARLRAARDAGLLDEPGVAVPMSVWWLAPQFVLLGVATTFTMVGLEEFFYDQVPDELRSVGVAACMSVVGVGSYASGMLVSATRSRGESWFSDNLNRAHLDYFYWLLAGISALDVLLIIKLQACNHTGEFFIKQNHNGIQAFVHIKALERECHSVTVLAMESGLLAHSDEPCDAGSKPDADADGRRGGWRAARFLIAVGFLERVGFNGVQSNLVMYLAGPMGMSTAAAAAGANAWAGTVLVLTLVGALAADSRLGRYRAIVAAGVLHLLIVRSRRINGYSDSQA

SEQ ID NO: 33070 - protein, 516 aa, Oryza sativa (japonica cultivar-group)
MDMLLCFVEIFSILCCCIIYYYHLQTKKASASEPTEWPVLGHLFGMFANIHRFHDWATDILAGGWHNFEARAGLTGIRFFITCDPSNVRHIFTSNFANYPKGDEYAEIFDVLGNGIFNADGESWRSQRAKAQMLMAGARFRAFAARSSRDKAEKSLLPLLAHAADTGARCDLHDLFLRLTFDVTCTLVFGVDTGCLSAGLPVIPFARAMDDVLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRATMASC

SEQ ID NO: 33071 - protein, 406 aa, Oryza sativa (japonica cultivar-group)
MIQFRRRILTLLLQPASPRPIAGIFLPPCSLRRLLSTTAPVSPKPFAVEDYLVAGCGLTRAEAAKASAKISHLSSPSNPDAVIAFLSDLGLPRPQIAAAIAADPRLLCADVEKNLAKRVGELGDLGFSRSQIARLLPLAGWCFRSSSLATNLAFWLPVFGSFDKILKALRMNKNLLSPGVQKSAKPILAFLEQCGINASDVARSSTMYSSRLLTANPEYLRDAVARVEELGLDRSSRRFHRGLVAVALVSKETAARKIRLMEELGFSQDDLLVIMRKLPNFLALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEEGNGVASLLSLQTEMDGVQVYAGKSG

SEQ ID NO: 33072 - protein, 206 aa, Coccidioides immitis RS
MAENQPGKTLSSSAAGTPTNPRGIPTAPFVDDVTDYVSTRADVEPTLRSFQEMISKYQFMELNTQRRAQGLKDKIPDITKTLETVNFLSARRKAESSIPIETAFELNDTLYARATIAPENTSEVYLWLGANVMLAYPINEAQKLLEDKLRVAQVSLGNCEEDLEFLREQITTLEVATARVYNWDVMQKRKEKAEGKGEHEKKIPDE

SEQ ID NO: 33073 - protein, 492 aa, Synechococcus sp. CC9311
MNNGRKSTMAERFSQQNQRVRPSSKEDQVVQKAKEHFERTLIPIAGSLAGSVAALQHPRDDEALNYGEIFLRDNVPVMVYLLTQKRFKVVKQFLKICLDLQSTTYQTRGVFPTSFVEENGELIADYGQRSIGRITSVDASLWWPVLCWMYVKASGDEQFGSTPGVQRGVQLLLDLVLHPTFEGTPVLFVPDCAFMIDRPMDVWGAPLEVEVLLYASLRCCSQLMELGLRNQSSRLLDQRLVLTRQWIHDLRKFLLKHYWVTSKTMQVLRRRPTEQYGDNQHQNEFNVQPQVIPDWLQDWLENRGGYLIGNIRTGRPDFRFYSLGNSLGCLFGLLTAPQQRALFRLTLHNRNHLMAQMPMRICHPPMETLEWQNKTGSDPKNWPWSYHNGGHWPSLLWYFGASILLHERRHPNADILLMGQMKAMLEDCYWSQLNQLPRQQWAEYFDGPTGTWMGQQSRTYQTWTIVGFLLLHHFLRVNPDDVDMLDLDGPSG

SEQ ID NO: 33074 - protein, 517 aa, Zea mays
DIEFTVQESRLWMLQCRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLANADTPEDALAARNNGAEGIGLCRTEHMFFASDERIKAVRQMIMAPTVELRQQALDRLLPYQRSDFEGIFRAMDGLSVTIRLLDPPLHEFLPEGNVEEIVRELCSETGANQEDALARIEKLSEVNPMLGFRGCRLGISYPELTEMQARAIFEAAIAMTNQGVQVFPEIMIVVPLQFKIMTKIHLIAEQAEFFSFGTNDLTQMTFGYSRDDVGKFIPIYLAQGILQHDPFEVLDQRGVVELVKLATERGRKARPNLKVGICGEHGGDPSSVAFFAKTGLDYVSCSPFRVPIARLAAAQVLV

SEQ ID NO: 33075 - protein, 436 aa, Oryza sativa (japonica cultivar-group)
MDSGGASDPSRQVRVRFLTKLPAPLRAPPTSIAVPADLTRMGLSEIVNSLLLAASPDHQAQPFDFLVDGELVRLPLQEFLLAKGISVERVLELEYVKAVAPRKQEDPCPHDDWVSAVDGSNPSFVLTGCYDGLARIWRDASECTHILEGHSDGITSARFINKGETEDRLHVVTASKDRSLRLFKFDTSVSVPKQIGAYKILRGHTSSVQSVAVDPSTNMICSGSWDNSIKLWSVEGSEEDGDTVSVKKRRTNSDSSGPEESLFEGSATSTFLGHTQCVSAVTWPERQTIYSASWDHSVRQWDVQTGKETWNMVSGKALNCLDCGGESSSLIAAGGSDPVLRVWDPRKPGTLAPIFQFSSHKSWISACKWHPSSWFHLVSSSFDGKVMLWDLRTAWPLASVESHKDKVLCADWWKGDSVISGGADSKLCIASGIEIV

SEQ ID NO: 33076 - protein, 290 aa, Gibberella zeae PH-1
MATSISRSRALASALRPAKPSVQLRNDQAIRCLSNTARQYVAMPKESPNLRKAPRDHIGTLKAPIVNPADKYQSKSDNMHRYGAWVMGCLPKYVQQFSVWKDELTIYISPSGVYPVFSFLKYNTAAEFTQVSTITAADYPTRENRFEIVYNLLSVRHNSRIRVKTYADEASPVPSITGLFDGANWYEREVYDLYGVFFAGHPDLRRIMTDYGFEGHPLRKDFPLTGYTEIRYDEEKKRIVTEPLELTQAFRNFEGGSSAWEPVGAGQDRTPESFKLPTPKPEEKKEEEKK

SEQ ID NO: 33077 - protein, 1373 aa, Burkholderia mallei ATCC 23344
MSKHRQAPGPRGGLVMGNLAAYKRNPITMLLRLHQQYGDVARNRLGPFVTHALAHPDHIQYVLQENHRNYVRGRFYDNFKMFFGDGLLTTDGEFWRRHRRVVQPLFHKKQVDAHTAAVGDAALALAYRWSALPPGKALDVVEEMMHLSLRMLGLMVFNTDVSSHAEAAGPAVRFGIEAMMPQGNLNDFIPRWAPTRFNRRIAHARRAIDTIVAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGATISLRPVHGIRLIVKPRERQQSHLARVREHESARALRPLGDTATTAGAACPMTAAREPGASAAALAAVEAGALDAAHRGGAAAAAAGEPCPPRDPAEAAPLPLAAAPAPASPAVDADASARGVPAWRFTWRPVPVDPVPDEPSPALSGRRIALVNGRGGTAERVAAALARTCAKVSVFAPAASADHAEAARVFVNEAGPLDGIVDLGLEAPFALDDAGAWEAPMRRTVELLKACYGDWAAEDDTSRLFYVALTWMDGQMGYGETAGAQPLGGLWAGLAKTLPQELPNCNVRVLDIAPDETGRVDRLVVNELYRWGLFEVGYRGGVRYTLHAKRNELPPHAVDARTTLGAGDTVLFSGGARGIGLLCARSLAERHGCTVIVTGRETPPDGGEPWMALDEPGFKHYGLEQLRAATPEHPPKAIRAALQRLKRRRELRTALDEMAALGLPVHYRVCDVTDRAAVRALCDELGDSLRMVIHNAGVDRPVRLIQKRAEDFADTVRTKVLGFANLCDAVRARPRLVQFCNVGSLTGRWGGMTGETDYAAANEALARLGLWAARHAFSPACGVKTLVWPTWEGVGMITNFAVTQRYVSPMNVDEGVRHWLRELAAPGSGEVMFMGAVGRAPTPMQIKGFVPIRELPNIGELVTRRHHVGEPVRFRPFKRFESRYAIDPAVAPYAHAFRFNGRAVLPASLVLEHACAVGDWVMPPTGEPRELSEMTNVVLRLDALPDVPAGGAPVELASEAAGYMIGDVWCVDVRCSDARTQAELLSMTLVYRPQPEQIGAAFARAPDTTPEPAPLTSAPHAAWNGELLPAGDWSVPDDASAGIVRIGRVPSAAVLSLWALPFPLELRLPVNHVEHVLRVLLAEWGAARADAPAVWRIGGAKLARLPAASADGVVEYAAGRFAVLDARGYVLLRIDDARVDGEPAQAALPETGALADPLTA

SEQ ID NO: 33078 - protein, 490 aa, Burkholderia mallei ATCC 23344
MTTTNTTTEPAAPGAARAAPATPPIRDCLDRYCIIGGGAAGIATAKNLREHGIAFDLIEREDDIGGTWYYGKPCSAIYQSVHMISSREFSEYTDYPMPADYPTYARGDQALAYLRDYARRFGVYEHAQFNRTVLEVAPLAHGGAWRVELDGHDVRHYKGVFVCNGHLSKPQVPDYPGRFDGLQLHSALYKTPDVLKGKRVLVVGAGNSGCDIAVEAVHHASAVFHSTRRGYFYWPKFLFGIPADRWAEWPLKLRMPLWARRFFGERLLRLTTAGQPEDYGLPKPDHKLFEAHFIINSTLFYHLGHGDLVAKPDVVELKGDRVAFSDGSEERIDAIVYATGFQLSFPFLDQSYLQWDKMQPRLYLNMFDRAHPNLFFIGLFQTSTGNWPLMDYQAQLVARYLRARDAAPRKAARLDRMIGRDRSNWNGGIRFSDTQRHVIEVEHFAYRLQLKRLIRALPDSRVAARQARPVAVASAAPAPAAAARARTGDA

SEQ ID NO: 33079 - protein, 171 aa, Candidatus Kuenenia stuttgartiensis
MEYLKKLIRDVPDFPKVGVLFKDITPLLQDAKGLKDSIACIASYVENKKIDIVVGAEARGFILATTVAFSIGTGFVPIRKPGKLPYEKASMTYNLEYGTDTLEIHKDGIKKGQQVLMVDDLLATGGTMNACCKLVESLGGNIVGCAFLIELGFLNGRDILSKYDLFSLIKY

SEQ ID NO: 33080 - protein, 165 aa, Anabaena variabilis ATCC 29413
MMPCYKLPLSKMRRLGLALLLPAALLGTVALPNQLSSVTAQTPGGNRPLTIRSDIQEYDAKNQVITARGNVQMLYPARQIQATSAQAQYFSKERRIDFSGNVYILQQGGNSIRAEKVTYLIDEGRFVALPQSNRQVESIYMVDDAEQGSQSNAPAPATPALRRSN

SEQ ID NO: 33081 - protein, 230 aa, Zea mays
  misc_feature (170)..(170): Xaa can be any naturally occurring amino acid
MEKKQKQKKHARSRSFTGGGLASFLKSTVAFFSFTFPSASVGTRSSFNHRNGFSGPIVSIVPPEARGGGGRNRSGYMTPEPSSPKVSCIGQIKRSNSRRQRKVNPCGKNGGGACPLPPAPAEGKPRGSLVKRLSFFRRGRSRPRSRADGLVGNGKECDGGATAAAAAPAXAGLGQMRRFTSGRAAFQDLDWRQEWRRAGRVSDEEDEGFVAHSAPLPHGSSSHPTSDSLG

SEQ ID NO: 33082 - protein, 263 aa, Oryza sativa (japonica cultivar-group)
MAPPPISSSLSLMASNPIPSPPVAKPGRPLTVAACSNSSSSSSSSSPSSTSCSAAWSLPVATSAGRRGLLALGAGFLASPGLLCPAGDAGATRIEYYATVGDKLCDMNVVKSGLGYCDVEVGTGAQPPRGQLINVHYTARFTDGIVFDSTYKRGRPLTMRLGAGKILRGLEQGISGGGGVPPMLVGGKRKLMIPATLAYGPEPAGCFSDFRVNFGVSYKRRDYGQMKRKGATCLSPDAESKCVTGAPWVSNTQSTTFAICTKK

SEQ ID NO: 33083 - protein, 161 aa, Mesorhizobium sp. BNC1
MISRLERINIIEWFRRLFGGNPPRIQAAALPWRRKHGTVEVMLITSRNTGRWILPKGWPEGREALDQTAMREALEEAGVEGAISGEIGRYIYGKEMSSGFRSRCEVAVFPLEVKREVKRWPEKTQRARRWFVPEEAALLVVEPDLSRLIGAFEGNPRKITA

SEQ ID NO: 33084 - protein, 239 aa, uncultured archaeon GZfos1D1
MKDRSSHDTDGSKSREKEASALSAVTLVADGMIVGIGTGSTAGYAIVELGRLVARGIDILCVPTSYQSEMLAAQQKIPITTLSEHPKLDIVLDGADQIDRNLVAIKGGGAAHTREKVIAHAASRVVLMADHEKVVPGLDHAVPIEVLPYARTLVEREVRALGGIPELRMAARKDGPVVTDNGNFVIDADFGAIDDPARLSGELSALVGAIEHGIFLNVDEVHIGTADGVKVLKRQGLRK

SEQ ID NO: 33085 - protein, 128 aa, uncultured archaeon GZfos1D1
MKRSARNFVGVDAGLNLLIRPAMYDAYHEVAVANKADSAGAETYDIVGPICESGDIIARDRKLPLIEPGDVIAVFDVGAYGFSMSSQYNGRCRCTEIMVSGGAVDVIREQEHYGDLIAKQKIPARLLA

SEQ ID NO: 33086 - protein, 464 aa, Nostoc sp. PCC 7120
MVSTHPAGVQDAGTQYLPQRRNTNTNISPNQELLPLTAKANSQGNLEIGGCDVTTLVEQFGSPLYILDEETLRTACQQYRDGFQKYYPGESQVLYASKAWNCLAVCAIAASEGLGIDVVSGGELYTALAAGVSPAKIYLHGNNKSREELVLAIESGVTIVADNWYELRILASLADSEEPIRLMLRLTPGIECHTHEYIRTGHLDSKFGFDPNDLAEVFEFVSQQPNLNCVGLHAHIGSQIFERQPHRDLAAVMVQWLRDANKYGLNVTELNVGGGLGIKYVESDDPPSIDEWVKAICEVVQAACAAENLPLPKLLSEPGRSLIATSCITAYTVGSSKTIPEIRTYVSIDGGMSDNPRPITYQSVYRAVIANKLSAPHTETVTIAGKHCESGDILIKNAQLPKTEPGDILVVMATGAYNYSMASNYNRLPRPAAVVVANGEANLILQRETYQDLIRQDCLPERLK

SEQ ID NO: 33087 - protein, 665 aa, Bacillus clausii KSM-K16
MTNKVEELAVNTIRTLSIDSIEKANSGHPGMPMGAAPMALNLWTKHMNHNPANPKWSNRDRFVLSAGHGSMLLYSLLHLSGYDVTLDDLKSFRQLGSRTPGHPEYGHTDGVEATTGPLGQGIAMAVGMAMAERHLAATYNTDKYPIVDHFTYAICGDGDLMEGVSQEAASLAGHLKLERLIVLYDSNDISLDGDLHESFSESVEDRFKAYGWHVVRVEDGTDMEEIHRAIEEAKRVDRPTLIEVKTVIGYGSPNKAASSASHGSPLGTEEVKLTKEAYKWTFEEDFYIPEEVKAYFAAVKEEGAAKEAEWNDLFAAYKAEYPELAAQYERAFSGELPEGFDQALPVYEHGTSLATRASSGEALNSLAAHTPELFGGSADLAGSNKTTLKGESNFSRDNYAGRNIWFGVREFAMGAALNGMALHGGLKVFGGTFFVFSDYLRPAIRLSALMGVPVTYVLTHDSVAVGEDGPTHEPVEHLAALRAMPGLSVVRPGDGNETAAAWKIALESSDRPTVLVLSRQNVDTLKGTDKKAYEGVKKGAYIVSEPQDKPEVVLLATGSEVPLAVKAQAALADEGIDASVVSMPSWDRFEEQPQEYKDAVIPRDVKARLAIEMGSSFGWAKYVGDEGDVLGIDTFGASGAGEAVIAEFGFTVDNVVSRAKALLKK

SEQ ID NO: 33088 - protein, 153 aa, Prototheca wickerhamii
MASLAFRSASIVSFTSAPRHPPAAPAAPKLGAPSPAPSPWSSQREVIATEGAPGAVGAYSQAIKANGFVYVSGQIPLVPGTKNFVSEDVEEQTEQVLTNLGAILKEAGSSFDRVVKTTILMADMADFAKINGVYGRYFPTNPPARAAYAVKAL

SEQ ID NO: 33089 - protein, 398 aa, Glycine max
  misc_feature (149)..(149): Xaa can be any naturally occurring amino acid
  misc_feature (242)..(242): Xaa can be any naturally occurring amino acid
  misc_feature (328)..(328): Xaa can be any naturally occurring amino acid
  misc_feature (338)..(338): Xaa can be any naturally occurring amino acid
MASAMLVGVYDHRRRRQRLRASRMLENGIRILKEEVQRSNREWESYKEKIKNNEEKVKLHKQLPYLVANIVEILDMNPEDEAEEDGANIDLDSQRKGKCVVLKTSTRQTIFLLVVGLVDPDKLKPGYLAGVNQDSYLILDTLPSEYDSXFKAMEVDEKPTEDYNDIGGLEKQIQEWVETIVLPITHKERFQKFGVGPPKGVLLYGPPGTGKTLIARACAAQTNATFLKLAGPQLDINMLWFXAKLVRDAFQLAKEKSPCIIFMDEIDAIGTKRFDSEVSGDRELQRTMLELLNQLDGFSSDDRVKVIAATNRADILDPALMCSGRLDXKIEFPHPTLXIHSRKMNVHPDVNAAQLKAVCVEAGMLALCRDATEVNHEDFDEGIIQVQAKKKASLDYYA

SEQ ID NO: 33090 - protein, 295 aa, Zea mays
MQMSTDPNHYGVFPHSFCNQHVVSFQTSSVTSVSGAIPVCLDTSSGMNGNMAMLNTTTSTIVSTGSPNMSAESSCQNLKYTAPLAVEWSYPELQLLNDGLNKYANEPGIMKYIKIAATLPDKTVRDVAMRCQWMAARKEATRRRKPEEHYLGKKIKDRKDKMAEPSSWGTNPPVQTEMRSSSSMPPNAKHNGFLSADSQIDHGMLNILEENAKLLNQIEVNILTSQAHNNIELFHHARRNINGLLQSMSQIPGIMSKMPPLPISVDERLASCILPRAPMAQVLGSSHLKEERRVW

SEQ ID NO: 33091 - protein, 489 aa, Escherichia coli O157:H7 EDL933
  misc_feature (57)..(57): Xaa can be any naturally occurring amino acid
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 33092 - protein, 167 aa, Prototheca wickerhamii
MDGPVDREEAVYLAKLAEQAERYDEMVAEMKKVAQMVHDQELSVEERNLLSVAYKNVIGARRASWRIISSIEQKEESKGNDENVKRIRKYREVVEKELQEICSSILSLLDEHLIPTASSGESKVFYLKMKGDYHRYLAEFKTGGERKEAAEHTLLAYKAAQDIALVD

SEQ ID NO: 33093 - protein, 130 aa, Brucella melitensis 16M
MGDILPSCAGIWAGILKGNQMTGINDIIDNEVKNNDVVLFMKGTPGFPQCGFSGQVVQILDYLGVNYKGVNVLASDELRQGIKEYSSWPTIPQLYVKGEFVGGCDIVREMFQSKELQALFNEKGIATKAA

SEQ ID NO: 33094 - protein, 300 aa, Pisum sativum
MAIPILRTAMMISHSHSQPLIQYSISAIDETAKRRKRVVFSSSPSSELNPVIRSSEVSFSVGTCLIPHPKKVDKGGEDAFFVSNYNGGVIAVADGVSGWAEEDVDPSLFPRELMANAYNFVGDDSATVIIAMLEKNGNLKIANVGDCGLRVIRNGIVTFSTSPQEHYFDCPFQLSSERVGQTYLMHGKNVELMEGDIIVMGSDGLYDNVFDHEIALTVARYRDVSEAAKALANLASSHARDSNFDSPYSWEARSKGFEAPLWKKILGMKLTGGKPDDITCNCGQEVVHEMICIKKTSLEC

SEQ ID NO: 33095 - protein, 439 aa, uncultured archaeon GZfos36D8
KLEEEQYTIEEGVPLTSAISPPHYMPPSSSLSYSESELEDLKMPAYEDVLKEAEKNDEFVAFIGPHHSGSGHLRWVMRMKGDIIKDVIPDPGYVHRSMEKIAENRLYIQNVPLTERPNISDPINMNLGYVRAIENALGIEVPERAKYIRTIMAELSRIGAFFYDMGIFPLFMGHSTGFMYSFAIREMVLELMVRMTGSRCTPSFIIPGGIRRDIPDDVLDRTRKFTTAIHKRLKKYENIFVYNPVLISRMKEVGVLTREEAIRCGIVGPFLRASGVEYDVRKAEPYEVYDKLDWEATTGDAGDCLGRIFGRLEEMKQSVEIVRQAVDAVQEMPRGGVISEEILGDYKEASDDIRGYLYNVYGDLVLPKGEWTSVTEAARGTVLYSIISDGESNVPYRVRIITPCWMNLRGIIEASKGERVADFWTVYASFGYFPPEADR

SEQ ID NO: 33096 - protein, 462 aa, Zea mays
MPPSVDAMPAPGDAAGGGDVRMISSKELRSHASADDLWISISGDVYDVTPWLPHHPGGDLPLLTLAGQDATDAFAAYHPPSARPLLRRFFVGRLSDYAVSPASADYRRLLAQLSSAGLFERVGPTPKVQLVLMAVLFYAALYLVLACASAWAHLLAGGLIGFVWIQSGWMGHDSGHHRITGHPVLDRVVQVLSGNCLTGLSIAWWKCNHNTHHIACNSLDHDPDLQHMPLFAVSPKLFGNIWSYFYQRTLAFDAASKFFISYQHWTFYPVMCIARINLLAQSALFVLTEKRVPQRLLEIAGVATFWAWYPLLVASLPNWWERVAFVLFSFTICGIQHVQFCLNHFSSDVYVGPPKGNDWFEKQTAGTLDILCSPWMDWFHGGLQFQIEHHLFPRLPRCHLRKVAPAVRDLCKKHGLTYSAATFWGANVLTWKTLRAAALQARTATSGGAPKNLVWEAVNTHG

SEQ ID NO: 33097 - protein, 579 aa, Arabidopsis thaliana
MTIDEPDDHRRRLRARARGHFRQSFELRSAFPTRLHRFDLQSFDKEPTNPVDFGAETLSYEDYYDETRDRYDKAFLMMITYQCDALVDKFNVTPLIIAIRESELQSEDGEVKDTKRPKTHKAEPCNLDGKRAVTIWFSMLKMTMPLSSSLVISFLACHQAGAPRANGRVISCVSGTSSISRNFIYLYCTWNRAVKAVEAILETSDKLEQWSKEPESAIDYLKNVYDKGDNESKALALILFGCWRDFVGEFAPVRICNKGCCLLIGYNPKAKVVVSLRSNASQDDSHILPPNPYECFELGSANVPVYSTEWSDDDPSEDELPIAGKKGKKGKKAKKPRRNWSSTEDVVLISGWLNTSKDPVVGNEQKGAAFWERIAVYYNSSPKLKGVEKRGHICCKQRWSKVNDAVNKFVGSYLAASKQQTSGQNDDDVVSLAHQIFSKDYGCKFTCEHAWRERRYDQKWIAQSTHGKAKRRKCEADSEPVGVEDKEARPIGVKAAKAAAKAKGKAKLSPVEGEETNALKEIQSIWEIKEKDHAAKEKLIIIKDKKNRTKFFERLLGKTEPLSDIEIELKNKLINELLA

SEQ ID NO: 33098 - protein, 266 aa, Picrophilus torridus DSM 9790
MIISGLIGRPVTHSIGQLVYNRIFKDLKMDAIYMSFDIIKENLGIFCKYAAENMAGFNVTAPYKNDIIKYTNSVDSISLKTGSVNLVRVLDNRLYGYNSDYAGFIKTMDENNIELKNKRILISGTGGIARTVFNAIKDKNVNADVSFLSRSGRKPWIPENINVYNYNNVKDDYDILINCTPLGTYPDNSIAFPDNIIKKVTGIDVVYNPVRTRFLSIVESNGGRAVNGVDLFTGQGVETLKLIFNMDLDYNDFKLYVLKALSDINE

SEQ ID NO: 33099 - protein, 262 aa, Triticum aestivum
PAAGVRRDSTSDGHEHAVGYVTGDQFYGAKASLNVWPARVASAAEFSLSQIWVISGTFGNDLNTIEAGWQVSPQLYGDNSPRFFTYWTSDAYQATGCYNLHCSGFVQTNRRIAIGAAISPASAYNGRQFDISLLIWKDPRRGHWWLQLGSGPLVGYWPSSLFSHLGGHANMVQFGGEVVNTRPSGSHTPTQMGSGHFPREGFNRAAYFRNVQVVDWDNNLLPARDLRLVADHPACYGIQGGYNRAWGNYFYYGGPGRNVHCP

SEQ ID NO: 33100 - protein, 197 aa, Oryza sativa
MQLLGVACPLKASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKYKFVAKKYSPPSIPAEFFEDPSSYKPD

SEQ ID NO: 33101 - protein, 414 aa, Thermus thermophilus HB8
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 33102 - protein, 516 aa, Ralstonia metallidurans CH34
MYMTQALHRSMQQRPDKVAVRFNGRALTYAEIGDRVARLAGALRKLGVAEGERVAMFSLNSARYIEYYMAVPWAGAVLNPVNFRWSAAEIAYSFKDSGTAVLIVDDPFTEVAQKVAAECTTVRHVIYAGDGETPAGMLNYETLIADSAPMEDAYRHGDDLAGIFYTGGTTGFPKGVMLSHANLISSACNQPMSGTVDESIVMMHVMPMFHLACFASINAVFLVGGTHVAISAFDPGRMMEGIAQDRVTAVLLAPTMIQMGLDWMDRHPGRAAELDLSSLNSLRYGASPMTPALLERTRQTFPAVRFSQGYGMTELAPVATMLGPEYHDAAAQASGKMYSVGRPAHTVEVKVVDSRGNEVPRGTVGEIIVRGPNVMLGYWNQPQATAEAIRNGWMHTGDGGYMDKDGFLFLVDRLKDMIISGGENVYSAEVEKALASHPAVAQSSVIGVPHEKWGESVHAVVVLRQGESATLESIQSHCRERIAGYKIPRSVEFVDALPLSSVGKVLKNELRKRHWK

SEQ ID NO: 33103 - protein, 450 aa, Picrophilus torridus DSM 9790
MDYLDVKRDDINYRNVYGSTYPLMKNAGMAVANVFKNNFGKNRKVLVIAGPGNNGGDAICAASYLMTDNDVYLLMIKDPKTPEARRAYNEYNGISYKYDEIDDLIKKTEIIVDGILGIGISGNPREPELSIIRMINSSGKKVISIDVPSGFPYESVKPDITVTFTDLKENMNESNSGKILIADIGIGKNIREYAGPGDLVYLKKPAFDSHKGMNGVLSIIGGSAYYGSAVISGLGAYSCGIDLVKIFTENVDIISSYYPGLIVRNIKNVDEMLKSNAFLIGPGLGTDFDDYDLLIRIISSGKPVVLDADALKIIKKEDVKGRNVIITPHKMEFKIFTSMEPSEESAVNFSEKYKITVLLKGTTDIVTDENRIMRVPGGNARMSMGGTGDLLSGMVSAFASRGVSNFRSAVMASYINKRVGEQCFKEKGYFYSITDMMDKIPSFINKNTFY

SEQ ID NO: 33104 - protein, 751 aa, Ustilago maydis 521
MAKNTSSAHSNGDSSNRKPSDHSLKFDTINGSSNGHRNGKPAVSALEDYSDAPAFSPLFPGSSIDRRELVKLTLQSLREMGFDSAAKTLEAESGITLEHPSITAFRTAVLSGDWRNAERLLIDGLTYAARRIQASRNPLGSSAGSSLLDAPASSSTASSSVSLPAVLDSSNQDLIDSVLRRPDLVSLRSIRFMLQKQRYLELLEARQTKKALNVLREKLTPLSHDTSQLHLLSSLVISASPEQLHARAGWDGADGDSRRLLMVEIESAVSPLVMIPSRRLPQLLEQAQSFQKQQDPFFNSPHGSHFSLLTDHRSDRSVFPSHNSIIIMDHRDEVWCLQFSHDGTKLATAGADKTILIWSVQDDYKLLQKFVPLSDNISSVSWSPDDEQLLVTSDVDVTLCRLATGSMLTLREHSYTVATATWLADGSGFVTGGMDGKIVWWDTQGYVLHKKTTSPFRVLSVAASPDGAHLVALSARQVAQTGLSSSTTRGHTSSSTALSISTASDQLSDTSSQSTASTGIIHDRADLDLAADLGGGSRTMGTERYRIHFINLRTREELGSIYLREEVVSLAVSGDSQYALINVRPSELQMWDINRQCLVRRFNGHKIHQHVIGCGFGGIDENFVVSGSEDAKIYIWHRASGRLIETLEGHNGGTVNDVAWHPKDSLTLASCGDDHSLRIWRPGGRPLASPAHPTEVAPKSDDSEMSGAANPFPWSFSDPSSAVEVDMMRSIHEAMDEEEEDSGVNSPSPTF

SEQ ID NO: 33105 - protein, 355 aa, Lotus japonicus
IVRLHEVLATKTKIYFIMDFVRGGELFAKVSKGRFGEDLSRRYFHQLISAVGYCHTRGVFHRDLKPENLLLDENGDLKVSDFGLSALRDQIRPDGLLHTLCGTPAYVAPEILAKRGYDGTKVDVWSCGVVLFVLAAGYLPFNDPNLMVMYRKIYNGEFRCPRWMSPDLRRFLSRLLDTNPETRITVDGMTRDPWFKKGYKEIKFHEEYRPESGSGSGSEVVDLNAFDIITFSSGLDLSRLFRQKEGEERLVVSGTPEKVLEMAEEVGAAEGMAVRWKKECGVELEGLNGDYGIGIDVSRLTAELAVVEVKMRGVDAVAFRNLWDEKLKPQLLGGATTSYHQEVEPESPESQVASD

SEQ ID NO: 33106 - protein, 408 aa, Ustilago maydis 521
MITTVSSTPSVDRYGTRLNGSAQSNKVVNKPLAWLERVDSDPTEASKPVNQITVVNDSEFEIHLVFSDCSVFRANLQRLSAGHADPSFDVALRAMALAWFVGCQRNSESVNVAQEQQQLVLPTPESLLQLCRVHHNQHHDARVQHSRSSIILHHTHLAASLAMASTSTASQPWDVLRRNTRNLESAIDARLTTYSQLASKIARAADHTTLDMTGAGSSSASETREHSEHVELETELESLINELSNSVDALTAKLDDPAIPPTTPQLHAVQRHRELLFDFTRDFRRSQTNVRHAIDRRDLLGNVQGDIDAYKAAHASDADALLAERARIDNSHGMIDRTLEQAYATRADFADQRSTLQAISTRMSSSAAQVPGLNSIITLIGRRKTRDSVIMGCLIGTLTVLLLKFALG

SEQ ID NO: 33107 - protein, 472 aa, Lotus japonicus
SVMIPIFATQVSAIESAAGDIDEALKWNGNYQECRACVGSGGVCGSDGEFRCFCKDGPHTSACNSAIAPAPGALGAGFMTTLFFVLIICHRMRSMSFRQKMLFRKRRKYVDHNVEAFMKSYGSLAPRQYSYSEIKRITNSFLDKLGQGGYGVVYKATLPDGRLVAVKVISESNGSGEDFINEVASISNTSHVNIVSLLGFCYMNKRALIYEFMPNGSLDNFINGRGGSPNAVSYFDWNTLSKVAIGIARGLEYLHQGCNTRILHLDIKPQNILLDENLCPNIADFGLAKICKRKESIVSMLGTRGTPGYIAPEIFSRAFGGASHKSDVYSYGMLILEMVGGRENYDSGGGSQSSEMSFPDWIYKDLEQGDVHTNCLVITGEEHEMARKMILVSLWCIQTHPSERPSMSKVVEMLEGTLQSVPYPPKPILHSPEKLLLQNSDLTSGNTLETDSMTTEKDGSIELNVLSKNVPG

SEQ ID NO: 33108 - protein, 79 aa, Glycine max
KPPLRGERGSGPPPRVGYVGPPPGATLVAIKPSEEGTGDTVWNETADAAWVLDAFEEPYRTAAKMLLKRRTYSLEMNSF

SEQ ID NO: 33109 - protein, 437 aa, Desulfuromonas palmitatis
MSTLKETLRKKIEEHRPRTTRLVKEFGDVKLGDVTISQAIGGARGIKCLVTDISYLDPMEGIRFRGKTIPETFAALPKVPGSDYPYVEGFWWMLLTGDVPTMEQTLEVVEDWKKRSQIPAYVIDVLRALPRDSHPMAMFSAAIVAMQRDSVFAKNYAAGKFNKMTCWEDMYEDANELMAKLGPIAAYIYRMKYKGDTHIPADPKLDMGGNFAHMMGVDKPYDDVARMYFILHSDHESGNVSAHTTHLVASALSDAYYSYAAGINGLAGPLHGLANQEVLAWTQNFMDKLGGKVPTKEELEKALWDTLNSGQVIPGYGHAVLRKTDPRYTSQREFCLKTPGLKEYPLFQLVSMIFEVAPDVLLKHGKAKNPWPNVDAQSGVIQWYYGVTEYDFYTVLFGVGRALGCLANITWDRALGYAIERPKSVTTAMLEDAAGIK

SEQ ID NO: 33110 - protein, 322 aa, Leptolyngbya boryana
MAQDQKPTVVITGASSGVGLYAAKALVKRGWHVVMACRNLEKADSAAKSLGMSPDSYTLMHIDLGSLDSVRKFVTQFRESGKSLDALVCNAAVHMPLLKEPMRSPEGYELSVATNHFGHFLLCNLLLEDLKHSTHNDPRLIILGTVTANSKELGGKIPIPAPADLGDLSGLEAGFKAPIAMIDGKPFKAGKAYKDSKLCNMITSRELHRRYHDSTGIVFNTLYPGCVADTPLFRNSLPVFQKVFPWFQKNITGGYVSQELAGERTAQVVADPEFKQSGVHWSWGNRQKEGRESFVQELSEKVTDDAKAKRMWELSEKLVGLA

SEQ ID NO: 33111 - protein, 299 aa, Photorhabdus luminescens subsp. laumondii TTO1
MSSGRFEFTGSIVALVTPMDASGQVDKASLKKLIDYHVASGTSAIVSVGTTGESATLSHDEHGDVVLTTIELADGRIPVIAGTGANATAEAISLTKRFENSGVVGCLTVTPYYNKPSQEGLYQHFKTIAENTDLPQILYNVPSRTGCDLLPLTVARLAKIKNIVAIKEATGNLNRVSQIQELVNDDSFILLSGDDASGLDFIQLGGKGVISVTANIAAPDVAKFCELALNGQFAEARKLNNRLMDLHRQLFVEPNPIPVKWGCQKLGLIADDTVRLPMTPLTDAGKVSVEKALKMAGLL

SEQ ID NO: 33112 - protein, 518 aa, Oryza sativa (japonica cultivar-group)
MGVTKAEAVAGDGGKVVDDIEALADLRKEPAWKRFLSHIGPGFMVCLAYLDPGNMETDLQAGANHKYELLWVILIGLISALIIQSLSANLGVVTGRHLAELCKTEYPVWVKTCLWLLAELAVIASDIPEVIGTGFAFNLLFHIPVWTGVLIAGSSTLLLLGLRRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKIGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 33113 - protein, 427 aa, Staphylococcus epidermidis ATCC 12228
MSFEKSIKAMEQAEKLMPGGVNSPVRAFKSVDTPAIFMDHGEGSKIYDIDGNEYIDYVLSWGPLILGHKNQQVISKLHEAVDKGTSFGASTLQENKLAELVIDRVPSIEKVRMVSSGTEATLDTLRLARGYTGRNKIIKFEGCYHGHSDSLLIKAGSGVATLGLPDSPGVPEGIAKNTITVPYNDLDSLKLAFEKYGDDIAGVIVEPVAGNMGVVPPVNGFLQGLRDITNEYGALLIFDEVMTGFRVGYNCAQGYFGVTPDLTCLGKVIGGGLPVGAFGGKKEIMDYIAPVGTIYQAGTLSGNPLAMTSGYETLSQLTPESYEYFNSLGDILEKGLKEVFAKHNVPITVNRAGSMIGYFLNEGPVTNFEEANKSDLKLFSNMYREMAKEGVFLPPSQFEGTFLSTAHTKDDIEKTIQAFDNALSRIV

SEQ ID NO: 33114 - protein, 397 aa, Chlamydomonas reinhardtii
MALTMSAKSVSARAQVSSKAQAAPAVAVSGRTSSRVMPAPALAARSSVARTPLVVCAATATAPSPSLADKFKPNAIARVPATQQKQTAIITGASSGLGLNAAKALAATGEWHVVMACRDFLKAEQAAKKVGMPAGSYSILHLDLSSLESVRQFVQNFKASGRRLDALVCNAAVYLPTAKEPRFTADGFELSVGTNHLGHFLLTNLLLDDLKNAPNKQPRCIIVGSITGNTNTLAGNVPPKANLGDLSGLAAGVPAANPMMDGQEFNGAKAYKDSKVACMMTVRQMHQRFHDATGITFASLYPGCIAETGLFREHVPLFKTLFPPFQKYITKGYVSEEEAGRRLAAVISDPKLNKSGAYWSWSSTTGSFDNQVSEEVADDSKASKLWDISAKLVGLSA

SEQ ID NO: 33115 - protein, 96 aa, Zea mays
MVLVSAAKMSVRGKGGKGLGKGGAKRHRKVLRDNIQGITKPAIRMLSRRCGVNRISELIYEETRSVLKNFLENVIRYSVTYTEHARRKTVNGMDDY

SEQ ID NO: 33116 - protein, 398 aa, Daucus carota
MALQAASFLPSSFSINKEGKANVSLKETSLFGVTFSDSLRTDFSSLRTRRGCRQISQTGAIRSQAVATTPSVNRATGEGKKTLRKGSVIITGASSGLGLATAKALAETGKWHVIMACRDFLKAERAAKSAGMPKENYTIMHLDLASLDSVRQFVETFRRSERPLDVLVCNAAVYFPTAKEPTYTADGFELSVGTNHLGHFLLSRLLLDDLNKSDYPSKRLIIVGSITGNTNTLAGNVPPKANLGDLRGLAGGLNGMNSSAMIDGAEFDGAKAYKDSKVCNMLTMQEFHRRYHEETGITFASLYPGCIATTGLFREHIPLFRTLFPPFQKYITKGYVSEAESGKRLAQVVSEPSLTKSGVYWSWNKDSASFENQLSEEASDVEKARKVWEVSEKLVGLA

SEQ ID NO: 33117 - protein, 440 aa, Davidiella tassiana
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 33118 - protein, 345 aa, Thermus thermophilus HB8
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 33119 - protein, 457 aa, Streptomyces avermitilis MA-4680
MAVTGPPALPTLPALPDPAADAVLGSGLLEELAYALGGPFHFLLPDAFDANLRALHSVLDETGVDGFVYFAKKANKAAVWAERSAAGGAGVDVASAAELRQALGHGVRGEHLVVTGPAKDLALLGLAVRHGALIAVDALDELDTLITTVSGDRTRPARLLLRCLPPAQPHSRFGLGEAEVALALERCVTAGEAVRMEGFSFHLSGYDVKLRADLAGHLVELCLKARVLGLEADRISIGGGLPVSYSSAADWNTFLTRQNGGHYHADRTFDPDGFYPYHSPVAGADALRRILATRPEGHRPSLAALLNDAGITLLLEPGRALLDRAGGTVFRVQGVKDRDGYQLLTVNGTSLSLSEQWFNSEYLPDPHLLSAHPDTPDAVWPAAVGAATCLESDMLTWRKVPFPRRPRTGDLLVYPNTAGYQMDSNESPFHDLALPPKVVIDHTDRARPRWRLDRHAP

SEQ ID NO: 33120 - protein, 262 aa, Oryza sativa (japonica cultivar-group)
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 33121 - protein, 522 aa, Ricinus communis
MAGGSLAPAGVAKERAEQYQGKVTFAVFVACMVAAVGGSIFGYDIGISGGVISMDAFLEKFFRSVYLKKKHAHENNYCKYDDQRLAAFTSSLYLAGLAASLVAGPITRIYGRRASIISGGISFLIGAALNATAINLAMLLLGRIMLGVGIGFGNQAVPLYLSEMAPTHLRGGLNIMFQLATTSGIFTANMVNYGTHKLESWGWRLSLGLAAAPALLMTIGGLLLPETPNSLIEQGLHEKGRNVLEKIRGTKHVDAEFQDMLDASELANSIKHPFRNILEKRNRPQLVMAIFMPTFQILTGINIILFYAPPLFQSMGFGGNAALYSSAVTGAVLCSSTFISIATVDRLGRRFLLISGGIQMITCQVIVAIILGVKFGDNQQLSKSFSVLVVIMICLFVLAFGWSWGPLGWTVPSEIFPLETRSAGQSITVAVNLFFTFVIAQSFPSLLCAFKFGIFLFFAGWVTVMTAFVYIFLPETKGVPIEEMIFLWRKHWFWKKIVPGQPEVDDSRESMEMGEAVASRIK

SEQ ID NO: 33122 - protein, 195 aa, Staphylococcus epidermidis ATCC 12228
MNINFNNINLIISAVKKAQYPDTGLTEVALSGRSNVGKSTFINSMIGRKNMARTSQQPGKTQTLNFYNIDEQLIFVDVPGYGYAKVSKVQREKFGKMIEEYITQRENLKLVIQLVDLRHQPTEDDVLMYNYLKHFDIPTLVICTKEDKIAKGKVQKHIKRIKDKLELESGDNIISYSSIKNSKQQEIWNFIETYI

SEQ ID NO: 33123 - protein, 555 aa, Cryptococcus curvatus
MSASTKQASTTVAQPSGKPVTNVIDPERDDFIVPDNYVTRTVENMKMLPPVTWRNLHKNIQWISFLALTIPPAMAIYGLCTVPVQTKTFIWSVVYYFITGLGITAGYHRLWAHRSYNASKPLQYFLALCGAGSVQGSIRWWSRGHRAHHRYTDTKLDPYSAHEGFWHAHMGWMLIKPRGKIGVADISDLSKNPVVKWQHNNYVALLFFMGLAFPTLVAGLGWGDWWGGLFFAGAARLVFVHHSTFCVNSLAHWLGETPFDNKHTPKDHFITALVTVGEGYHNFHHQFPMDFRNAIKWYQYDPTKWFIWTMAQLGLASHLKKFPDNEIKKGQYTMKLMQLQEQSEKLEWPKHSNDLPVISWEDFQAESKTRALIAVHGFIHDCSSFIEDHPGGAHLIKRAIGTDSTTAFFGGVYDHSNAAHNLLAMMRVGVLDGGMEVEHLKVGRLTRSNSADSLVSDAPSSASSTVSASSILSEVEDMDKPERKPSTSRSPRCPTPGRSPCLLRRSIASSARPPRSAQDSSRASRAPPRPASHGQRALTLLSRLRAFSVEHPGFH

SEQ ID NO: 33124 - protein, 391 aa, Pediococcus pentosaceus ATCC 25745
MEFSKRANQVSPSATLAVSTEAKKMQAAGIDVVNLSTGEPDFATPKAIIKAAMESMESGKASYYTPVGGLPELRQAVATHIKTDTGYDAKMEQVAVTVGAKMGLFETFQALLNEGDEVMIVAPFWVSYEEQVKLAGGSVIAIHPQASDLKTTPSELSRFKTASTKLLILNTPQNPSGLVYSEEETRAIAQWAVDNNVILVADEIYGKLVYNGAKFSSVMSMGNEIVNNTILIDGVSKAYAMTGWRIGYVVAAPQIIRKILALQGHMTSNPTAVAQYAALEALRGDQYPVEEMRLAFEKRLNQTFDLMQVIPGFSFDYKPEGAFYLFPDVTEAMKIKGYATSTDLAMALLKEAHVAVVAGEAFGMPGHIRLSYATSQTLLSEAVRRIQNFMN

SEQ ID NO: 33125 - protein, 434 aa, Staphylococcus aureus
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSQRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 33126 - protein, 493 aa, Cryptococcus curvatus
MSASTATAPPATAPAVANPTPAAASAAAAAPAATKDKAETIDPESEHFVVSQNYVTRTVENMTMLPPVTWSNLLQNIQWISFTALTVPPAMAIYGLCTLELQRKTVIWAIVYYFMTGLGITAGYHRLWAHRAYNASAPLQYFLALCGAGSVQGSIKWWSRGHRAHHRYTDTKLDPYSAHEGFWWAHVGWMLVKPRGKIGVADISDLSRNPVVKWQHNNYVMLMVLMGLVFPTLVAGLGWGDWKGGLLFAGAARLVFVHHSTFCVNSLAHWLGETPFDNKHTPKDHFITALVTVGEGYHNFHHQFPMDFRNAIKWYQYDPTKWFIWTMSNVGLASHLKKFPDNEIKKGQYTMKLQMLQEQSGSIQWPKHSNDLPVISWEDFQAEAKERSLVAIHGFIHDCSSFLEDHPGGIHLIKKAIGTDATTAFFGGVYDHSNAAHNLLAMMRVGILDGGMEVESLKLENLQRSMSVSSMESDAASSASSVSVSSISPRWPH

SEQ ID NO: 33127 - protein, 275 aa, Picrophilus torridus DSM 9790
MRLIENWFSERYSDNLQLSFRVQDQLLSVKTDYQRIDLFNTYDFGKLLSIDGTVQLTEKDEYIYHEMITMVPYYCTAKSDSALIIGGGDGGAAKRLIDLGIKRIVNVEIDQNVVEISRKYFPELADSFNNKNVELIIGDGIKYVKDTDESFDLIIIDSTDPVGPAEGLFNKSFYENARARLSDDGIIVTQSGSPYYQPEALKMATKGMLDVFSNVRTYIAFIPTYPSGLWSFTMASKSEIMQRKDNIIPGRYFNEDVLKGSFYLPEFVKNIIKSI

SEQ ID NO: 33128 - protein, 449 aa, Bacillus clausii KSM-K16
MPKFTKEDIVRQAQDNNVRFIRLQFTDLLGTIKNVEIPVDQLSKALDNKMMFDGSSIEGFVRIEESDMYLYPDLDTWVVFPWTPEKGKVARLICDIYQPGKPGEEPKPFEGDPRGILKRVLKEAQELGFTDFNIGPEPEFFLFKNDEKGEPTLELNDRGGYFDLAPTDLGENCRRDIVLELEDMGFEIEASHHEVAPGQHEIDFKYADAVSTCDNIQTFKLVVKTIARKHGLHATFMPKPLFGVNGSGMHLNMSLFTQEGNAFYDKNTESQLSKTAMQFLGGILKHAEGFTAITNPIVNSYKRLVPGYEAPVYIAWSMRNRSPLVRIPSSRGVSTRIEVRSPDPSANPYLAMAVMLASGLDGIKKKINPPEATDRNIYIMSKEERLDEGIKDLPSTLKEAIDSLLKDEVLVKALGEHALEHFVEAKEIEWDMFRTQVHPWEREQFMQNY

SEQ ID NO: 33129 - protein, 113 aa, Glycine max
  misc_feature (40)..(40): Xaa can be any naturally occurring amino acid
MAGSGSSMLYSFLLFTVILSLQEMYRGKLASSELYTILGXFIGNLQETIGARTGWGAVIVAEAVALIAASTVHRVCITTCFLFSAALLYEVNKISGSALSTSDSRIKKQSGRA

SEQ ID NO: 33130 - protein, 177 aa, Triticum aestivum
  misc_feature (133)..(133): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEXVEEVKKEYPDAYVRIIGFDNMRQGQCVSFIAFKPTCLPRSPGKA

SEQ ID NO: 33131 - protein, 255 aa, Prototheca wickerhamii
MFALAPSRHCVAFSAGPRPASHPTARRGLAVRPRAIQTPDAYVSPSSRTAATELQALELYSEIVPDVLLSQTLQTVEAPKAATSSRGVLNGIMSSPSAFGRYKFAVEQARHYDRAAKAASLAEATSLRVNKALVNVGALFMENISGRVSTEVDPRAHADESALVACGQTLIQLYEEAGVSRTRVILRIPATWAGIRAAAALEAQGIATHLVLVYSFAQGAAAAQAGVSVIQPNVGGLGDWHNRQPGMIRKPKGPR

SEQ ID NO: 33132 - protein, 303 aa, Prototheca wickerhamii
MAAASVQQSTKAPEPLVAANQLEALKQMSKVVADTGEVDAIRRYKPFDCTTNPSLVYKAMQLPEYAPYLAEAIASEKESHKGVRPYAYVADRLAVNIGAELSKLVPGRVSTEVDAHLSYDTGASVDKALRLLDLYAAKGVEPSKIYIKVASTWEGIRASEILQKQGISTNMTLIFSFAQAGACADAGASLISPFVGRIMDWYKKSTGRTYAAHEDPGVESVKRIYSYYKQYGYDTIVMAASFRNIGEIQELAGCDNITIAPSLLAELEANTETLPMPCGPARARPPTPTSTCRGPRRGPSVRC

SEQ ID NO: 33133 - protein, 403 aa, Silicibacter sp. TM1040
MTHIAVIGAGQAGSSLVAKLRKCGFDGEITLIGAEKVLPYQRPPLSKAYLLGEMELERLFLRPESFYAENNITLRLGTKVDAIDAAAKTLQIGDETLSYDQLVLTTGSHPRHLPAAIGGDLGGVHVVRDLKDVDAMAPAVTDGARALIVGGGYIGLEAAAVCAKRGVSVTLVEMADRILQRVAAPETSDYFRALHSAQGVDIREGVGLSHLEGDAGKVTCAVLADGTRLDVDFVVVGVGITPASELAADAGLEIENGIRTDELGRTSDPAIWAAGDCASFPYKGQRIRLESVPNAIDQAEVVAENLLGAEKAYVATPWFWSDQYDVKLQIAGLNSGYDNVVTRQGADGSMSFWYYTGDQLVAVDAMNDPRAYMVAKRLIEAGKTADKAIVVDPEADLKPLLKA

SEQ ID NO: 33134 - protein, 458 aa, Escherichia coli K12
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 33135 - protein, 163 aa, Prototheca wickerhamii
MLAMQGPVTGRLPCASQLTRPKQRHGKYIAFCTRNEVSRSSRPRASSVSRAASAQQSRSGGGARPWRPISCHSPARLVGSVDDANFVRGASPAIDREELSRTVRAVILAGGEVKNPLTRSRAMPAVPLGSSLMMIDIPISNCMSAGINKIYVLTQFQSHTLNS

SEQ ID NO: 33136 - protein, 300 aa, Geobacter bemidjiensis
RPFEALPKAAGSEYPTVESFWYFLLTGEVPTAAQVSAVEAEFKTRQVVPEYVYTAVRALPKESHPMVMLSVGIMAMQKDSKFAAFYSGGKFNKMDAWESVYEDASDIVARIPVLAAFIYNLKYRGDKQIAIDPKLDMGANFAHMIGQSEQYKDVARMYFILHSDHESGNVSAHTTHLVHSALSDPYYAYSAGLNGLAGPLHGLANQEVLGWIMEFQKKLNGAEPTKENVTKALWDTLNAGQVVPGYGHAVLRKTDPRYTAQREFCLKTPGLKDDQLFKLVAMIFETAPGVLTEHGKTKNP

SEQ ID NO: 33137 - protein, 299 aa, Desulfuromonas acetexigens
KAKGSKYPTVESFWYFLLTGDVPTQAQVDAVVAEWKTRQIVPSYVWDAIRALPRDSHPMVMLSVGILALQKDSKFAAFYNSGKFNKMTAWESVYEDASDLCARIPIIAAFIYNLKYRSDFQTAIDPNLDMGANFAHMIGQCEEYKDVARMYFILHSDHESGNVSAHTTHLVHSALSDPYYAYSAGLNGLAGPLHGLANQEVLDWTLKFQEKYCKDVEPTKELVTKALWDTLNAGQVVPGYGHAVLRKTDPRYMSQREFCLNTPGLKDDKLFKLVAMIFETAPGVLTEHGKAKNPWPNVD

SEQ ID NO: 33138 - protein, 163 aa, Brucella melitensis 16M
MASIAQAAKSLLLKEFASAFALSMRQFFAPKATLNYPHEKGPVSPRFRGEHALRRYPNGEERCIACKLCEAICPAQAITIEAGPRRNDGTRRTVRYDIDMVKCIYCGFCQEACPVDAIVEGPNFEFATETREELYYDKDKLLANGDHWEREIARNIAMDAPYR

SEQ ID NO: 33139 - protein, 292 aa, Malonomonas rubra
GFWYLLLTGDVPTMEQTLEVVEDWNQRSAVPEYVIDVLRALPRDSHPMAMFSAAIVAMQRESVFASNYAAGKFNKMTCWEDMYEDANTLMARLGPIGAYIYRMKYKGDTHIAPDPELDMGGQFAHMIGQSDEYKDVARMYFILHSDHESGNVSAHTTHLVASALSDAYYAYSAGINGLAGPLHGLANEEVLRWTQNFMQKLGGEVPTEEGLKEALWATLNSGQVIPGYGHAVLRKTDPRYTSQREFCMNTSGLKEYPLFQLVKMIFEVAPGVLTEKNPWPNVDAQSGVIQWY

SEQ ID NO: 33140 - protein, 382 aa, Bacillus subtilis subsp. subtilis str. 168
MNTNKRVLILTANYGNGHVQVAKTLYEQCVRLGFQHVTVSNLYQESNPIVSEVTQYLYLKSFSIGKQFYRLFYYGVDKIYNKRKFNIYFKMGNKRLGELVDEHQPDIIINTFPMIVVPEYRRRTGRVIPTFNVMTDFCLHKIWVHENVDKYYVATDYVKEKLLEIGTHPSNVKITGIPIRPQFEESMPVGPIYKKYNLSPNKKVLLIMAGAHGVLKNVKELCENLVKDDQVQVVVVCGKNTALKESLSALEAENGDKLKVLGYVERIDELFRITDCMITKPGGITLTEATAIGVPVILYKPVPGQEKENANFFEDRGAAIVVNRHEEILESVTSLLADEDTLHRMKKNIKDLHLANSSEVILEDILKESEMMTAKQKAKVLS

SEQ ID NO: 33141 - protein, 396 aa, Brucella melitensis 16M
MAETQVRNFNINFGPQHPAAHGVLRLVLELDGEVVERVDPHIGLLHRGTEKLMEAKTYLQAVPYLDRLDYVAPMNQEHAYALAVERLLDIEVPKRGQLIRVLYSEIGRILNHLLNVTTQAMDVGALTPPLWGFEEREKLMVFYERACGARMHAAYFRPGGVHQDLPDQLIEDIGKWIDPFFTTLKNLDDLITPNRIFKQRNVDIGVVKLEDAWAWGFSGVMVRGSGAAWDLRKSQPYECYSEMEFDIPVGKNGDCYDRYLIRMEEMRQSVRIMRQCVDLLLGKERVGPVSNTDHKIVPPKRGEMKRSMEALIHHFKLYTEGYHVPAGEVYAAVEAPKGEFGVYLVSDGSNKPYRCKLRAPGFAHLQAMDFLCRGHMLADVSAILGSLDIVFGEVDR

SEQ ID NO: 33142 - protein, 202 aa, Brucella melitensis 16M
MSEEALGELSGYIRERLGDAIEEANLAYGELTLCVPVASLIGVLTFLRDDVQCQFVNLTDISGVDYPQREKRFDVVYQLLSPRQNQRIRVKVQADEDTLVPSAVPVFFGAEWYEREAYDMYGILFSGHPDLRRILTDYGFEGHPLRKDFPLTGFVEVRYNDELKRVVYEPVQLRQEFRNFDFLSPWEGTDYVLPGDEKAKTN

SEQ ID NO: 33143 - protein, 500 aa, Staphylococcus epidermidis ATCC 12228
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 33144 - protein, 245 aa, Glycine max
MSGRGKGGKGLGKAGAKRHRKVCATHPGHHQPAFAPLEAQGGFQAHLGALLRGETAGCSESSSGTSSRDVLPDPEPPPPRGPKGGRPAGEGAPGSVGRPCFPWPGGGLIGRPPCGNISAAPHRRPPPATHTQQPSEARRRSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 33145 - protein, 341 aa, Staphylococcus epidermidis ATCC 12228
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVAVKIGQLIDDKAMVKAI

SEQ ID NO: 33146 - protein, 286 aa, Synechococcus elongatus PCC 6301
MSADAPVWIDEVFEDRVRYGLRGQILWEETSPFQKITIVDTEHYGRGLLLDDCWMTAERCEVCYHEYLVHPPLTTAASIARVLVIGGGDGGTVREVLRYAEVEQVDLVEIDGRVVELSQEYLGAIGTAWADPRLNVKIGDGIAFVQTAPDASYDVILVDGSDPAGPAAGLFNREFYENCRRVLKPGGVFASQAESPDSFLAVHLEMIETLSAVFAEAKPYYGWVPMYPSGWWSWLYASDTPGQFQKPQSDRLAAIEPQVEIYNRDIHQAAFAQPNFVRRGLSARQG

SEQ ID NO: 33147 - protein, 110 aa, Arabidopsis thaliana
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEGLHAY

SEQ ID NO: 33148 - protein, 254 aa, Synechococcus elongatus PCC 6301
MASLLALDFDGVLCDGLREYFLAAWQAGCDRDPSWPEVPEPSLEDRFRLLRPVIEQGWEMPVLLQALRREVADAEVLADWPQLCDRVLKDWGLTTTELSQAMDRVRDRWIKRDRKEWLQLHHFYPGVAERLAQQTAPWVIISTKDGRFIAELLEQIPNLQPPLAIYGKEVGVPKTQTLIQLQVEFEQIAFVEDRLPALEAAAQLESVDLYLADWGYNTDRDRQQAMTSDRIQLLRLTDFSSGRSPALAASPVES

SEQ ID NO: 33149 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 33150 - protein, 588 aa, Synechococcus elongatus PCC 6301
MSETLASETLTPELAAVREKTVVDNLDELLEILPPQLRDQLLRHPQKDRLVEVVLDLGRFPEARFPEGAEYLSETPVSREDLAYCAARVGDFGADNRAGIERTLHRIGAIRNRKGEVIGLTCRVGRAVFGTVGMIRDLVETGQSLLFLGRPDVGKTTALREVARVLADDLLKRVVIIDTSNEIAGDGDIPHPAIGRARRLQVARPELQHQVMIEAVENHMPEVIIIDEIGTELEALAARTIAERGVQLVGTAHGNQIENLIKNPTLSDLVGGIQSVTLGDDEARRRGSQKTVLERKAPPTFEIAVEMLERYRWVVHEDVANTVGLLLRQGQPNPQVRTLSEDGRVLIAPAFKDAPKQPASVTQQTWSHTSDRGWRSSGRMRPLPPVLDVPTTREDLRDPEVAFEQALATDVARPVGPNGEELPLHVYPYAVSRHYLEQVIDTLQLPVLLTKDLADADVVLALAGQLKGQSKLRHVARNHHVPIHVIKSNTMPQIVRALRRLLNQEQLDEPETVNLELFTKAGKNDEIEALEEARLAVEQIVLPKGQPVELLPRSAIVRKMQHELVEHYRLKSASFGEEPNRRLRIFPA

SEQ ID NO: 33151 - protein, 344 aa, Triticum aestivum
MDADGRLRRALAAFGGGDVWDLVDAALAAAAPADLRARRDGIVERLYAGARCRNCDAPESPPQPPRQPAEAASPAWQEEEEEEEEVADVDGLGLEEETDEGGGLESKILAIKDFLEDPDQSEEELVSLLQNLADMDITYKALQETDIGRHVNGLRKHPSGDVRQLVKLLVRKWKEIVDGWVRLHNSGGDGGNSILTDGDSPEKTQGKSYQNARVSDFKYTPSPPQRHSGLSSERSRNNNGFESTLERHRASPAPTYHTKQNNGNNYSTTSSSAPARAMREQKDNHLDEKLDSARKRLQENYQEAQNAKKQRTMQVLDIHDIPKPKNKNTFIRKPGGGGLPGRHR

SEQ ID NO: 33152 - protein, 550 aa, Oryza sativa (japonica cultivar-group)
MSGPMQRSSQPQFISSVERNNQSNGPGTPLIDSIDVDQIVIPEKNSWKNLFSYIGPGFLVSIAYIDPGNFETDLQAGAQYKYELLWIILIASCAALIIQSLAARLGVVTGKHLAEHCRAEYPKATNFILWILAELAVVACDIPEVIGTAFALNMLFKIPVWCGVLITGLSTLMLLLLQQYGVRKLEFLIAILVSLIATCFLVELGYSKPNSSEVVRGLFVPELKGNGATGLAISLLGAMVMPHNLFLHSALVLSRKVPRSVHGIKEACRFYMIESAFALTIAFLINISIISVSGAVCGSDNLSPEDQMNCSDLDLNKASFLLKNVLGNWSSKLFAVALLASGQSSTITGTYAGQYVMQGFLDLRMTPWIRNLLTRSLAILPSLIVSIIGGSSAAGQLIIIASMILSFELPFALVPLLKFTSSRTKMGQHTNSKAISVITWGIGSFIVVINTYFLITSFVKLLLHNGLSTVSQVFSGIFGFLGMLIYMAAILYLVFRKNRKATLPLLEGDSTVRIVGRDTATEGEGSLGHLPREDISSMQLPQQRTASDLD

SEQ ID NO: 33153 - protein, 169 aa, Listeria monocytogenes str. 1/2a F6854
MKKITPKAMCAWIPKREDETHKGDYGRVLIVAGNKQFGGAAIMAAEACVKSGAGLTTVASDSVNRPALQTRIPECMFIDYENITSLSEQISQFDTILIGPGLGLDAYAEEIFRLVLQKSTEHQQVIIDGDGITIYAKGENPHPAAKLTFTPHAGEWERLKVLAPDAVTP

SEQ ID NO: 33154 - protein, 348 aa, Arabidopsis thaliana
MSARPEGSPPEVTLETSMGPFTVEMYYKHSPRTCRNFLELSRRGYYDNVLFHRIVKDFIVQGGDPTGTGRGGESIYGSKFEDEINKELKHTGAGILSMANAGPNTNGSQFFITLAPQPSLDGKHTIFGRVCRGMEVIKRLGSVQTDNTDSYLSLCEGRDSRKMAFAATLFVPPPVAVRSPARFLGRLSIPCLLQVLPTNGAASPRQVKRAIVANASPGNGGVKAEEEDGVSLGTMKLPVDTDLARFETLLFQWANSLCQGANLPLPVPLKVDRISGGARLGFIVMEDEGKTDVPVYIDCLVFQTTENGVVFQATRNGRKKDKAPPGEERIMRSLLGALKKAVEIARVT

SEQ ID NO: 33155 - protein, 136 aa, Lilium longiflorum
MARTKQTARKSTGGKAPRKQLATKAARKSAPTTGGVKKPHRYRPGTVALREIRKYQKSTDLLIRKLPFQRLVREIAQDYKADLRFQSHAVLALQEAAEAYLVGLFEDTNLCAIHAKRVTIMPKDIQLARRIRGERA

SEQ ID NO: 33156 - protein, 377 aa, Zea mays
MADHRDTGLTLDPKFDAHGLLTAIVTDRTSGELLMVAHMNAEALEATRTTGDAHFWSRSRGRLWKKGESSNNVLRVVEMRIDCDQDAIWLICDPAGRRAGTGRVIRRASALASLLLLAACGQAGEGGDDKAGERLEAASIAAGLVADPAAAPLDGIWSRDTDRMCILPAGTGPARRVGVMLDYGEGQGCTAIGTMERSGAALKLTLGACRFTARFDGDAIQFPATLPSTCNAFCTGRATLSALNVAASAEPLPSVDRDDYSITELCSEFGVTARALRFYEDEGLISPQRRGTQRIYSQRDRARLAWILRGKRVGFSLADIREMIDLYDLGDGRRLQREVTLERCTAKIEALQAQKRDIDAAIAELTEFVALVESHRD

SEQ ID NO: 33157 - protein, 438 aa, Bacillus subtilis subsp. subtilis str. 168
MRNGFGKTLSLGIQHVLAMYAGAIVVPLIVGKAMGLTVEQLTYLVSIDIFMCGVATLLQVWSNRFFGIGLPVVLGCTFTAVSPMIAIGSEYGVSTVYGSIIASGILVILISFFFGKLVSFFPPVVTGSVVTIIGITLMPVAMNNMAGGEGSADFGDLSNLALAFTVLSIIVLLYRFTKGFIKSVSILIGILIGTFIAYFMGKVQFDNVSDAAVVQMIQPFYFGAPSFHAAPIITMSIVAIVSLVESTGVYFALGDLTNRRLTEIDLSKGYRAEGLAVLLGGIFNAFPYTAFSQNVGLVQLTGIKKNAVIVVTGVILMAFGLFPKIAAFTTIIPSAVLGGAMVAMFGMVIAYGIKMLSRIDFAKQENLLIVACSVGLGLGVTVVPDIFKQLPSALTLLTTNGIVAGSFTAVVLNIVYNVFSKAKKIEQEADLAEQKTAV

SEQ ID NO: 33158 - protein, 673 aa, Pediococcus pentosaceus ATCC 25745
MAENNTYYITTPIYYPSGKLHIGNSYTTIACDAEARFQRLEGKDVFFLTGTDEHGLKIEQKAEALNTTPKAYVDGMAEDIKKLWDLLEITNDKFIRTTDDYHEKAVQKIFQKLLDQGDIYLGEYEGWYSVSDEEYFTESQLAEVYRDADGNVTGGKAPSGNEVELVKEESYFFKMSKYADWLLDYYQTHPNFIQPASRMNEMINNFIKPGLEDLAVTRTGFKWGVPIKNDPKHVIYVWIDALSNYITALGYSSDEDGNFKKFWPANVHMVGKEIVRFHTIYWPIMLHALGLEQPDQIYGHGWLLMKDSKMSKSKGNVIYPETIVKNYGLDALRYYLLKAMPYGNDGNFTPEDFISKINFDLANDLGNLLNRTVAMINKYEGGVIPTFQSGVNDVDVDLETTAATTIKNYEDLMNNLHFADALAEIWKLVARTNKYIDETTPWILARNDDDESKQKLASVMNHLAESLRVIAILIQPMMTQSPAKIFAQLGLDVNQLELQGLKFGEIPADTKVVEKGTPIFPRLDVEKEVEFLKNQMTQSDKKKGRAAMAEANQKKAEAVATDQKKEIRIEAFDKVELRVAEVLEAGPVKGADKLLKFKLDAGDEEPRQILSGIAQSYPDPSVLVGKKVVIVANLKPRKMRGEMSQGMILSTEHDDQVKVVMVDDQHQNGDVLG

SEQ ID NO: 33159 - protein, 324 aa, Bacillus subtilis subsp. subtilis str. 168
MKLDAVTFGESMAMFYANEYGGLHEVSTFSKGLAGAESNVACGLARLGFRMGWMSKVGNDQLGTFILQELKKEGVDVSRVIRSQDENPTGLLLKSKVKEGDPQVTYYRKNSAASTLTTAEYPRDYFQCAGHLHVTGIPPALSAEMKDFTYHVMNDMRNAGKTISFDPNVRPSLWPDQATMVHTINDLAGLADWFFPGIAEGELLTGEKTPEGIADYYLKKGASFVAIKLGKEGAYFKTGTSEGFLEGCRVDRVVDTVGAGDGFAVGVISGILDGLSYKDAVQRGNAIGALQVQAPGDMDGLPTREKLASFLSAQRTVHQKKGDY

SEQ ID NO: 33160 - protein, 482 aa, Triticum aestivum
MWRRHLLRRLLPSPATAGTPSPLVRHLSTTPTPFSTTDTTSIASSLAAAVTKLSSTPAPATSPDAYFSLHFSDVRPTNALLAETLSLSPPATSRAAADLFRFLVRRSLHPSDGALALVVRHLARRRDFPAVRTLLQEFPSALGPDTVDAYLFHLARAGRATDALKVFDELPGELRTRGALTSLVSSLSSEGFPQLAERAVKKIAHEIFPDDNICTLLVSGYADAGKLDHALRLIGETRNGGFQPGLDAYNAVLDCVCRLCRKKDPLRMPVEAEKFLVDMEANGIPRDAGTFRVLIKNLCKIRRTEDAMKLFRQMGEWGCSPDADTYLVLIKSLYQAARISEGDELMIWMRSAGFGDKLDRKAYYGFIKVLCGIERVEHAVKVFRLMKGYGHAPGTKSYSLLIEKLARHNLGDRSNALFREAVARGITVTPGVYKIDKRYVKEKKEKKVKKKLTLPEKKILKSKRLYKLKMSFVKKPKRRMRA

SEQ ID NO: 33161 - protein, 373 aa, Staphylococcus epidermidis ATCC 12228
MAELKRGLEGVIAAETKISSIIDSQLTYAGYDIDDLAENAQFEEIIFLLWNYRLPNENELSELKEKLFDYMTLNNRVYKHFEEYVTDHVHPMTALRTSVSYVAHFDPEAENESDENKYDRAIRIQAKIASLVTAFARVRDGKEPVKPNSELSYAANFLYMLRGELPTEVEVEAFNKALILHADHELNASAFTARCAVSSLSDMYSGVVAAIGSLKGPLHGGANERVMSMLKEIGSIDNVDHYLDERFANKDKIMGFGHRVYKDGDPRAKYLREMSRKITEETGQSELFEMSLAIEKRMKEEKGLIPNVDFFSATVFHSMNIPHDLFTPIFAVSRTSGWIAHILEQYRDNRIMRPRAKYIGEQNRKYVPIEERP

SEQ ID NO: 33162 - protein, 262 aa, Solanum demissum
LEVDKIKKWHPQCRLLLRIKAPSDSGSLRPLGKKFGALPEEIESLLHYACNVAGLKVVGVSFHVGSIAQDPTIYREAIANARAVFDVADYLGIPKMQILNIGGGFRSTPLFEEIASVVNEAVQDFFPDPNLKIIAEPGRFFPETAFTLVTHVIGKRVRGEKIEYWIDEGIYGSFRPTLYNSCFVGIKTISMKESCEIGESTIYGPSCDSLDAVAVDIKLPELELDDLIVFYDMGAYSKCAGTKFNGFDMLSTPTYIVSTNST

SEQ ID NO: 33163 - protein, 310 aa, Oryza sativa (japonica cultivar-group)
MVEWTRAEKRTFLRQRVEARLAALLLENQEYTDALTLLTDLIKEVRRLDDKLLLVDIDLLESKLHFSLRNLPKAKASLTAARTAANAIYVPPAQQGTIDIQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDALLEQNLCRLIEPYARVEIAHIAEMIELPVDHVEKKLSQMILDKKFAGTLDQGAGCLIIFEDPKTEAIFPATLETISNVGKVVDSLYMRSAKIMA

SEQ ID NO: 33164 - protein, 403 aa, Vibrio vulnificus CMCP6
MTVEMKVERGLFDEVMVPCYNPMEMIPVKGQGSRIWDQNGNEYIDFAGGIAVSCLGHCHPVMVNALTEQAGKLWHLSNVMTNEPALRLAKKLTEVSFAERVFFANSGAEANEAALKLARRYAADVYGPEKSEIIAFKQGFHGRTFFTVTVGGQAAYSDGFGPKPGDVTHLPYNDIEALQAHISDRTCAVMMEPLQGEGGIIPPTAEFIQAVRELCDKHNALLVFDEVQTGNGRTGEFYAYQGLGVTPDILSTAKSLGGGFPIGAMLTTAKLAEHLKVGTHGSTYGGNPLACAVAEAVVTEVSKPETLQGVKEREQWFREGLAKLNEKYQIFAEIRGKGLLLGAALNEQWKGRARDVLVAAGKEGLLVLVAGANVVRFTPSLVITKQEIEEGFAKLDKAIASLV

SEQ ID NO: 33165 - protein, 238 aa, Arabidopsis thaliana
MSSQICRSASKAAKSLLSSAKNARFFSEGRAIGAAAAVSASGKIPLYASNFARSSGSGVASKSWITGLLALPAAAYMIQDQEVLAAEMERTFIAIKPDGVQRGLISEIISRFERKGFKLVGIKVIVPSKDFAQKHYHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 33166 - protein, 560 aa, Leavenworthia crassa
MTSSTALICDTEAWKDLKKHVEDIKKTHLRDLMNDANRCESMMLEFDGLLLDYSRQRATVETMNKLLKLAKDAQLPEKISRMFNGEHINSTENRSVLHVALRAPKDAVIMADGKNVVPEVWNVLDKIKEFSEKIRSGSWVGATGKPLEDVVPIGIGGTFLGPLFVHTAPQTDPESVECAKGRQLRFLPNIDPVDVARNIKGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFKSTSLEENIPVLLGLLSVWNVSFLGYPARAILPYSQALEKFAPHIQQVSMESNGKGVSIDGLPLPFETGEIDFGEPGTNGQHSFYQLIHQGRVIPCDFIGVVKSQQPVYLKGEIVSNHDELMSNFFAQPDALAYGKTPEQLHKENVSENLIPHKTFSGNRPSLSLLLPELSAYNVGQLLAIYEHRVAVQGFVWGINSFDQWGVELGKVLASQVRKQLHSSRTQGTELDGFNYSTTTLLKRYLETSSEPQM

SEQ ID NO: 33167 - protein, 351 aa, Prochlorococcus marinus str. MIT 9303
MAKQGPMRIGINGFGRIGRLVFRALWGRPGIEICHVNDPSGEAATAAHLLEFDSVHGRWDQLVGGSENQLLVNQQTISYSQGSTPGAVPWNDAGIDIVLECSGKFKSPETLSVYFDQHALKRVIVACPVKGKLAGKEVLNIVYGINHHLYDPKIDHLVTAASCTTNCLAPLVKVVHENFGISHGSITTLHDITNTQVPIDSFQKDLRRARSCLQSLIPTTTGSAKAIAMIFPDLEGKLNGHAVRVPLLNASLTDAVFELKRSITVKDANEAFRHAAEHQLKGILGYEDKPLVSIDYVNDSRSSIIDGLSTMVVNGSQLKVYAWYDNEWGYSSRMADLTCYISNLENTSNTF

SEQ ID NO: 33168 - protein, 110 aa, Ustilago maydis 521
MFSDLECDYINPIDLCNKLNQFILPEMAAHAVLTLFFLLSGQWLAFLLNAPLVAFNVNKVMNKNHTLDATEIFRTLSQHKKVCFIKLGFYLVSFFYYLYRMILALIADTE

SEQ ID NO: 33169 - protein, 953 aa, Ustilago maydis 521
MKGLKKAMNLSRSKSNDSNGNRSGSAGGGTVPAPPPKGGSVPANPAYQGSLKSTKNGPSSASSSFSSLSSSATSAAPSHAPYNVPVYPTGQGTPQTRLLPHGVNNLADKTPPAPPVVVVDVSSEMPADPIPHSVATASQPSSSITPFHHTGSPGSPPPPGAAMASLSSTGIAASELATPPKAASLTRLRQSPSNSGPKDTIPITSKTPPRKQRSSRFHVTEKVELEKLPHFNEVVPADRPELFVRKLRQCSLVFDFNDASQELEGKQIKAATLHEMLDYITTNRKVITDEIYPEVVAMFSANLFRSIPPQVNPVGDAFDPEEDEPVLELAWPHLQIVYEFFLRFVESPDFNTNIAKKFIDHHFVLQLLELFDSEDPRERDFLKTTLHRIYGKFLNLRAFIRRSINNVFFQFIYETERHNGIAELLEILGSIINGFALPLKEEHKTFLTRVLIPLHKVKSLALYHPQLAYCVVQFLEKDSSLTEEVLLGLLRYWPKVNSPKEVMFLNEVEEILDVIEPSEFVKVEVPLFQQLQRCINSQHFQVAERALYFWNNEYIVNLIGDNVQVILPIVFSSLYQNSKAHWNRTIHGLVYNALKLFMEINPALFEMCTNEYKQQRQMEKQKLIDREEAWKRLRDTAIKNSKAIGVEMPASLKEEQAAPAGSVNPYDLDAFDSAADLTAGADSLFEQMGQGINGEVSTTDFDDVEAHRVAQETSQAQQPDLTREDSVDDMKDFPETARQQVNKQESPHVRRKSVIPMDPTVLAELAGHKSLDGGLMRWVGQRVNAGGGGGFGVGVEVHFDVDELICLPDHVVFGITCSSGVFANMHRPTSLYVTLICLLGTVMSVRAATQRVGDSCSYKQNCQDWAEGVGPDWAKGAITCAVPQDGKPEKCGSGDKKGRDEFSGVCKAVGTLSATEYGCACGVHKADCPETSPFSRIFWPQDWLETAWSQVHH

SEQ ID NO: 33170 - protein, 510 aa, Photorhabdus luminescens subsp. laumondii TTO1
MCGIGGVFNTENRLIDDIENKLQTIMSKIAHRGDPSRFNEKVVRNNFSIATNRLAIVERDSAYQPISNQEHDLHLVLNGQIYNYKSLRNELIKQGYQFKNGGDAEVALIAYICYGKSFIKKLDGMFSFILFDNKNNKFLLGRDHVGIKPLYYTQKEGNWYVASEIKSLIEFNSEIKPVEPGSIFDGLTSEKYISYDTTIPASSDNVEQAKEKIYSLLDNAVRKRVDTDLPVSIMFSGGIDSTIVLYLAKKYHHDITAISFGLPGSKDIEIAQRYCTENNIKHIIYTFTQEELINNIQDAIYYGEFFEQIDAIDSTIAHFGYYIANRLGFKIALCGEGSDEIFAGYDLFKTYPDPHHLSLYRLNNLHRTDLQRVDRASMRNTVEARVPFMDSALVPYVLSLDFSYKLNNGIEKYILREAFRGKIPEYIIDRPKIRMPDGSGVKNTIIDYVKDIKCNLPRNMVDSLNSIGLTHQSSLYFAEKYLSLGYPLPKERFKESGKDFSESGYFNFIS

SEQ ID NO: 33171 - protein, 290 aa, Photobacterium sp. SKA34
MNLRQLSTVNALSDNVTACEYQGINIIRVIHPLAEAGISLHGGHLLWFKPQGEKDIIWLSEKAIFDQSKAVRGGIPICWPWFGQAGTPSHGFARTSQWSLLEHRENENVVIVSLALEDNEETYAIWPHKFKNVLTFEVGQDLKVSLTSTNTDNQPWSYSGALHTYLDIANINNIDITGMGPNYLDSTQQGRACEGGTTLTFTSETDRVYTQPESTITINDKNNNREILVTNEGHNAAVIWNPWQALSISMSDMADNSFETMVCVESTIHQPNIELAPGQSHTLATTISSR

SEQ ID NO: 33172 - protein, 490 aa, Silicibacter sp. TM1040
MLDATTDLKSLLADPTLLEDRAYINGAFVAGEGTFEVTNPARGDVIANVADVSRMQARDAIAAAQGAQKEWAKWTGKERAGVLRKWFDLMMAHQEDLAVILTAEMGKPLAEARGEIAYGASFIEFFAEEAKRVYGETIPGHQRDKRITVIKQPIGVAASITPWNFPNAMITRKAGPALAAGCAFVARPASETPLSATALAVLAERAGIPAGVFNVIPASDASGIGKEFCENPIVRKLTFTGSTNVGRILLRQAADQVMKCSMELGGNAPFIVFDDADLDAAVEGAIMCKFRNNGQTCVCANRIYVQSGIYDAFAAKLKEKVEAMKVGDGLEDGTHFGPLISEAAVKKVEDHIADAMDKGAEVILGGAPSELGGTFFEPTIVTGATPDMAFAQDETFGPLAPLFKFETEDEVIEMANDTIFGLASYFYAKDLSRVYKVAEALEYGIVGINTGIISTELAPFGGVKQSGLGREGSHHGIEDYLEMKYLCMSV

SEQ ID NO: 33173 - protein, 331 aa, Photobacterium sp. SKA34
MTIKVGINGFGRIGRFVFRAAQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMIVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIALTDNFVKVVSWYDNEIGYSNKVLDLIAHISK

SEQ ID NO: 33174 - protein, 828 aa, Escherichia coli O157:H7 EDL933
  misc_feature (185)..(185): Xaa can be any naturally occurring amino acid
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVXGFMRTFGMDEPMGCYDDIEQADAFVLWGANMAEMHPILWSRITNRRLSNQDVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 33175 - protein, 436 aa, Solibacter usitatus Ellin6076
MDNETLTITDNRTQQTYTVPIYRGTVRAMDLRQIKKDADDFGLMTYDPAFMNTASCQSAITYLDGEKGILRYRGYPIEQLAEQCSFLEVAYLLLNGELPTAEQLEYWQCKVMRHTMTHENVKKFMDGFHYDAHPMGILISTVAALSTFYPEAKNVGDAKCRHKQIVRLIGKMPTLAAYAYRHRLGLPYIAPDPELGYTKNYMNMLWKRTEPKYAANPVLARALEVLFILHADHEQNCSTSTMRAVGSSNADPFVTTSAAIAALSGPLHGGANEEVLRMLDEIGKPENIPGFIEQVKEGKRKLMGFGHRVYKNYDPRARIIKQVAEEVFEVTGRNPKIDIALELEKIALSDDYFIKRKLYPNVDFYSGIIYQAMGFTPDQFTVLFGIPRTVGWLAQWQEMQQDPDKKIARPRQVYTGEDERDFVPIADRGARAMTAV

SEQ ID NO: 33176 - protein, 220 aa, Arabidopsis thaliana
  misc_feature (121)..(121): Xaa can be any naturally occurring amino acid
MDMIPQLMEGSSAYGGVTNLNIISNNSSSVTGATGGEATQPLSSSSSPSANSSRYENQKRRDWNTFGQYLRNHRPPLSLSRCSGAHVLEFLRYLDQFGKTKVHTNICHFYGHPNPPAPCPXCPLRQAWGSLDALIGRLRAAFEENGGKPETNPFGARAVRLYLREVRDMQSKARGVSYEKKKRKRPLPSSSTSSSSAVASHQQFQMLPGTSSTTQLKFEK

SEQ ID NO: 33177 - protein, 307 aa, Staphylococcus epidermidis ATCC 12228
MNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 33178 - protein, 377 aa, Solanum tuberosum
MPMDTEIKQSGDLIFRSKLPDIYIPKHLPLHSYCFENLSEFNSRPCLIDGANDRIYTYAEVELTSRKVAVGLNKLGIQQKDTIMILLPNCPEFVFAFIGASYLGAISTMANPLFTPAEVVKQAKASSAKIVITQACFAGKVKDYAIENDLKVICVDSAPEGCVHFSELIQSDEHEIPDVKIQPDDVVALPYSSGTTGLPKGVMLTHKGLVTSVAQQVDGENANLYMHSDDVLMCVLPLFHIYSLNSVLLCALRVGAAILIMQKFDIAQFLELIPKHKVTIGPFVPPIVLAIAKSPLVHNYDLSSVRTVMSGAAPLGKELEDAVRAKFPNAKLGQGYGMTEAGPVLAMCLAFAKEPFDIKSGACGTVVRNAEMKIVDP

SEQ ID NO: 33179 - protein, 409 aa, Staphylococcus epidermidis ATCC 12228
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPIALDTTDTQEIIKTVKLIAPNYGGINLEDISAPRCFEIEETLKKETNIPIFHDDQHGTAIVTMAGLINALKIVDKELTNIKVVLNGSGAAGIAIVKLLHAYGVNNMIMCDSKGAIYSGRNFGMNDTKTYVAKWTNKDKVEGSLEEVIKDADVFIGVSVADILTQDMVKTMADDPIIFAMANPNPEINPNEAKQAGAKVVGTGRSDFPNQINNVLAFPGLFRGALDVEATHINEDMKKAAVEAIVHLIDENELHPDYCIPGPFDKRVAPSVAKNVAKAAMESGVARIKIDTQEIFDKTMKLTDLK

SEQ ID NO: 33180 - protein, 393 aa, Synechococcus elongatus PCC 6301
MGKPRIAMTAVSEFRPGLEGVPATLSSISFVDGQRGVLEYRGISIEQLAQQSSFLETAYLLIWGHLPTQQELTEFEHEIRYHRRIKFRIRDMMKCFPDSGHPMDALQASAAALGLFYSRRALDDPEYIRAAVVRLLAKIPTMVAAFQLIRKGNDPIQPRDELDYAANFLYMLTEREPDPVAARIFDICLTLHAEHTINASTFSAMVTASTLTDPYAVVASAVGTLAGPLHGGANEEVLDMLEAIGSVENVEPYLDHCIATKTRIMGFGHRVYKVKDPRAVILQNLAEQLFDIFGHDPYYEIAVAVEKAAAERLSHKGIYPNVDFYSGLVYRKLGIPSDLFTPVFAIARVAGWLAHWKEQLNENRIFRPTQIYTGSHNLDYTPIADRDLAIESD

SEQ ID NO: 33181 - protein, 431 aa, Rickettsia rickettsii
MTNTKSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWLIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLFKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 33182 - protein, 154 aa, Brassica napus
  misc_feature (99)..(99): Xaa can be any naturally occurring amino acid
  misc_feature (102)..(102): Xaa can be any naturally occurring amino acid
  misc_feature (104)..(104): Xaa can be any naturally occurring amino acid
  misc_feature (149)..(149): Xaa can be any naturally occurring amino acid
MDSSNSWINCPSVFSSSSRRCQQSRSDLYIGGGYEDLEGEDDLKSEFICPFCAEVFDIVGLCCHIDEEHPVEAKNGVCPVCTKRVGLDIVGHITTQHAXFFXIXFQTFNRRRRLRKGGGYSSAYLTLKKELREANLQSLLGGSSSFASXTNIDS

SEQ ID NO: 33183 - protein, 386 aa, Escherichia coli K12
MTNNPLIPQSKLPQLGTTIFTQMSALAQQHQAINLSQGFPDFDGPRYLQERLAHHVAQGANQYAPMTGVQALREAIAQKTERLYGYQPDADSDITVTAGATEALYAAITALVRNGDEVICFDPSYDSYAPAIALSGGIVKRMALQPPHFRVDWQEFAALLSERTRLVILNTPHNPSATVWQQADFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTLDDVEFCQWLTQEHGVAAIPLSVFCADPFPHKLIRLCFAKKESTLLAAAERLRQL

SEQ ID NO: 33184 - protein, 382 aa, Kineococcus radiotolerans SRS30216
MRAMVYRGPYRVRVEEKDVPRIEHPNDAIVRVTLAAICGSDLHLYHGLMPDTRVGTTFGHEFIGVVESVGSSVQSLVPGDRVMVPFNISCGSCFYCARGMLSNCHNVNPNATAVGGIYGYSHTAGGYDGGQAEYVRVPFADVGPTLIPEWMHDEDAVLLTDATATGYFGAQLGEIREGDVVVVFGAGPVGLVAARSAWLMGAGRVIVVDHLDYRLEKARTFAQTETVNFAEHDDVVVHLKRITDHLGADVAIDSVGAEADGNFRQHVTGAKLKLQGGSAVALNWAIDSVRKGATISVMGAYGPIPNSVKFGDAVNKGLTLRMNQCPVKRQWPRLFEHVRNGHLTPRDLVTHRIPLEHIAEGYHIFSSKLDDCLKPLIVPTPA

SEQ ID NO: 33185 - protein, 296 aa, Bacillus clausii KSM-K16
MKPTGKYGPVWTAMVTPFQSTGAIDYQQTEQLIEHLIENGTDVLIVAGTTGESPLLSKEEKLELFAFCVKQANGRAAVVAGTGSNDTHASVELTKAAEKTGVDGVMLVTPYYNKPSQQGLFCHFSEIANETNLPVMLYNVPGRTGVNLEAETTIALANVNNIVAIKEASGNLEQIAAIIEHTPASFAVYSGDDSMTLPILAIGGDGIVSVASHLIGKEMQAMIGAFQAGENGKAAMMHRKLLPVMQALFLAPNPACVKYALNKNGIDVGEVKPPLAPVNDQEKAVVDQALATIQSR

SEQ ID NO: 33186 - protein, 827 aa, Rhodobacter capsulatus
MIPLTSELVAIGKTATDKADAIAQAVDLLTAAGKIDPRYGQSMMGREAVANTFLGNGIAIPHGLPQDRDLIHDTAIAVVQLPAGVEWAPGDTARLVVAIAAKSDEHLQVLSNLTDVLGDEAEAERLATTLDAAVIVARLTGAAAPVAAPAETPADFAQGIDVVVTGAHGLHARPATTLVDLAKGFAAEIRIRNGAKVANGKSLISLLNLGAAQGAALRISAEGADATAALAAIAAAFEAGLEDEEDTGAAAPEAATPGLTGAGASMASYEGRTLVGISSSPGYALAPVFRFARDEVVFDTDAADAAFETDRLDTALQTAWHELEELHDEVWKTSGPARAAIFRAHQEFLHDPEMVAEAKALIGQGRSAGFAWHRVFSDRADMLGAMKDAVLSGRAIDLRDAGQRVLQHLGRVRTGETHLPTAPCILLADDLTPSDTARLDPALVRGLATAQGGPTSHTSIIARALDIPAVAGVGPRLLDLATGTPVLLDGGAGVIVVAPTEADKARAETAMAALTAQRELEARERYKPALTVDGARVEVVANISDVAEAIASVEAGAEGVGLLRTEFLFVNREAPPGEDEQLAIYAAMLSALNGLPIIIRTLDVGGDKEIPYLRMPVEQNPFLGERGIRFCLSHEDLFRTQLRAIYRASAGGQVRIMFPMIAMIEELETARRIAEEVRLEVGAAPVEIGIMIEIPSAVMMAPELAKRVDFFSIGTNDLTQYALAMDRMHPVLAKQADGLHPAVLRLIDSTVRAAEAARIWVGACGGIAGDPVGAAVLSGLGVRELSVSIPAVAGIKAQLRHSAMAENRDLARRALACTTAAEVRGLK

SEQ ID NO: 33187 - protein, 459 aa, Photorhabdus luminescens subsp. laumondii TTO1
MAGQSQRSTLKRGLKNRHIQLIALGGSVGTGLFLGIAQTIKMAGPSVILGYAIAGFIAFLIMRQLGEMVVEEPVAGSFSHFAYKYWGDFPGFLSGWNYWAMFTLVGMAELTAVGMYIHYWWPDIPTWVSATIFFVLINTVNLINVRLYGETEFWFSIIKVTAIICMIVFGSYLLVSGNGGPQASITNLWQHGGFMPNGISSLIMAMAVIMFSFGGLELVGITAAEAENPRISIPKATNQVVYRILIFYIGSLTVLLSLYPWGNVVEGESPFVMIFHNLDSFWVANILNIVVLTAALSVYNSGVYCNSRMLYGLAKQGNAPEMLTKVNESGVPIRAIVMSALATSIGVLINYVMPGKAFELLMALVVTTLVINWVMICMAHLKFRAEKVKQGIAPSFKAFWYPFGNYLCLVFLAFILVIILMMDSIRISVILMPFWVGVLWLGFLMSHSRRDKMKTEELG

SEQ ID NO: 33188 - protein, 431 aa, Synechococcus elongatus PCC 7942
MIHEVFMPALSSTMTEGKIVEWVKAPGDRVEKGETVLIVESDKADMDVESFYEGYLATIIVPAGGNAPVGEAIALIAETEAEIEVAKQQAAGAGSAAATPATPAATAAPEPVAVSPEPVAAPTATRSDRLVASPRAKKLAKSLGVDLASLTGSGPHGRIVAADVEAAAGVTAKPAIATPVAPAVVTAPVAAPVATAPAAPAPTPAIAPGQFVPYSTFQQAVVRNMEASLNVPVFRVGYTITTDAIDSLAKQLKPKGVTITVLLAKAVAATLAKHPLLNARATETGVQYNEAINVAIAVAMDDGGLLTPVLGRADQTDLYSLARNWKDLVARSRTKQLKPEEYTTGTFTLSNLGMFGVDRFDAILPPGTGAILAIGASKPTLVATADGLFGVKRQMQVNLTCDHRHIYGAHAAAFLKDLADLIENRPESLTL

SEQ ID NO: 33189 - protein, 916 aa, Streptomyces avermitilis MA-4680
MSENKDPQVADVAESGVAGVKFVYDFTEGNKDLKDLLGGKGANLAEMTNLGLPVPPGFTITTEACKTYLDSGEEPAALRDEVSAHLDALEAKMGKKLGQADDPLLVSVRSGAKFSMPGMMDTVLNIGLSDKSVQGLAKQAGDDRFAWDSYRRLIQMFGKTVLGVDGELFEDALEAAKAAKKVTIDTDLEAADLKRLVTKFKKIVKTEAGRDFPQDAREQMDLAIHAVFDSWNTDRAKLYRRQERIPHDLGTAVNVCSMVFGNLGPDSGTGVAFTRDPASGHQGVYGDYLQNAQGEDVVAGIRNTVPLAELEQIDKKSYDQLMQIMATLENHYKDLCDIEFTIERGQLWMLQTRVGKRTAGAAFRIATQLVDQGLIDEAEALQRVNGAQLAQLMFPRFDDQAKVEQIGRGIAASPGAAVGKAVFDSYTAIKWSRSGEKVILIRRETNPDDLDGMIAAEGILTSRGGKTSHAAVVARGMGKTCVCGAEELEVDTKRRRMTAPGGVVVEEGDVVSIDGSSGKVYLGEVPVVPSPVVEYFEGRMHAGADDADELVAAVHRIMAFADRKRRLRVRANADNAEDALRARRFGAQGIGLCRTEHMFLGDRRELVERLILADTDAEREESLKELLPLQKKDFIELFEAMDGLPVTVRLLDPPLHEFLPDITELSVRVALAESRKDSNENDLRLLQAVHRLHEQNPMLGLRGVRLGLVIPGLFTMQVRAIAEAAAERKAAKGDPRAEIMIPLVGTVQELEIVRDEADQVIAEVQAATGTELKLAIGTMIELPRAALTAGQIAEAAEFFSFGTNDLTQTVWGFSRDDVEASFFTAYLEKGIFGVSPFETIDKDGVGKLVRDAAVAGRATRPDLKLGVCGEHGGDPESVHFFHEVGLDYVSCSPFRIPVARLEAGRAASQSAGSDHR

SEQ ID NO: 33190 - protein, 775 aa, Brucella melitensis 16M
MCLPTIAARGLAAAGANYGARFGLFAPGRRSDCLVGRAFFPKTVSHFSECAQWELAFMQMGMAVLVLVIACGVLSVLFAIWAIRSVLAADQGTQRMQEIAEAIREGASAYLTRQYSTIAIVGIVVFLLAWYLLSLNAAMGFLIGAVLSGVTGFIGMHVSVRANVRTAQAASLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIAGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 33191 - protein, 337 aa, Daucus carota
MAPIKIGINGFGRIGRLVARVALQRDDVELVAVNDPFISTDYMTYMFKYDSVHGAWKHHELKVKDEKTLLFGEKPVAVFGCRNPEEIPWASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYDQIKAAIKEESEGKLKGILGYTEDDVVSTDFVGDSRSSIFDAKAGIALNDNFVKLVSWYDNEWGYSTRVVDLIVHMASVQ

SEQ ID NO: 33192 - protein, 430 aa, Synechococcus elongatus PCC 6301
MKNVLAIILGGGAGSRLYPLTKQRAKPAVPLAGKYRLIDIPVSNCINADINKIYVLTQFNSASLNRHLSQTYNLSSGFGNGFVEVLAAQITPENPNWFQGTADAVRQYLWLIKEWDVDEYLILSGDHLYRMDYSQFIQRHRDTNADITLSVLPIDEKRASDFGLMKLDGSGRVVEFSEKPKGDELRAMQVDTTILGLDPVAAAAQPFIASMGIYVFKRDVLIDLLSHHPEQTDFGKEVIPAAATRYNTQAFLFNDYWEDIGTIASFYEANLALTQQPSPPFSFYDEQAPIYTRARYLPPTKLLDCQVTQSIIGEGCILKQCTVQNSVLGIRSRIEADCVIQDALLMGADFYETSELRHQNRANGKVPMGIGSGSTIRRAIVDKNAHIGQNVQIVNKDHVEEADREDLGFMIRSGIVVVVKGAVIPDNTVI

SEQ ID NO: 33193 - protein, 236 aa, Oryza sativa (indica cultivar-group)
MGMGTFTTDESDKHEESYLSLGLTVSQSKKNNTEYPKVLLLLAAYLDRSVQKNEDLLDSNKIKDSSTIFHGHRAPDLSIKLYAERIFKYSECSPSCFVLALIYMERYLQQPHVYMTSLSVHRLLITSVVVAAKFTDDAFFNNAFYARVGGISTVEMNRLELDLLFNLDFRLKVDLETFGSYCLQLEKETMVLVIDRPIQQVHGVNSAKDLSRNSSIDESCKSELMRYSSQALQGCS

SEQ ID NO: 33194 - protein, 157 aa, Glycine max
FWSHAVKLGPKITDTVKGKLSLGARILQVGGVEKVFMQLFSVKDGGEKLLKACQCYISTTSGPLAGLLFISTDKVAFCSDRSIKAYSSKGHLIRIHYKVVIPLEKIRSINQSQHVKKPSQKYIEIVTVDNFDFWFMGFLNYQKAFKYLKQAISQAQA

SEQ ID NO: 33195 - protein, 247 aa, Trifolium repens
NIAVGTPAEATHPDTLKAGLAELISTFIFVFAGSGSGIAYNKLTDNGAASPAGLISASIAHAFALFVAVSVGANISGGHVNPAVTFGAFVGGNITLFRGIVYIIAQLIGSVLASLLLVFVTASSVPAFALSEGVGIGPALVLEIVMTFGLVYTVYATAVDPKKGNIGIIAPIAIGFIVGANILVGGAFTGASMNPAVSFGPAVVSWSWSNHWIYWAGPLIGGGIAGIIYEVLFISHTGHEQLPTTDY

SEQ ID NO: 33196 - protein, 466 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTEAIEKLFEANKGEIAAVFLEPVVGNAGFIVPKPDFHSFLRKITKENNTLLVFDEVMTGFRLSYGGAQEYFGITPDITTLGKIIGGGLPVGAYGGRRDIMEKVAPAGPMYQAGTLSGNPLAMTAGIETLQRIKEPGTYEYLDKITGELVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 33197 - protein, 244 aa, Triticum aestivum
  misc_feature (78)..(78): Xaa can be any naturally occurring amino acid
  misc_feature (85)..(85): Xaa can be any naturally occurring amino acid
MLTKGRRVAGRGEDMSAHYAFGPHEDDAIIKHRLLTRTTTTRGEPPLKKLQKKFMSFATEVEKDADNTSDCERLYKAXFLLDINXFWTLPLLKSKAVVDANLREKESFNELQVEIQRQILQAQTDIEDLKKQLEQSKIERQHKEECEAIRKLISSQPPRSETEKLIANLEKEIANLEAESAACTRTLELRKKQFALLLHVVEELQISIEDEQRNIADELRAATEEPKLSIEEGSGGASDAMAVD

SEQ ID NO: 33198 - protein, 412 aa, Escherichia coli K12
MKALTYHGPHHVQVENVPDPGVEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLHFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLSFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 33199 - protein, 809 aa, Escherichia coli
MPVSACRAVARAVVGQQEAIKWDKAPCRFCGTGCGVLVGTQQGRVVACQGDPDAPVNRGLNCIKGYFLPKIMYGKDRLRQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 33200 - protein, 403 aa, Ustilago maydis 521
MAGAQRGSRVVFVGNIPYDMSEEQLTDVFREVGKVVGFRLVNDRETGKFKGYGFCEFEDPETAASAVRNLNEVEVGGRPLRISFADIDPLMEGRSTQHGQFDQDDLRRRAAAAGRAGRPGTFGHGGTARGGGMAGGGGWQQRGPADSGFGQRQFGGPPGGQAYGGPVGAQMGGGAPGGYAGAGAASMGVGGGPYTLPANLPAGVPLPAGVGSTDAITQTLATLPPNQLLDIMSQMKSLVATSPDQARALLTGHPQLAYALFQAMLMMNVVDPDILQRILAASGAVPGAVAAAAASVPPHMQTHSGASNGSATPPQRYGTAAAATRYAAPARPPPTSYAQPGYGGAPSAPAANDAVAALAGQNLPEEQKALLMQVLQLTPDQINALPPDQKASILQLKAQFGQA

SEQ ID NO: 33201 - protein, 292 aa, Debaryomyces hansenii CBS767
MPLITFTGLPSSGKTKWAKKLQLLLEDKINSAKESNGPGHNYSIIYHSDETLGISHDSYKDSNMEKHARGSQMSAVKRDLSRTNFVILDSLAYIKGFRYQLYCEAKGVVTPHCVIHVMSSLNTSIQWNNENNDEKKWDDELIKQLSMRYEEPNNDTRWDSPLFTIMSDYDKETLPIDEIWDCLVLKRPPPPNAATLVKPTSGNDFLQELDKQTLAVIGKIVQHQQLMSIGGEALIDKEKKLFIEMPATSVSIAQLQRIRRSYISLNRMRSVDVDRITPLFVEYVNRSLDNDD

SEQ ID NO: 33202 - protein, 953 aa, Yarrowia lipolytica CLIB122
MIEGISFASFVTHEKPKFVRALDFYKALGFLPTKEYKHGTDHHATDEEGAGSIQEVWLTSSRAGVPSVTVKLRLSRHGNEHVSLPNLKHDWRSLVPSLVYYAPDLDAVRAAITPFLHEDHSTLLERPSHTNFIELYAIDPMGNLVGFSRRENPYSSAMQKPFSADDIGPQNFSKPNETKIKGKKRIGVMTSGGDAPGMCAAVRAVVRAGIARGCEVYAVREGYEGLVKGGDLIEPLSWEDVRGWLSLGGTLIGTARCKEFREREGRLAGALNMVKNGIDALIVIGGDGSLTGADLFREEWPSLIEELVTNGSITAEQAERHRHLDICGMVGSIDNDMATTDVTIGAYSSLDRICELVDFIDATAQSHSRAFVVEVMGRHCGWLALMAGTATGADYIFIPEAAPDATQWAEKMTRVVKRHRSQGKRKTVVIVAEGAIDSDLNPITAKMVKDVLDGIGLDTRISTLGHVQRGGPPVAADRVLASLQGVEAIDAILSLTPETPSPMIALNENKITRKPLVESVALTKKVADAIGNKDFAEAMRLRNPEFVEQLQGFLLTNSADKDRPQEPAKDPLRVAIVCTGAPAGGMNAAIRSAVLYGLARGHQMFAIHNGWSGLVKNGDDAVRELTWLEVEPLCQKGGCEIGTNRSLPECDLGMIAYHFQRQRFDGLIVIGGFEAFRALNQLDDARHAYPALRIPMVGIPATISNNVPGTDYSLGADTCLNSLVQYCDVLKTSASATRLRLFVVEVQGGNSGYIATVAGLITGAYVVYTPESGINLRLLQHDISYLKDTFAHQADVNRTGKLLLRNERSSNVFTTDVITGIINEEAKGSFDARTAIPGHVQQGGHPSPTDRVRAQRFAIKAVQFIEEHHGSKNNADHCVILGVRGSKFKYTSVSHLYAHKTEHGARRPKHSYWHAIGDIANMLVGRKAPPLPETLNDEIEKNIAKEQGIIDPC

SEQ ID NO: 33203 - protein, 377 aa, Thermoplasma acidophilum
MQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 33204 - protein, 513 aa, Nicotiana tabacum
MEKEKKIDMEEKHEKELKEKEKKDKVKNTGSEEESEETEDEKDGATKNVKEKKYKKEKKEKKDKEKKDKSKEEESEEETEEEKDDGKGKKDKKKKHKTDMKEKKDKEMKDKSKHESEKEDSKEIEEEKDDGEGEKKDKEKKLKKGKKDRKEKEKKDKSIEESKEEKDDDKGEKKDKEQKDKKEKKNKEEKGKSKGESEEETEEEKDDEKGKNKESDEEDERQTEEEENDEKGVKKDKEKKNKEKKEKKDNEKKDKSKEETEEEKDDEKGEKKDKEKKCKKNKKEKKDKETKDKSKEVSDEEEEKDDEEGEKKDKKKKHNKDKKETKDKEKKYKSKEESEEEDKKETEEEKDDDEEGQKKEKEKKNKKDKKEKKDKEKKVKSKEESDEEDKQDKVNEVEVATREIKIEDDKKISDGEADEKGKRKEKGKDSKDEKQKDAKKDKAEKTRKLEDKYKSNGKLKSKLEKINAKLEALQQKKADIMKTIKEAEDKNLAVVESPKEADLKAHDGVMTEQ

SEQ ID NO: 33205 - protein, 650 aa, Photorhabdus luminescens subsp. laumondii TTO1
MDSDILRTSLLIRETEEALLRLYSTGELHGTVHTCIGQELTGAIVCKFLKKNDWVFSNHRCHGHFLSRTGDVTGLIAEVMGKETGVCGGRGGSQHLCKEGFFSNGIQGGILPVATGAAFAKKLRHDNSISIAFIGDGTLGEGVVYEVLNIAAKWDLPLLIVLENNQYAQSTHISETLSGSISKRAQAFGMRYTKSDVWNWEHLIAETEELINYTRNQRHPAFLQIDTYRLKAHSKGDDLRNIDEIEHFNTIDPINVILRERAAELETEVAGVQERVNDAIRKAKQARSSPFYGAETQLQSRSSTFHPLPSQGSKIRLSRAINKAFLEIMELDKNILFIGEDVKAPYGGAFKISDGLSDSFPEQVINTPISESAIVGIGCGLAMHGYCPFVEIMFGDFLTLAFDQILNHAAKFRDMYNDQVKVPLVIRTPMGAGRGYGPTHSQTLEKHFMGIPGLTILAINNLIDPAIVYKTLAKQEEGPVLLIENKILYTKSIRNAPLGFTSYASDDPFPAVVVSPLSTNVDVVIFGYGGLSDLLVDVAEELFVEHDVIAQVICPLQIYPFSVIPYIKLVSKCKIAIIVEEGQGFAGFGSEVVAQLTEILGKLLPRTIRIYPSSMAIPSSKALENLMIPGKDMLIERILKAYISEAEPQQ

SEQ ID NO: 33206 - protein, 873 aa, Solibacter usitatus Ellin6076
MFMAPLWILKFATLVSACLAAYGILTPLTAPGRRGHLRGRLLFQLLTRMGPASIKIGQILSTQGGLFSAGVIAGLSKLLDDVPPCGRRYVQKTIETDIGKPMSTIFESFDWQAVASASIAQVHRGVLASGQCVAVKVIRRGVPGELKISLGVFGFAVRLAHHLLPSLRQRNLPAHFAKIERLLLLQADLRNEANNQTRIRRNFEGHPFVRVPRPYAEYSGGNVLVMEFMDGLRGLEFAGVELAPPLLACRLQEAFYTMAYLHGVFHADLHPGNIMFTKCGEIILLDFGVVGILDENEKWGLCAFYYAATRGDWKLAVERFTRYFVIGADSIADTTGCGSALEKVLRKHFELQTNKWSTIGFAEEANLVLRDFGARFTTNFSNLVLAFVSGEGFVARVDPDIDIWNNARRFTDRASPYMSQEVRKRFDSSLAPFMPRSVDWRARAARSLVAPTHLDPYMLPSEYPIFVRRAQGCEVEDFDGNTYIDLACGFGPHLLGYGNPVLREALTAAVDVGVNAIGHAAEVELAEELTAAFPGADKVIFANSGTEAVLQALRLTRAFRKRRRIAKFEGHYHGHSDQGVVSSWFRFAGTESEPEPFIDLPGVDQRAVGDMLILQYGDPLSLRRLRTAADELACVICEPMPSTLGCYDREFLLQLRAICSESGVPLIFDEIVTGFRVAFGGIQTLLGIEPDVSCLGKIIGGGLPCAAVVGHREIIDLARGSNDPFIDSESKVFVGGTFSGNAYSCTAGLAILRYLRQRPEIYVRLDDQTRTLVAELKAAADSRHVAVQVSGTRSILTLTFDHQNASHFRGKQTGTNHRANLALSYYMRRHRVHLPELHTMLLNAALEDVHISTIIAAFDQSLAEMVEDGFFLS

SEQ ID NO: 33207 - protein, 146 aa, Pseudomonas syringae pv. tomato str. DC3000
MKTVAQLLKLKDLHNQHVHTIGPNQMVLDALRLMADKNIGALPVVENGTVVGVVSERDYARKVVLKGRSSVGTPVSEIMSSKVITVDSQQTVETCMGIMTDSHLRHLPVVEDGQLLGLLSIGDLVKEAIAEQASLIQQLEQYIRGE

SEQ ID NO: 33208 - protein, 497 aa, Aspergillus nidulans FGSC A4
MRLLTALKTAPLLAACVVAKANYPAIPVDTTTPVQQRLAIYGPNSISIGWNTYEKLNESCVEYGTSSEKLDRRACALVEPTTYPTSRTYENVVILTDLTAGTTYYYKIVSTNSTVDHFLSPRVPGDETPFSINAVIDLGVYGEDGYTIKGDKSKKDTIPTINPALNHTTIGRLASTVDDYEFVIHPGDFAYADDWFLSLDNLLDGENAYQAILENFYEQLAPISGRKPYMASPGNHEAACQEIPFTTGLCPDGQKNFTDFMHRFGRTMPSSFTSVSTNDSAKVFANQARELAQPPFWYSFEYGMAHIVMINTETDFEDAPSGKGGSAHLNGGPFGAKNQQLEFLEADLASVDRDVTPWVIVAGHRPWYTAGSACTPCQEAFEDLLYTYGVDLGVFGHVHNAQRFLPVYNSVADPNGMQDPKAPMYIVAGGAGNIEGLSSITKQLDFTEFANDEDYTYSTIRFLDRNHLQVDFINSVSGEVLDTSTLYKSHEARFVRQ

SEQ ID NO: 33209 - protein, 360 aa, Synechococcus elongatus PCC 6301
MAVRKLGVLTSGGDCPGLNAVIRAIARHAVGNYGWELWGIAYATQGLLKRQAIALSPHHFDRQSLDPLLCSGGTILGSINRGDTLAHQAEILAGYQELGLDALIGIGGDGSLAILRQLAEAGRWQFIGIPKTIDNDVALTERAIGFDTAIHTVAEALLSLGSTAASHDRIMIAEVMGRQSGHLALQGGIAGGADVILLPEIPYRLLELCHYLQQLRDRWQRRYAVIAIAEGTHHPPEVTQGPGSLGEQLVQAITAQDPTLDARVTVLGHVQRGGNPVASDRLLATQMGYAAVERLAAGASGEMMAWQGGRVVSVPLEAVCLQSPTLVDPHSPPVDTAAGLGIFLGDRSLTPWRGSACPTH

SEQ ID NO: 33210 - protein, 391 aa, Xanthomonas oryzae pv. oryzae KACC10331
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDQTLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHHVGKSLNEPDLIPTANQIVADAKTRGAEIPLPTDVVVAKQFLPDAEASVKALDAVDADDLILDIGPQTAQRYAELIASAGTVVWNGPVGVFEFESFSHGTETLARAIASSKAFSIAGGGDTLAAVDKYDIAKDVTYISTGGGAFLEFLEGKTLPAVAALQARGQ

SEQ ID NO: 33211 - protein, 256 aa, Vibrio vulnificus CMCP6
MRRPVVMGNWKLNGSKTMVAELLTGLNAELEGVEGVDVAVAPPALYIDLAERLIAEGGNKIILGAQNTDINNSGAFTGDMSPAMLKDFGATHIIIGHSERREYHNESDEFVAKKFAFLKENGLKPVFCIGETEAQNEAGETEAVCARQINAVIDAYGVEALNGAIIAYEPIWAIGTGKAATAEDAQRIHASIRAMIAAKDAAVAEQVIIQYGGSVKPENAEAYFAQPDIDGALVGGASLDAKSFAAIAKAAAKMKA

SEQ ID NO: 33212 - protein, 198 aa, Glycine max
MFAEENGLKGDPRLQAISQAIRVVPHFPKHGIMFQDITTLLLDHKAFKDTVDIFVDRYRDMHISVVAGIEARGFMFGPSIALGIGAKFVPLRKPRKLPGEVISEKYALEYGTDCLELHVGAAQPGERAIIIDDLVATGGTLSAGVKLLERVGAEVVECACVIGVPDVKGQCRSIGKPLYVLVEPRKADKCQAQADKCY

SEQ ID NO: 33213 - protein, 241 aa, Synechococcus elongatus PCC 6301
MLLNTRKPVMDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 33214 - protein, 359 aa, Yarrowia lipolytica CLIB122
MLVKLRDTKRQQWTVDVEPSDTVETLKTKNAEGKDYGVGDQKMIYSGKILANTTSIESLNLKEDAFIICMISKPKVKAAAAAPAAAAPVAAAPAAAEPAVAPVTPATSRSVATPGAPTNSGNVVGNTETPTTGGADASTTGDIGAESGPAASATAAVTTAINNMVDMGYPRDQVEAAMRAAYNNPERAVEYLLTGIPDHVIGEEADDDVPESNTDTDLFAEAVAQQGQGASVAPNTSALDFLRDNPQFIEMRRMVQQQPHLLEPLIQQLAASNPQLAALITQNSEAFLHLLGEGLEEGSGGVPEGTTEIQVTPEESDAIERLAALGFERNLVIQAYFACDKNEEVTANYLLEHGYDDDE

SEQ ID NO: 33215 - protein, 889 aa, Pseudomonas syringae pv. tomato str. DC3000
MAQQPRFLDEDPQETREWLESIESVLNSEGRPRAHYLIDQLLDFDVAQHGDFYGRVTTPYVNTIPLDRQQPYPGDLQVEKRINAFIRWNALAMVLRAGKHSGVGGHIASYASAAVLYDVGFDHFFRGRTEQFAGDLVYIQGHSSPGIYGRAYLEGRLSEEQLDNFRRETDRDGISSYPHPRLMPDFWQFPTVSMGLGPITAAYHARFMRYLENRGLKEHQGRKVWAFLGDGEMDQPESQAAVALAGREKLDNIIFVVNCNLQRLDGPVRGNSKVIQEFESLYRAAGWNVIKVIWGGGWDALLEKDKSGLLRQRMMECVDGEYQNYKSQNGAYVREHFFGKYPELLELVSDLSDDDIWKLSRGGHDPEKVYNAYAAAMRHQGGPTVILAKTVKGFGMGEAGEGQNINHQLKKLGADAIKAFRDRFALDITDDQLGDMPYLKPAEGSTEALYLKARRAQLGGYIPARFSDAATLQVPPLSALDTQLKNTGDRGISTTMAFVRILSTLLKDPNIGKLIVPIVPDESRTFGMENLFRQIGIHSHVGQLYTPQDAGQLSYYKESTDGQIMQEGLNESGAISSWIAASTSYANHGVMTVPFYIFYSMFGFQRVGDLAWAAGDARARGFLLGATSGRTTLMGEGLQHDDGHSHVMSSTIPCCVSYDPTFAFELAVIIQDGMRRMFAENEDIYYYITLPNENYPHPDLPEGAEPGILKGMYPLQASASINTGKHVQLMGCGSILLEVIAAARLLEDDFGVSSEIWSVTSLTELRREGQDVERWNLLNPEQEPRLSYVESCLADREGPVVVATDYMKIFADQIRPFVPLRRFVALGTDGFGQSDTRESLRHFFEVDRYFVAVAALKALADDGKVERKVVAQAIERYKINPDKQNPVLV

SEQ ID NO: 33216 - protein, 303 aa, Populus tremula
DVYFWEAKGQTPLYPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 33217 - protein, 543 aa, Triticum aestivum
  misc_feature (280)..(280): Xaa can be any naturally occurring amino acid
  misc_feature (297)..(297): Xaa can be any naturally occurring amino acid
MGSLPEQQQQQVVFRSTLPDIVIPDHLPLHDYVFERLAERRDRACLIDGATGETLTVGDVHRLSRRVAAGLYSLGVRHGSTVMLLLPNCVEFALAFLAASRLGAATTTANPLHTPPEIAKQAAASRATLVVTEPAFVAKVRGLAGVVIVATGDGAEGCASFSDLAAADDSALHEAPIDVASDVVALPYSSGTTGLPKGGMLSHRGLVTRVPQLVDGDNPNRPLREDDGVLCVLPMCHVYSLHSILLCGLRPGAALVVMRRFDTVKMIQLVEPPGITIGPXVPPIVVEMARGDPMDRXDLPSVRWVISGAAPMGKELQDIIHAKLPNAVLGQGNSARQRQGPVLSMCMAFAKEPSPVKSGACGTVVRNAELKIVDPETGVCLGRNQPGEICIRGRQIMKGYLDNPEATAETVDKEGWLHTGDVGFVDADDEIFIVDRLKELIKYKGFQVAPAELEAMLIAHPGIADAAVVPMKDDASGEVPVAFVVPSSDSADMTEDEIKQYVAKQVVFYKRLQKVFFVSTIPKAPSGKILRKDLRAKLAVGSC

SEQ ID NO: 33218 - protein, 303 aa, Populus tremula
DVYFWEAKGQTPLYPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECGHVGWGVAVLVGVPSKDDEFKTHPMNLLNERTLKGAFFGNYKPRTDLPGVVEKYMNKELEVEKFITHS

SEQ ID NO: 33219 - protein, 130 aa, Nicotiana tabacum
GAAIEYAVLHLKVENIVVIGHSACGGIKGLMSLPADGSESTAFIEDWVKIGLPAKAKVQGEHVDKCFADQCTACEKEAVNVSLGNLLTYPFVREGLVKKTLALKGGHYDFVNGGFELWGLEFGLSPSLSV

SEQ ID NO: 33220 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 33221 - protein, 574 aa, Staphylococcus carnosus
MAKQIKGIAASDGVAIAKAYLLVEPDLSFDNESVTDTDAEVAKFNGALNKSKVELTKIRNNAEKQLGADKAAIFDAHLLVLEDPELIQPIEDKIKNESVNAAQALTDVSNQFITIFESMDNEYIAERAKADIRDVSKRVLAHILGVELPNPSIVDESVVIIGNDLTPSDTAQLNKEYVQGFVTNIGGRTSHSAIMSRSLEIPAVVGTKSITEEVEAGDTIVVDGMTGDVLINPSDEVIAEYQEKRENFFKDKQELQKLRDAESVTADGHHVELAANIGTPNDLPGVIENGAEGIGLYRTEFLYMGRDQMPTEEEQFEAYKAVLEAMKGKRVVVRTLDIGGDKELPYLDLPEEMNPFLGYRAIRLCLDQPEIFRPQLRALLRASVFGKLNIMFPMVATIQEFRDAKAFLKKNVLTLKMKAMKVADDIELGIMVEIPSTAALADIFAKEVDFFSIGTNDLIQYTMAADRMSERVSYLYQPYISNFSFLVKQVIEASHAEGKWTGMCGEMAGDQTAIPLLLGLGLDEFSMSATSILKARVLIRSLNESEMKELSERAVQCATSEEVVDLVEEYTKNA

SEQ ID NO: 33222 - protein, 452 aa, Escherichia coli O157:H7 EDL933
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFFYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHQELLQKRNGG

SEQ ID NO: 33223 - protein, 550 aa, Cryptococcus neoformans var. neoformans JEC21
MTDVYDVDAMREKLAGPSGITGLIRNRRLFGISMLTALGGLCYGYEQGSYGQVQVMPSFTRIPAFERIVTDASFKGWTVAVLGLGGWVGALINGYCCDRFSRRWSIFGGAIVCIVGTILTAAAVNSAMIFVGRFAIGLAVGSLSTAVPTYNSEISSAEVRGAMVGTWQLSVTIGILFSYWIGFGTNYISNTNTVAWRLPLALQAVPAIGLAIGAFFIPYSPRWLLKQGRDEEALRTLAYIRDMDADSELVRLEYLEIKADAIFERETAAEKFPTLLNRPFALQFAQIGSLFTTWPMFRRTAIACLMMFFQQMSGIDAIIFYAPTIFASLGIGSTAISLLASGVVGIMGVLSTFPALVIMDRVGRRPLIIVGGLGMSFCLIIVAALTATFQNSWSTHAGAAWTSAVFIWIYCFNFGYSWGPVSWTVIAEVMPMSARAPGTALAASANWMLNFCVSLMVPPMLENITYGTYLFFLAFMLLGVAYAIWILPETRNVGLEAMDKVFKSNDATRDAAKMHAIMERLREEHGQYDQPGAPREIHEDKLEVQYLESV

SEQ ID NO: 33224 - protein, 121 aa, Glycine max
MAPALQASTAMLARRQLTSSSLVAARLFVAQQRGYATPQGPPPANFRTSRQVQWTWDKESTLDRVGKFFLMTEMARGMYVLLEQFFRPPYTIYYPFEKGPISPRFRGEHALRRYPSGEERC

SEQ ID NO: 33225 - protein, 649 aa, Lactobacillus johnsonii NCC 533
MCGICAFFDPELKDKDCAIQGMMDTIKHRGPSSDGKYTNDKVALGFRRLSIIDLRGGSQPIFNEDKSRAIIFNGEIYNFKPLRKELIDAGHTFTTKADTEVLLHGYEEWGMDGLLKKVRGMFAFVIWDDNTKTLYGARDFFGIKPMYYSDQNGKLIVGSELKSFLAYPGFKKELNTEAVKPYLMNQYNDLKETFFKGVYRFPAGHWFEYKDGKMKTHQYWDAKYVENSLSFEETLDKINEDLKETVDLYRNADVPVGAFLSEGIDSSYLTSLLDPEDVFSVSFDDSTYNEASKAKALSDLHGWKFFADKVDADEAMRDFPEMQYHMDEPDANPSIIPLWYLCKLARKHVTVALSGEGADELFAGYVNYGMHTHNDVIKVFTAGLKKLPKKSRVRLAHKIKKMPNFPGKVHMYTNLAEPSEFYVGQSVIYDMDYPTIFTSKDANGILRDKYKNDLTVNGIYQEDFKKVKNIDEVKQMQYIDLHHFMLNDIEQKADKISMAHSLELRVPYLDKKIAELANSIPTKYLVNRHDTKYALRKASEKVLPEEWAQRPKLGFPTPIKQWLKEPRFYKQVRALFTEDFVDDIFDQKKIVKLLDDNYKGDGSARRQIWAIYTFLVWYKLFFVDYDETVKKYQHVQPEVAELIESGRLV

SEQ ID NO: 33226 - protein, 674 aa, Emericella nidulans
MPPKLFKKLVIAVSGTFPGYRQGRNFCDVQFLIEFFKSTTRELTRHSYAGDLKAIVERHGATFTSSVGTDCTHLIATQKEADKKGAKLSLDWLLDSDKAKKPVSEAPYRFGASHSNRNSQADPAKSEKKRSAKAVQDTDDDRSNKKPKQIMEDAQMITAEKAAKVRVRVDEYYHSNEHTWQVFIDDSGLIWDATLNLTVSAANNNKFYLIQILNSKDGSRYQTWTRWGRVGERGQSVLLGDGTLDSAKKQFEKKFKDKSGLAWKDRLNSPKNNKYTFIERNYEESDDEDEKSDNKLVKQPSNIPASKLPAPVQNVISFIFNQKYFLETMAQMSYDANKLPLGKLSKRTLMAGYETLKELAELATKPSMAMSKYGMQLRPAMEQLSNRYFTTIPHVFGRNRPPVLDNQAYIKREIELLETLTDMEITNSILKDASKMEDANPLDSQYAGLGMQEMTPLDHASEEFRELEKYLSGTRGSTHGVKYKIDIFRIERQGEHDRFKSSSYAGLKNSNRRLLWHGSRSTNYGGILSQGLRIAPPEAPVSGYMFGKGVYFADMSSKSANYCWSHNSDHKALLLLGDVELGDPIYELYDSDYNAGENAKKEGKIATLGKGRSIPAGWKDAGCIHPHLKGIQVPDADSGTTDHKTDQGYLLYNEYIVYDVAQIRLRYLFFVDMR

SEQ ID NO: 33227 - protein, 329 aa, Kluyveromyces marxianus
MVSIAINGFGRIGRLVLRIALERKNIDVVAINDPFISVDYAAYMFKYDSTHGKYKGEVSHDGSNLIINGKKVAVFQEKDPATLPWGKLGVDIAVDSTGVFKELDSAQKHIDAGAKKVVITAPSKTAPMFVVGVNEDKYNGEKIVSNASCTTNCLAPIAKIINDEFGIEEGLMTTVHSITATQKTVDGPSHKDWRGGRTASGNIIPSSTGAAKAVGKVLPELQGKLTGMAFRVPTTDVSVVDLTVKLVKAATYDEIKAAVKKVSEGKLKDVVGYTEDAVVSSDFLGDTHSTIFDAAAGIQLSPKFVKLVAWYDNEYGYSTRVVDLVEHVA

SEQ ID NO: 33228 - protein, 331 aa, Kluyveromyces marxianus
MVRIAINGFGRIGRLVLRIALSRKNIEVVAINDPFITVDYAAYMFKYDSTHGRFDGEVSHDGKALIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 33229 - protein, 524 aa, Glycine max
MGFTPTSTATCFLIIAPLVVLWCWKLLKWVWLRPKRLERALRAQGLQGNPYSLLIGDTKEMYTVLMQAARSQQSTSSFLSKDKDAAPHITTFNHHIVNKFGKNSFFWEGTKPKVVITDPEQIKEVFNKIQDFEKPKLSPIVKLLGSGLANLEGEKWRTHRKIINPAFHLEKLKVMLPIFLECCDDMVSKWERLLSSNDKSEIDVWPFLQNLTCDIISRTAFGSSYEDGKRIFELLKEQTGLMMKLQNAYIPGWWLLPTTTNKRMKKIDTEIRALLKGVINKRENAMKAGEVLNNDLLGMLLESNRMEIQDHGKNNIIAMTSLEVIEECNAFYIAGQETTSVLLVWTMVLLSRYPHWQERAREEVLHVFGNQKPDYNGLSHLKIVTMILYEVLRLYPPLIYFARAIKNDVKLGNLSLPAGVQVSLPILLIHQDRDIWGDDATEFNPERFAEGVAKATKGQVVFFPFGWGPRVCLGQNFALLEAKLVLSLLLQRFSFELSPTYAHAPVTVLTLNPKFGAHIILHKL

SEQ ID NO: 33230 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKDLEVEKFITHS

SEQ ID NO: 33231 - protein, 425 aa, Vibrio vulnificus CMCP6
MSDDNSQQMTPEEVLRQQALDYHALPTAGKIAVALTKPAETAKDLALAYSPGVAEPVREIAQNPDNVYKYTSKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLNECIIVCLGAGAAAVACMELLIKCGAMREKIYMLDRKGVIHTRRDDLNEYKQLFANNTDKRTLEDVISGADLFLGVSGPNLMPAEALKLMADKPVVFACSNPDPEIKPELAHEVRSDLIMGTGRSDYPNQVNNVLCFPFIFRGALDVRASEINDEMKLAAVEAIRQLAKEPVPEAVLKAAGVESLSFGPQYIIPKPMDSRLLPRVAKAVAQAAVDTGVARIPMPENYMAE

SEQ ID NO: 33232 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNEGTLKGTFFGNYKPRTDLPGVVEKYMNKELEVEKFITHS

SEQ ID NO: 33233 - protein, 158 aa, Oryza sativa (japonica cultivar-group)
MEIKMKGIFKGLKIISQIFALQKQQEMEIGCPTDVRHVSHIGVGTSDSCPSWMSEFRGLEELSAGSMGSFAQSRKTSWASQDFDKPPRATLPTEVCTDKSGQEAASCCHDIPRGPKNPRRKKAARASSASSFLSRSRSSSFVTACGDFSELRGGLRVA

SEQ ID NO: 33234 - protein, 407 aa, Arabidopsis thaliana
MAGVIHVSSTQIPVAFMSATKQSFRRASVIRCAANTPKKRYTIAVLPGDGVGNEVIPVAVDVLCLAGSLEGIDFSFEELPIGGVALDLVGVPLPKETLIRAKQSDALLLGAVGWPKWDNNPKHLKPITALLQLRAALQVFANLRPITVLPQLVDSTYLRKDTAQGVDLLIIRELTGGIYNAHPRGFTTNEQGDEVGFCTESYSASEVDHIARVAFDIAKQRRGKLCSVDKATILEGSMLWRKRVTAIASEYPEVEVSHLLIDTAAMDLVRHPRQFDTILTGVMFGDILSDLAAMIPGSVGLLPSAALGDSGPGIFEPVHGSAPKHYGKDTVNPIAAVLSAAMLLRYGLKEENAAKRIEEAVSDVLDRGFRTRDIHTPGTTLVGCKRMGEEILRSLDAKVSASTGNLV

SEQ ID NO: 33235 - protein, 496 aa, Rhodopirellula baltica SH 1
MICVSLGRARHKRMIAEHQFLVEQGAQLVELRLDYISRAVDLKRLLNDRPGPVVATVRRKEDGGRWERSEQDRLMLLRSVIAAGAEYVDIEADVAAQIPRYGNTKRIISYHDFSGTPENLDELHEAMAAEDADIVKIACMANSFSDNIRMINLCKNAKIPTIGICMGEIGMLTRILANRVGSPFTYATFSSDKKLAPGQLNWKEMNSVYHYETIKEDTALFGVIADPVAHSHSPLIHNAAFVDAGLNARYLPLRVPKDDLPSFMRTCKELGIQGISITIPHKESALQYCTQAESSCTGIGAINTMIFNGDDRLGYNTDYRAAMDCIEESFKIERGTENSLQGKTALVLGAGGVSRAIAWGLRQRKCDVTISSRTRERAEMLAADIGCRVIDWEERHEAKVQLLINGTPIGMHPDVDNTPFNQSALNQFMVVFDTVYNPENTLLIKQATQKQSRVITGVDMFVRQAAYQFKLFTGQEASIELMRKKIKEATNPVRLN

SEQ ID NO: 33236 - protein, 107 aa, Arabidopsis thaliana
MLLYPLYASVIAIESPSKVDDEQWLAYWILYSFLTLSELILQSLLEWIPIWYTAKLVFVAWLVLPQFRGAAFIYNKVVREQFKKYGILKPKVNKFILLIFPFTFNFL

SEQ ID NO: 33237 - protein, 94 aa, Glycine max
FKGLPVVMFSAEGIATPADAALNIKLGMNGVFVGSGIFKSENPEKFAGTVVLATTHYQDPVKLPKISWGLGEGIKGESRLGAKAGKVMTPDRGY

SEQ ID NO: 33238 - protein, 271 aa, Zea mays
  misc_feature (30)..(30): Xaa can be any naturally occurring amino acid
PESESEAASRRQGEMGKGAQGSDAAAAGGXVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLDDGAMCEPLIVGVHPCRRAVVGPHTGVLVVGARPIGLVFLLAARAFGAPCLVARDLDHHRLFVASSFGPARLSRCFPPRRISPVRATPPSALARHSL

SEQ ID NO: 33239 - protein, 316 aa, Acidovorax sp. JS42
MNQLDALKQYTTVVADTGDFKQLAQFQPQDATTNPSLILKAVQKPEYAPLLKDCVTRWHGRAIDELMDRLIVRFGCEILSIIPGRVSTEVDARLSFDTAATVARAERIVELYQAEGLHIDRVLIKIAATWEGIQAARQLEQRGIHTNLTLLFSFAQAVACGQAKVQLISPFVGRIYDWYKKQAGANWDEAAMAGANDPGVQSVRAIYNHYKHFGIGTEVMGASFRNTGQIVALAGCDLLTIAPELLAQLAASNAPVARVLDPEAARRVALQPVQYDEAGFRYALNADAMATEKLAEGIRAFAADAAKLEQLMQAAA

SEQ ID NO: 33240 - protein, 538 aa, Acidovorax sp. JS42
MNFDDPRTRCDHTTAWQRLRAHYESAGRSFDLRAAFAQDAQRFERFSQDAPHVFADLSKNLIDAPTEALLLQLARECGVVAYRDAMFEGRPINNTEQRAVMHWLLRKPAPGHAGQAQAAIDTVAPEIASALHDVHATLEDMLALAERVRADDGITDIVNIGIGGSDLGPAMVVKALDDLRHPGKRLHFISNVDGMELGSLLRQLRPESTLFLIASKTFTTAETMSNAQAARAWFLDQGGSEDARARLPLARHFYALTTNLEAAAQFGITTTLGFWDWVGGRYSLWSAIGLPIAIAVGAPHFRALLAGAHAMDEHFRTAPLESNLPVRLALLDLWYRNFHGFSSRSMAPYSHGLRRLPAYLQQLEMESNGKGVDAHGQPLPYATSPVVWGEPGTNGQHAFFQMIHQGPDTVPVEFIALREPGRDLPDQHPRLVANALAQARALMMGRPEEADGHRRFSGNRPSTFLLLERLDPASLGALIALYEHRVFTSGALWGINSFDQWGVELGKGIAKDLEPRLATGDVQGLDPSSAGLLRRLAT

SEQ ID NO: 33241 - protein, 514 aa, Arabidopsis thaliana
MGSKKKCFDGPRDIISGLPDALICHILSFLPTKEAASTTVLAKRWKPLLAFMPNLDFDESFYFDPLMTCEERRKGSESFMLFVGSVLTLQAEANATLNRFYVKCEGVDQNSVLEWIPKVLKRGVLDIDLHIPSSRGFGSNSTFYPLPSEIFVSKTLVRLKIQFQDGVNVNVECDVSLPMLKTLHLDYVKMDTRMFQKLLSGCHMLKELLLMNLIWEESSEPEPCYVTVSVPTLKILKFSRFENFVKAKDFKPIVLWSFDIPNLVYLEYLDTIADKYQHVRFDSLVEARLGLCKTSKQIKNDNNNVTKLFMGICNVKILYLTEDALKVLGCCRETMPVFENLIQLTIKTGLHVGWKSLPPLLKNCPNLQTLVFEGLNHIYRKRRSCGDENRPCMCKNLDNMRVKKDIDACLSSSSVKVIKILNFGDTGDFCQFWEIEEDCEFWEIVEDVADHIKQVKQFLETMPDLEQVTLYYNTPQDEDVMKVFKKLKKLRRVASAKCEVQIISDNLNLSFTFR

SEQ ID NO: 33242 - protein, 612 aa, Oryza sativa (indica cultivar-group)
MGISAAAAAAPFLLLVALLLLLPSPAAAFSFTYNFTTADTAPSGIAFQGDAFFNNSAGGLLGLFNSSSRGGAAAAHPRPLVAVEFDTYKNEWDPSDDHVGVDLGGIVSAATVDWPTSMKDGRRAHARVAYDGQAKNLTVALSYGDAAAAAALTDPVLWYAVDLMEYLPDAVAVGFSAATGEAAELHQVLYWEFTSSIDTKEETVILWVVLGLCGLLLVLVAAGVLWFVSQWRKAGELADGDIDDEMGYDELADEEFFVESGPRRFRYSDLAAATKNFSDERKLGQGGFGAVYRGFLKELGLAVAIKRVSKGSTQGRKEYAAEVRIISQLRHRHLVRLVGWCHEHRGDFLLVYELMPNGRVDRHLYGGGGGSKKAGGAAPPLSWPTRYNVALGLASALLYLHEECPQCVVHRDIKPSNVMLDATFSAKLGDFGLAKLVEHGSQPHTTVLAGTLGYLAPECVITGRTSRESDVYSFGVVALEIACGRRPAELDEEDPSKARLVPWVWELYGKRAILEAADQRLNGKFDLEQMERLMVVGLWCAHPDHAHRPSIRQALNVLKFEAPLPSLPPKMPVPSYVPPPDLVAPVSVEGTSSTDGPGVSECGSSGSNAGGG

SEQ ID NO: 33243 - protein, 181 aa, Glycine max
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 33244 - protein, 526 aa, Arabidopsis thaliana
MDQMNQVVIVRQVSNLLLFRFICVNPKSHILVLHICSCISRCAEREFGQKQWQSLRTKLAAWRDNVRNVISTIESNKATEEGFGISMDRFSNLPDDVIYHIVSFLSAKEATCLKFVSKNFQNLVTIKRNVVFHHWESFKNFVDGLLAEPASYRIKRFSLKLVSMDFAQYNIVNDCLCNVLKRGVLDLELDINVKEDYILPSDVFTCKTVVRLKLGCGFVIDILPKNALLPALKTLILDSVRFYASDGCAFTRLLSASPVLEELVIDRLNWEHWKGSRFVSSPTLKRLTLRRKEWEPEPETWTDFESVSFDTPSLAYLKYKDVIPYGYPIVNLNSIVEARLTLPREVEYDYWLNRSADPSNLIRGLKNVEILSIKVLHTMDLLFYNFKEAVPVFENLIHLSVTSEADFCWDPLQILLEKSPNLKTLTIEGPLHYNFYEKLDLEAVCECLLGYSFLLSCPIKVLKITEFVGDIGEIVQMKHVLGKLPCLELLEVHVQARRDDKKLQIMADLLMLPRTSSKCKVKVHFS

SEQ ID NO: 33245 - protein, 450 aa, Oryza sativa (japonica cultivar-group)
MKVDDGPGVNGSRWAKMMSTDSWRWCLGLIYIVAVASIWIAASYIVQSVVDEGVSPFLITYICNSLFVIYIPIVEAARYFEDSINNFWTKLKGKDVADLEQSADLESINLLHGSEQEGNTASPTRLPEDILASEAVFPVQAELNVADGSKGLDAKGRWTRARVARVSMVVCPFWFLAQLTFNLSLRYTTVTSNTILSSTSSLFTFLVALVFLGETFTWLKLISVLLCMGGTIIVSLADSGSTANTIATNPLLGDVLSIVSAGLYAVYITLIRKKLPDEKEGQGEVSMAQFLGFLGLFNMLFFFPFALFLNFTKLEPFHRLTWEQVGLIVGKGLLDNVLSDYLWAKAILLTTTTVATAGLTIQVPIAAIVDTLTGHAPHLLDYIGAAAVLVGFAGINIPVGTPQGSQQEQETPIVSMVDDPVHLPSDRNATSMVDDPVYLPSDRNATGAVQ

SEQ ID NO: 33246 - protein, 382 aa, Vibrio parahaemolyticus RIMD 2210633
MTLEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKQAPLEEVCLLGCGVTTGMGAVLNTAKVEKGDTVAIFGLGGIGLSAIIGARMAGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLEDVNKAFDLMHEGKSIRTVIHMDK

SEQ ID NO: 33247 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVAELINPKDHDKPVQQVIIEMTDGGVDRSIECTGNVQAMISAFECVHDGWDVAVLVGVPSKDDEFKTHPMNLLNERTLKGTFFGNYKPRTDLPGVVEKYMNKDLEVEKFITHS

SEQ ID NO: 33248 - protein, 262 aa, Brassica napus
  misc_feature (8)..(8): Xaa can be any naturally occurring amino acid
  misc_feature (248)..(248): Xaa can be any naturally occurring amino acid
  misc_feature (256)..(256): Xaa can be any naturally occurring amino acid
MASTSSLXALSQALLARAISHHGSDQRISLPSPFSRASASSRRRSNAATTKLRSLRPLVVRAAAVDTLEPTTDASIVDKSVNTIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGRGIANAVGLALAEKHLAARVNKPDAEVVDHYTYVILGDGCQMEGISNEAASLAGHWXLGKLIAFXDDNHIS

SEQ ID NO: 33249 - protein, 510 aa, Camellia sinensis
MALDTVFLLRELSFATLVILITHIFMRSILSKPLRMLPPGPTGLPLIGAIPHLGSMPHVALAKMAKIYGPIVYLKMGTCGMVVASTPDSARAFLKTLDLNFSNRPPNAGATHLAYGAQDMVFADYGPRWKLLRKLSNLHMLGGKALENWAQVRSSELGHMLKAMYDLSCRGEPVVVAEMLCYAMANMIGQVILSRRVFETKGSESNEFKDMVVELMTTAGYFNIGDFIPSIAWMDLQGIERGMKRLHKKFDVLITKMIEEHKASAYQRKETPDFLDVFMAQQKNPGEEKAQHDTIMHYSGPYSLPGTDTSSSIIEWALAEMLKDPKILNRAHDEMDRVIGRNRRLQESDLPKLPYLQAICKETFRMHPSTPLNLPRVAAQTCRVNGYYIPKNTRLSVNIWAIGRDPDVWERPLEFIPDRFLSGKNAKTDPRGNDFELIPFGAGRRICAGTRMGIVLVEYILGSLVHSFDWKLADDGVELNMDESFGLALQKAAPLSAMVSPRLPPNAYAA

SEQ ID NO: 33250 - protein, 117 aa, Zea mays
  misc_feature (6)..(6): Xaa can be any naturally occurring amino acid
  misc_feature (43)..(44): Xaa can be any naturally occurring amino acid
  misc_feature (62)..(62): Xaa can be any naturally occurring amino acid
GALVSXGRAALAVAGVLCAVAALAAAPLASFVRASSLLFFPAXXGWVLGRVSAFCASWDAVXPLSWRLKLGWTAFCGPAGPKGQAVCGLCIWVKNRATGASFVAWFVVQCCLGGLVL

SEQ ID NO: 33251 - protein, 84 aa, Oryza sativa
  misc_feature (7)..(7): Xaa can be any naturally occurring amino acid
  misc_feature (29)..(29): Xaa can be any naturally occurring amino acid
  misc_feature (40)..(40): Xaa can be any naturally occurring amino acid
  misc_feature (77)..(77): Xaa can be any naturally occurring amino acid
MSKSENXYSAARELIPGGVNSPVRAFTGXWGGTPLFIEKXADGAYLYDVDGKAYIDYVGSWGPMVLGHNHPAIRNAXYIVKRRE

SEQ ID NO: 33252 - protein, 993 aa, Pseudomonas syringae pv. tomato str. DC3000
MIEHTLDANPDAALEAALAECAREPIRIPGAIQPHGVLLSVAGDPLCIEQVSANCAKSLGLESAELLGQPLSILLSAAHSMLINQAYSQPAMPNSDPIRLTVRAVDYNASLSRAGDVLIIELEPFVEAAHEQSRIITRVLRNLQAATTLETLFDIGVHEIQALTGYDRVMIYRFEPEGHGKVVAQALTGPLPSYSGLNFPGSDIPAQARELYRLNWIRLIPDATYVPVALIPTLRPATGQPLDLSLSTLRSVSPVHCEYLKNMGVRSSMSISLLDGGELWGLITCSHPEPLLVSRELRDACAMIGQLLSVKISAIVATHIQREREEKVVLLGQLADAMNRADHEILHGLVSRPQLLQALTQADGAAVLIDDQVHLFGQCPTSEEVRALYQWIRDTGLTRQRSKERATGLQGLGVFHTDSMQRERPESAAYRETASGVIAFTLPKPVDNAVMWFRSQLASTMNWSGNPAHHVSTRAAGSASHGLRPRQSFDVWKQEVTGIARPWSRADLYGAEDIRRSALESDLERQVQREQEAVRLRDELVAVVSHDLRNPMSIIIMQCGMMQRWAVDDTNFENRNIRRALGTIEKATTRMNSLLEDLLDTAQIEAGRYQLSRLALSVTSLLEEACSLLVMLTTEKNIELNCTSAQGLVIDADPERIFQVLSNLVGNAIKFTPKGGRINIDAVADGDDVLFRVSDDGIGIPAQHLPYIFQRYWSVKEGNPRGNGLGLYICQGIITAHGGRLWADSSLDSGSVFSFTLPMHQGQDTIGESTFLKQSGTTHRLAQSISSKLERQQLEDRLTRAGLLNELNHRVKNTLATVQAIASLTVNSSTSLDSFRKSFDARLFALSQARAEWMSTELADLLAQLQDVNGGQHRITFTGDPVRLEPRISLTLSMVLHKLMANALQHGALSSPAGQVTVASTLNSHHNPPTLSIDWLETEGPPVVASNVKGFGLRLIRRSIERELKGKVDIKFASTGVSWSMLIPWPEKPESSL

SEQ ID NO: 33253 - protein, 508 aa, Nicotiana tabacum
MALSFIFISITLIFLVHKLYHRLRFKLPPGPRPLPVVGNLYDIKPVRFRCFADWAKTYGPIFSVYFGSQLNVVVTTAELAKEVLKENDQNLADRFRTRPANNLSRNGMDLIWADYGPHYVKVRKLCNLELFTPKRLEALRPIREDEVTAMVENIFKDCTKPDNTGKSLLIREYLGSVAFNNITRLTFGKRFMNSKGEIDEQGQEFKGIVSNGIKIGGKLPLAEYVPWLRWFFTMENEALVKHSARRDRLTRMIMDEHTLARKKTGDTKQHFVDALLTLQKQYDLSDDTVIGLLWDMITAGMDTTTITVEWAMAELVKNPRVQLKAQEELDRVIGTDRIMSETDFSKLPYLQCVAKEALRLHPPTPLMLPHKASASVKIGGYDIPKGSIVHVNVWAVARDPAVWKNPLEFRPERFLEEDVDMKGHDYRLLPFGAGRRVCPGAQLAINLVTSMLGHLLHHFTWAPAPGVNPEDIDLEESPGTVTYMKNPIQAIPTPRLPAHLYGRVPVDM

SEQ ID NO: 33254 - protein, 534 aa, Rhodococcus sp. RHA1
MSGPTLSTANHTPLSPLRFLERSASVFPDRIAVVHGDRRYSYREFGDEVERLARVLRSRIEPGDRVAFLCPNTPEMLFAHFAVPLAGGVLIALNSRLAGRELEYILEHSGTSLLFVDSELVGSVATAREAVPSLREVIEIPDSTIARPMVPEGIVTGMYADFLAAADDVDGTPLHWGVDDEQQVIAINYTSGTTGKPKGVMYTHRGAYLNSLGETFHNGFAGSTKYLWTLPMFHCNGWCTPWAVTQAAGTHICLRAVRADAIWDAIDTLGVTHLCGAPAVCSTIAEAPQAHPVDALRITTAGAPPSPTVIAQLEAIGVTVVHVYGLTEVYGPYTICEYQDSWSDRTAEERASLLSRQGVGMVQAENARVVDAQMNDVPADGETMGEIVLRGNNVMLGYYRDPEATAEAFAGGWFHTGDLGVMHADGYIQLKDRAKDIVISGGENISTVEVEQAMMTHPAVLDVAVVGVPHPKWGERPKAFVIVKKGATVTAEELVEHTRGRIAKFKVPDEIVFPLELPRTPTGKVLKFELRNSN

SEQ ID NO: 33255 - protein, 262 aa, Acidovorax sp. JS42
MSAKPRDSTMPPVSPYPLENPYMPTTSHAPVAGSLPPAPDAKVAMGWMHTARFLTTAAQLHHLPAIEVPEIAFVGRSNAGKSTCINTLTQQGQLAFASKKPGRTQHINLFALGKQGATDAVLADLPGYGYAAVSRSDKLRWQQVMLSYLVSRESLTAIVLLCDPRLGLTELDEALLNAVRPRVEAGLKFLVLLTKADKLTRAEQAKALSITRLQAGGGEVRMFSALKKQGVDEVAQLLWQWAHPVQKEDAAVEALPPSEDQN

SEQ ID NO: 33256 - protein, 92 aa, Haemophilus somnus 2336
MGVSGTGKTSVGTEVAYRLGLKLIDGDDLHPRANIIKMRQGQPLNDEDRMPWLERIRDAAFSLEQKSEKGIIICSALKKQYRDQIRGWKPKH

SEQ ID NO: 33257 - protein, 214 aa, Nostoc punctiforme PCC 73102
MGKNRFKLVIFDCDGVLVDSEPIINRIFAETLTEAGFPITHAEVTQKFIGKSLKTCLEIIEASYKKPLPKNFVELCKEREIAPLQQELQPVSGITEILEQITLPKCVASNSSHRHIQMVLKLTGLLDKFDGKLYSANDVSRPKPFPDVYLYAAEQMNTNPEDCAVIEDSVPGVQAAYAAGMTVFGYAHQSDRTALAEVGAKIVFNDMRQLAQLL

SEQ ID NO: 33258 - protein, 287 aa, Bacillus licheniformis ATCC 14580
MVLSKQPKKVLPPQHQTQRPGLEYLMDPRPVFDRPKRERKLAGKTAIITGGDSGIGRAVSVLFAKEGANVVIVYLNEHRDAEETKGYVEKEGVGCKLIAGDIGDEAFCNDVVRRAKEAFPTIDILVNNAAEQHPQKGIEKITSHQLIRTFQTNIFSMFYLTKAVLPHLKKGSSIINTTSITAYAGNERLIDYSSTKGAITSFTRSLALSLVDQGIRVNGVAPGPIWTPLIPSTFTEREVEIFGSTTPMERPGQPAEVAPSYLFLASDDSSYMTGQVLHVNGGTIING

SEQ ID NO: 33259 - protein, 520 aa, Oryza sativa (indica cultivar-group)
MGDHRAKAKVRVNGAPAEATLFCTDPPGAANGGGGDGGELRWRCAGGAAAERVLSLDADVLGVEARGKEVVVKAFVLPAVAAAKSVSCAAGAGKGGGGRRRRRRDYVFEMAAGEDAAAAWCDRMRGSLDSLGRPKRLFILVNPFGGKKCGKKIYEAEIKPLFEAAGVNVTMQETRYQGHAREVASSLDLARYDGIVCVSGDGVLVEVDFFTDILVYPFRGMRKRLAYDCVKRKGYTSISIGESPDLQERLAKSNKKKDLQVVNGILQRMDWEEAMKIPIGVVPAGTGNGMAKSLLHSASLVADIDIESEKYRWMGSARFDFYALVRIMNLRKYYGSIQYVPAPGYEAYGDVVKQVENCTVECQEQIGKSLCSYQGPSVEFQGSEWRSLDGPFVSIWINNVQWAAESIMAAPGAKFSDGYMDAVIVRDCPKADLLALLMKMGDGSHVKSPYVTYLKVRCLRLSPGQLVENPKRGGIIDVDGEAIARGEGTYGKNQKQDVMGYGPSIQMTVHRALATMYCPK

SEQ ID NO: 33260 - protein, 255 aa, Rhodopseudomonas palustris CGA009
MNLFDLSGKVAVITGSSRGIGKAIAERMAEHGAKVVISSRKQDACDAVAKSINDTYGAGTALALAANISSKDDLKRLAQEATQTFGKIDALVCNAASNPYYGPQAGINDDQFRKILDNNIVANHWLISEVVPQMIARKDGSITIVSSIGGLKGSTVIGAYCISKAADMQLARNLACEYGEHNIRVNCIAPGLIKTDFARALWENPETLKASTARSPLQRIGEPDEIAGAAIFLASKAGTFTTGQTIVIDGGATIS

SEQ ID NO: 33261 - protein, 169 aa, Borrelia turicatae
MSTLIQRTLCIIKPDGVRRGLIGNVISRFERTGLKIVAAKMILVNREMAETHYLYDDIAVRHGEFVWQSLINFIISSPVFVFVVEGVEAVEVVRKFCGSTEPKMASPGTIRGDFAYHSFNYANEKEFSVYNVIHASANVDDALREVSLWFKENEILTYKRDDEFEHYYG

SEQ ID NO: 33262 - protein, 364 aa, Arabidopsis thaliana
MGKGGMSQGEGSKVEEENMAAWLVGINTLKIQPFLLPSVGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAAQAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 33263 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHGKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 33264 - protein, 200 aa, Leifsonia xyli subsp. xyli str. CTCB07
MTNRTASLRRETSESGIELSLDLDGTGASEIHTSVPFYDHLLTAFAKHSLTDLRVRASGDTEIDVHHTVEDVGIVLGQAIRQALGDKAGLSRYGDALVPLDEALVQAVVDLSGRPYLVHAGEPSGFEFHLIGGHFTGSMVRHVFEAISFNAAITTHVTVVGGRDPHHIAEAEFKAFARAFRQAKAYDPLVSGIPSTKGAL

SEQ ID NO: 33265 - protein, 309 aa, Vibrio parahaemolyticus RIMD 2210633
MNPISRVAIIGECMVELKKHDGVLQQGFGGDTLNTAVYLSRLTKQHGVETSYVTGLGHDPFSREMLTAWREEGINTDMVYLSEDKLPGIYAIETAEDGERSFFYWRNDAAAKYWLRERALLSLVKDLCQHQMIYLSGISLAIISDDCRQMLIELLTMCRKEGVKIAFDNNFRPKLWPNIEQARDFYSKILSVTDMAFLTFDDEVMLWGDKHEDEAISRTKNFGVKEIIVKRGADDCFVVTQDQQHTVAALKVDAVVDTTAAGDSFSAGYLAKRILGGDVAESALAGHKVAGTVIQHRGAIIPSQAMPTI

SEQ ID NO: 33266 - protein, 520 aa, Nicotiana tabacum
MYSHRSKVSTKIMALSFIFISITLIFLVHKLYHRLRFKLPPGPRPLPVVGNLYDIEPVRFRCFADWAKTYGPIFSVYFGSQLNVVVTTAELAKEVLKENDQNLADRFRTRPANNLSRNGMDLIWADYGPHYVKVRKLCNLELFTPKRLEALRPIREDEVTAMVENIFKDCTKPDNTGKSLLIREYLGSVAFNNITRLTFGKRFMNSKGEIDEQGQEFKGIVSNGIKIGGKLPLAEYVPWLRWFFTMENEALVKHSARRDRLTRMIMDEHTLARKKTGDTKQHFVDALLTLQKQYDLSDDTVIGLLWDMITAGMDTTTITVEWAMAELVKNPRVQLKAQEELDRVIGTDRIMSETDFSKLPYLQCVAKEALRLHPPTPLMLPHRASASVKIGGYDIPKGSIVHVNVWAVARDPAVWKNPLEFRPERFLEEDVDMKGHDYRLLPFGAGRRVCPGAQLAINLVTSMLGHLLHHFTWAPAPGVNPEDIDLEESPGTVTYMKNPIQAIPTPRLPAHLYGRVPVDM

SEQ ID NO: 33267 - protein, 357 aa, Colletotrichum lagenarium
MAEFIRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALSHDYLAPYHDPTDEPVAEEKFDWSFNDADLPVDTWKIMMYSEILDYHNVDASAQQIEEQFNGQ

SEQ ID NO: 33268 - protein, 364 aa, Pseudomonas syringae pv. tomato str. DC3000
MNNKKLRIAAIAGDGIGLEVLPEGVRVVQAAAARHGLELQFEYFEWASCDYYLEHGKMMPDDWFDQLKSFDAIFFGAVGWPDKVPDHISLWGSLLKFRREFDQYANIRPVRLFPGVPCPLANRKPGDIDFVVVRENTEGEYSSLGGIMFENTDNEFVLQESVFTRRGVDRILKFAFEMARKRERKHVTSATKSNGMAISMPYWDKRTEAMASHYPEISWDKQHIDILCARFVLQPERFDVVVASNLFGDILSDLGPACAGTIGIAPSANLNPERRFPSLFEPVHGSAPDIFGKNIANPIAMIWSGALMLEFLGQGDKRFTAAHDEIIMAIEQAIASGEVTPDLGGQRSTQEVGAAIAGRVGAAR

SEQ ID NO: 33269 - protein, 518 aa, Nicotiana tabacum
MEIPYYSLKLTIFSFAIIFVLRWAWKILNYVWLKPKELEKCIRQQGFKGNSYKFLFGDMKEIKKMGEEAMSKPINFSHDMIWPRVMPFIHKTITNYGKNCFVWFGPRPAVLITDPELVKEVLTKNFVYQKPPGTPLTKLAATGIAGYETDKWATHRRLLNPAFHLDKLKHMLPAFQFTACEMLSKLEKVVSPNGTEIDVWPYLQTLTSDAISRTAFGSSYEEGRKLFELQKEQLSLILEVSRTIYIPGWRFLPTKRNKRMKQIFNEVRALVLGIIKKRLSMIENGEAPDDLLGILLASNLKEIQQHGNNKKFGMSIDEVIEECKLFYFAGQETTSSLLVWTMILLCKHPSWQDKAREEVLQVFGSREVDYDKLNQLKIVTMILNEVLRLYPAGYAINRMVTKETKLGNLCLPAGVQLLLPTILLQHDTEIWGDDAMEFNPERFSDGISKATKGKLVFFPFSWGPRICIGQNFAMLEAKMAMAMILKNYAFELSPSYAHAPHPLLLQPQYGAQLILYKL

SEQ ID NO: 33270 - protein, 318 aa, Orobanche ramosa
MATFPVINMEKLNGEERSATMEMIKDACENWGFFELVNHGITAEFMDTVERLTKEHYKKCMEQRFKEMVTSKGLEAIQSEITDLDWESTFFLRHLPVSNISEIPDLEDEYRKVMKEFAGQLEKLAEQLLDLLCENLGLEKGYLKKVFYGTTGPNFGTKVSNYPPCPKPDLIKGLRAHTDAGGIILLFQDDMVSGLQLLKDGEWVDVPPMRHSIVINIGDQIEVITNGKYKSVMHRVIAQTDGTGRMSIASFYNPGNDAVIYPAPALVNKAENNGLYPKFVFEDYMQLYNGVKFQAKKPRFEAFKNMEKITNLGPIATA

SEQ ID NO: 33271 - protein, 431 aa, Acidovorax sp. JS42
MTHPVLPGHPHLHYHDQALQLEGLRLADLAREFGTPLYVYSHAAMLDALGAYQRGFAGRKVQICYAMKANSSLAVLQLFARHGCGFDIVSAGELQRVIAAGGDPAKVIFSGVGKTRAEMRQALEVGIGCFNVESEAELDVLSEVAQSMGLRAPISIRVNPNVDAKTHPYISTGLKGNKFGIAHERTVATYQRAAALPGLRVVGIDCHIGSQITEESPYLDAMDRMLDLVQAIEAAGIAVHHIDFGGGLGIDYNGDTPPRADALWAKLLAKLDARGYGDRQLMIEPGRSLVGNAGVCLTEVLYLKPGEQKNFCIVDAAMNDLPRPAMYQAYHAIVPLQATAPTAVSHVYDVVGPICESGDWIGRDRNLAVAAGDMLAVLSAGAYCSSMGSTYNTRPRPAEVLVDGARAHLIRTRESVNDIFRSEKLVPQGNP

SEQ ID NO: 33272 - protein, 507 aa, Zea mays
MAGGGFAVADGPSVDYGGRVTFSVVVTCLMAASGGLIFGYDIGISGGVTAMESFLSAFFPGVLRRMAAARRDEYCVYDSHVLTAFTSSLYLAGLAASLVASRVTRAIGRQAVMLAGGALFFAGAAVNAAAVNVAMLIVGRMLLGFGIGFTNQAAPVYLAETAPAKWRGAFTTGFQLFLSIGNLAANLVNYGTSRIPAWGWRLSLGLAAAPAAVILAGALLIPDTPSSLLVRGRAEEARAALRRVRGAKADVDAELEDVARAVEAARAHEQGAFRRILRREHRHHLAVAVAVPLFQQLTGVIVIAFFSPVLFQTAGFGSNAALMGAVILGAVNLASTLLSIVTVDRYGRRPLFLTGGFVMIVCQVAVAWIMGSQIGADGGSAMARPYSLAVLALTCVFSAAFGWSWGPLTWVIPGEIFPVEIRSAGQGISVAVNLGATFLLTQTFLSMLCTLKYATFIYYAAWVAVMTAFVVAFLPETKGVPLEAMGAIWERHWYWRRFVQPSVAEDP

SEQ ID NO: 33273 - protein, 206 aa, Xanthomonas oryzae pv. oryzae KACC10331
MAALRMRTLTAAALREMPLPSPGGDKEQRGRVLVVGGAMRVPGAALLAGEAASRAGAGKLQIATAARVAPAMALAVPKALVLGLGQNGQGEITRGYRALDAALAACDAAVIGPGMGSWKTTAALVRLAAAKAVGTLVLDAGALSRSSRAPPGRPFVLTPHAGQMATLAGDDKTAVEAAPGEYALTFAQKMRSVVIVKGADSVTTGP

SEQ ID NO: 33274 - protein, 230 aa, Lactobacillus johnsonii NCC 533
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKDTAEKYGDEQVHIWRRSYDVLPPAIDDDNEYSQAHDRRYANLDPHIVPKAENLHVTLDRVMPFWEDHIAPDLLDGKNVIIAAHGNSLRALTKYIENISDDDIMDLEMKTGEPVVYTFDDKLDVVNKEKLDD

SEQ ID NO: 33275 - protein, 177 aa, Arabidopsis thaliana
MSSNKIVLTSSDGESFQVEEVVARKLQIVKHLLEDDCVINEIPLQNVTGNILSIVLEYCKKHVDDVVDDDASEEPKKKKPDDEAKQNLDAWDAEFMKNIDMETIFKLILAANYLNVEGLLGLTCQTVADYIKDKTPEEVRELFNIENDFTHEEEEEAIRKENAWAFEADTKHEDPKP

SEQ ID NO: 33276 - protein, 370 aa, Oryza sativa (indica cultivar-group)
MNGSSGSQGHNVNGGQKKVQHASPLALNNGSKHRPLTPMRRCRGVACVVIILSTAFTLIVFIAPITTFLVRLVSVHYSRKATSVLFGIWLSLWPFLFEKINKTNVVFSGESVLPKKRVLLFANHRTEVDWMYLWDLALRKGYLGYIKYILKSSLMKLPVFSWAFHIFEFIPVERKWEIDEAIIQNKLSAFKDPRDPLWLAVFPEGTDYTEKKCIKSQEYASEHDIRFHFCEKLEVLLLIYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTCFFLYLSLFSSVWFKVYVLLSCAYLTLLPISPFNHPN

SEQ ID NO: 33277 - protein, 154 aa, Oryza sativa (japonica cultivar-group)
MTVGMINANPVVHERPERAAHPHPADAIDALDVFDTVRDIKDPEHPYSLEQLSVLSEESVSVDEKLGRIQITFTPTVQHCSMATVIGLCLRLKLMQNFPPHFKIDIKVAPGSLANEESVNKQLNDKERVAAALENPNLRQLVDECLCSNDSHSH

SEQ ID NO: 33278 - protein, 114 aa, Geobacter sulfurreducens PCA
MDSCIFCKIVDGTIPAKKVYEDEDMVAIEDINPVAPHHLLLIPKKHVVNALDLTPEDDRLVGRVFRVAAEIARQRGVDERGFRIVQNSNADAGQSVFHIHFHLLAGRHLGWPPG

SEQ ID NO: 33279 - protein, 553 aa, Rhodopseudomonas palustris CGA009
MTKHIPLQATSACAAVPPSAVLDSAHLGEIRGALGTIAADDRAPRRTLKARLQTLLAIAGPGLIVMVGDNDAGAFGTYTQAGQNYGTTLLWTLLLLIPVLYVNQEMVVRLGAVTGVGHARLIFARFGKFWGAFSVADLFLLNALTLVTEFIGISLALQYLGLSQFWGVIAAAVIITFAVSTGDFRRFERFALLLVAGSLLLIPVAVMVHPPLPQLAHDFFVPKMPAGAPLGEVMLLIIAIVGTTIAPWQLFFQQSYLIDKRITPRFIRYERWDLCVGIALVIIGAVAMIGFSAAAFAGRPEFGAYTDALGTAHGLEQAAGRLPAILFALALLDASIIGAAAVSLATAYAIGDVFAVAHSLHRKPSEAKGFYAVYAGLIAFAAALVVTPGMPLGLLTNAVQTLAGVLLPSATVFLLLLCNDKAVLGPWVNRRAGNLFTGAIVAVLVLLSVILTVSVLFPGVGETTILGILGGGVVGALLLSGAVALIARRGQGVRAEPPARSVVAPEEWRMPLLATLPPARLSAVSRTWLLVLRGYLVLAAGLVLYRIVELIAR

SEQ ID NO: 33280 - protein, 181 aa, Borrelia turicatae
MWEILMKDKTEYYDKFIMKVPNFPKEGILFYDITNVLLKAEAYKSLIEDAHAFYLSRNIDYIAAIESRGYLIGAPLALKMGLPLLLIRKEGKLPRQVLREEYNLEYGFSSIEIHKDDVKQHSNILLVDDILATGGTLKAAAMLLKKSGGVVSDIFCFIELVSMNGKDALREYSLNSLVKYF

SEQ ID NO: 33281 - protein, 303 aa, Populus tremula
DVYFWEAKGQTPLFPRIYGHEAGGIVESVGPGVTDLQPGDHVLPVFTGECGDYRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 33282 - protein, 512 aa, Borrelia turicatae
MNNNAVIVLDFGSQYSQLIARKIREMGVYTMVIAYSISAEEIKDMYPVGIILSGGPASVYLDEAPTVDIDIFNLGVPILGICYGMQLIIKLFGGVISKCDKQEFGNTELFIEDDQSNLFFGLSNKLKVMMSHGDNIEKVPSNFKQIAYTETCIASVFNEEQKIYGLQFHPEVTCSEVGNQILKNFVFKICQAHVNWNLSNSIDDFVEKIRLQVGDKKVILGLSGGTDSLVCALLINNAIKSNLICVFIDTGLLRKNEVREILELGRQYNLNIKYVDSSSIFLKNLENIDEPEEKRKIIGRTFVEIFEKVALEDKDVEFLAQGTIYSDVIESESRNNVFSSHIKSHHNVGGLPEKIRLKLLEPLRELFKDEVIQLGIQLGIEENSLYRHPFPGPGLAIRIIGKISQEKINILQGADSILIEELLANNLYYKIRQAFVVLLPVKSVGVMGDNRTYEYTAVIRCVNTLDFMTANWVELPYDFLRKVSSRIINEVRGINRVCYDISSKPPATIEWE

SEQ ID NO: 33283 - protein, 226 aa, Lotus japonicus
MASGGGYGDANAKIDYVFKVVLIGDSAVGKSQILARFARNEFSLDSKSTIGVEFQTRTLVIDHKTVKAQIWDTAGQERYRAVTSAYYRGAVGAMLVYDITKRQTFDHIPRWLEELRNHADKNIVIILIGNKCDLVNQRDVPTEDAKEFAEKEGLFFLETSALEATNVESAFTTVLTEIYNIVNKKSLAADESQGNGNSASLSGQKIIIPGPAQEIPAKRNMCCQAS

SEQ ID NO: 33284 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTGLINPKDHDKPVQQVIIEMTDGGVDRSIECTGNVQAMISAFECVHDGWGVAVLVGVPSKDDEFKAHPMNLLNERTLKGTFFGNYKPRTDLPGVVEKYMNKELEVEKFITHS

SEQ ID NO: 33285 - protein, 222 aa, Nicotiana tabacum
MASGYGDASQKIDYVFKVVLIGDSAVGKTQILARFARNEFSLDSKATIGVEFQTRTLVIQHKSVKAQIWDTAGQERYRAVTSAYYRGAVGAMLVYDITKRQTFDHIPRWLEELRAHADRNIVIMLTGNKTDLEDQRAVPTEDAKEFAQKEGLFFLETSAMEATKLEDAFLTVLTEIFNIVNKKNLAADENQSNSNPASLTGKKILVPGPGQVIPGKKACCSS

SEQ ID NO: 33286 - protein, 222 aa, Nicotiana tabacum
MASGYGDASQKIDYVFKVVLIGDSAVGKSQILARFARNEFSLDSKATIGVEFQTRTLAIQHKSVKAQIWDTAGQERYRAVTSAYYRGAVGAMLVYDITKRQTFDHIPRWLEELRAHADRNIVIMLIGNKTDLEDQRAVPTEDAKEFAQKEGLFFLETSAMEATNLEDAFLTVLTEIFNIVNKKNLAADDNQSNGNPASLTGKKILVPGPGQVIPEKKACCSS

SEQ ID NO: 33287 - protein, 507 aa, Arabidopsis thaliana
LFRLLRSICKTCPTEESLRLFTGYLQFLTEIPKTWVLKYIEKMDHVSSLPEGVLCNIFSFLTTKEAALTSILCKRWRNLLAFVPNLVIDDSVFLHPEEGKEERYEIQQSFMEFVDRVLALQGNSPIKKFSLKFRTDFASHRVNAWISNVLARGVSELDVLVILYGAEFLPLSPKCFKSRNLVTLKINSLGIDWLAGDIFLPMLKTLVLHSVKLCVDKFFFRALPALEELVLFAVSWRDRDVTVSNASIKTLTIKFNYYLGTLSLDTPSLVSFCFSDHVAKDYPLAKMEKLSEARISLLVTEYQIERARAPNIYWVEDDVVLRLVNVGKLMKGIRNVQYLNLSPNTLEVLSKCCESMPLFNNLKSLTIESNERRGWQAMPVLLRNCPHLETLVLEGLLHHVTEKCRNACDCVSQEEKGRSLTSCQVKVLEIKGFQGTTKEMHTIKHFLEHFPCLREIKIHMEENGPTQLRVPEVSQYIAEMMEHYEKSSSCNVQLLVGGYLCKKWTTQ

SEQ ID NO: 33288 - protein, 518 aa, Nicotiana tabacum
MEIPYYSLKIAISSFAIIFVLRWAWKILNYVWLKPKELEKYLRQQGFKGNSYKFLFGDMKETKKMGEEAMSKPINFSHDMIWPRVMPFIHKTITNYGKNCIVWFGPRPAVLITDPELVKEVLTKNFVYQKPLGNPLTKLAATGIAGYETDKWATHRRLLNPAFHLDKLKHMLPAFQFTASEMLSKLEKVVSPNGTEIDVWPYLQTLTSDAISRTAFGSSYEEGRKIFDLQKEQLSLILEVSRTIYIPGWRFLPTKRNKRMKQIFNEVRALVFGIIKKRMSMIENGEAPDDLLGILLASNLKEIQQHGNNKKFGMSIDEVIEECKLFYFAGQETTSSLLVWTMILLCKYPNWQDKAREEVLQVFGSREVDYDKLNQLKIVTMILNEVLRLYPAGYVINRMVNKETKLGNLCLPAGVQLVLPTMLLQHDTEIWGDDAMEFNPERFSDGISKATKGKLVFFPFSWGPRICIGQNFAMLEAKMAMAMILKTYAFELSPSYAHAPHPLLLQPQYGAQLILYKL

SEQ ID NO: 33289 - protein, 403 aa, Chlamydia trachomatis D/UW-3/CX
MDKLSIRDLSLEGKKVLVRVDFNVPIKDGKILDDVRIHSAMPTIHYLLKQDAAVILVSHVGRPKGGVFEEAYSLAPIVPVLEGYLGHHVPLSPDCIGEVARQAVAQLSPGRVLLLENVRFHKGEEHSDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCASQISHVSTGGGASLEFLEKGSLPGTEILSPAQS

SEQ ID NO: 33290 - protein, 518 aa, Nicotiana tabacum
MEIPYYSLKIAISSFAIIFVLRWAWKILNYVWLKPKELEKYLRQQGFKGNSYKFLFGDMKEMKKMGEEAMSKPINFSHDMIWPRVMPFIHKTITNYGKNCIVWFGPRPAVLITDPELVKEVLTKNFVYQKPLGNPLTKLAATGIAGYETDKWATHRRLLNPAFHLDKLKHMLPAFQFTASEMLSKLEKVVSPNGTEIDVWPYLQTLTSDAISRTAFGSSYEEGRKIFDLQKEQLSLILEVSRTIYIPGWRFLPTKRNKRMKQIFNEVRALVFGIIKKRMSMIENGEAPDDLLGILLASNLKEIQQHGNNKKFGMSIDEVIEECKLFYFAGQETTSSLLVWTMILLCKYPNWQDKAREEVLQVFGSREVDYDKLNQLKIVTMILNEVLRLYPAGYVINRMVNKETKLGNLCLPAGVQLVLPTMLLQHDTEIWGDDAMEFNPERFSDGISKATKGKLVFFPFSWGPRICIGQNFAMLEAKMAMAMILKTYAFELSPSYAHAPHPLLLQPQYGAQLILYKL

SEQ ID NO: 33291 - protein, 521 aa, Nicotiana tabacum
MGNAHNSKIAAICLIIFLVYKAWELLKWIWIKPKKLESCLRKQGLKGNSYGLFYGDMKELSKSLKEINSKPIINLSNEVAPRIIPYYLEIIQKYGKRCFVWQGPTPAILITEPELIKEIFGKNYVFQKPNNPNPLTKLLARGVVSYEEEKWAKHRKILNPAFHMEKLKHMLPAFYLSCSEMLNKWEEIIPVKESNELDIWPHLQRMTSDVISRAAFGSSYEEGRRIFELQEEQAEYLTKTFNSVYIPGSRFFPNKMNKRMKECEKEVRETITCLIDNRLKAKEEGNGKALNDDLLGILLESNSIEIEEHGNKKFGMSIPEVIEECKLFYFAGQETTSVLLVWTLILLGRNPEWQERAREEVFQAFGSDKPTFDELYRLKIVTMILYESLRLYPPIATRTRRTNEETKLGELDLPKGALLFIPTILLHLDREIWGEDADEFNPERFSEGVAKATKGKMTYFPFGAGPRKCIGQNFAILEAKMAIAMILQRFSFELSPSYTHSPYTVVTLKPKYGAPLIMHRL

SEQ ID NO: 33292 - protein, 521 aa, Nicotiana tabacum
MGNAHNSKIAAICLIIFLVYKAWELLKWIWIKPKKLESCLRKQGLKGNSYRLFYGDMKELSKSLKEINSKPIINLSNEVAPRIIPYYLEIIQKYGKRCFVWQGPTPAILITEPELIKEIFGKNYVFQKPNNPNPLTKLLARGVVSYEEEKWAKHRKILNPAFHMEKLKHMLPAFYLSCSEMLNKWEEIIPVKESNELDIWPHLQRMTSDVISRAAFGSSYEEGRRIFELQEEQAEYLTKTFNSVYIPGSRFFPNKMNKRMKECEKEVRETITCLIDNRLKAKEEGNGKALNDDLLGILLESNSIEIEEHGNKKFGMSIPEVIEECKLFYFAGQETTSVLLVWTLILLGRNPEWQERAREEVFQAFGSDKPTFDELYRLKIVTMILYESLRLYPPIATRTRRTNEETKLGELDLPKGALLFIPTILLHLDKEIWGEDADEFNPERFSEGVAKATKGKMTYFPFGAGPRKCIGQNFAILEAKMAIAMILQRFSFELSPSYTHSPYTVVTLKPKYGAPLIMHRL

SEQ ID NO: 33293 - protein, 112 aa, Fusobacterium nucleatum subsp. nucleatum ATCC 25586
MATLFTKIINKEIPANIVYEDDDVIAFKDIAPVAPVHVLVVPKKEIPTINDITDEDTLLIGKVYRVIGKLAKEFGIDKDGYRVVSNCNEHGGQTVFHIHFHLIGGEKLGTMV

SEQ ID NO: 33294 - protein, 493 aa, Pseudomonas syringae pv. tomato str. DC3000
MSLTRFQMCIDGQWVDALSGKTFDSLNPALAEPWAQLPDAGEADVERAVQAAQKAFESQEWRGLTATARGKLLRRLGDLIAENKEHLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIAPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPLDESTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 33295 - protein, 379 aa, Pseudomonas syringae pv. tomato str. DC3000
MKAIVYNGPRDVSVKNVPDAKIEKPTDALVRVTTTNICGSDLHMYEGRTSFETGRIFGHENMGEVIEVGAGVDRVKVGDRVCLPFNIGCGFCENCEKGLTGYCLTANPGSAGAAYGFAEMGSHEGGQAELLRVPYADFNCLLLPEDAAEREDDYVMLSDIFPTGWHATELAGLLPGESVAIYGAGPVGLMAVHSAMIKGASQVFVVDNHPDRLALAAKMGATPINSLEQGAVDQILNLTDGRGTDRGCECVGYQCCDRHGHEANHVTMNNLVASTKATGGIGVVGVFVPQDPGAHSDLAKEGKMAFDFGSFWFKGQQIRTGQANVKAYNRRLAELIHHDRAKPSQIISHRLKLEEGPAAYQHFDARDDGWTKVVLKPNG

SEQ ID NO: 33296 - protein, 668 aa, Synechococcus elongatus PCC 6301
MVVAAQSLDELCINSIRFLAIDAVEKAKSGHPGLPMGAAPMAYVLWDRFLRFNPKNPAWFNRDRFVLSAGHGCMLQYALLHLSGYDSVSIEDIKNFRQWGSPTPGHPENFETPGVEVTTGPLGQGIANAVGLALAEAHLAARFNKPDAKLVDHYTYVILGDGCNMEGISGEAASLAGHWGLGKLIALYDDNHISIDGSTDVAFTEDVSKRFEAYGWHVLHVENGNTDLAAIEKAIADAKAVTDKPTLIKVTTTIGYGSPNKANTAGVHGAALGDAEIKLTRENLGWDYEPFVVPEDALAHWRKAIERGAALESSWNETLAQYKANYPAEAAEFERMLSGQLPTGWADALPSYTPADKAVATRKHSEICLNALAPVLPELIGGSADLTHSNLTELHVSGDFQKGAYENRNVHFGVREHAMAAIANGIALHNSGLIPYAATFLVFADYMRGAMRLSALSEVGVIYVLTHDSIGLGEDGPTHQPVETIASLRIIPNMLVFRPADGNEASGAYKVAVENRKRPSVLAMSRQNLPNLEGSSIDIVAKGAYVLSDDEGTPDLILLATGSEVSLCVEAAKQLRAEGKKVRIVSMPCWELFDEQSAEYKESVLPKAVTARLAVEAGSSFGWHRYVGDAGATISTDTFGASAPGNVMFEKFGFTVDNVVAKAKAVIG

SEQ ID NO: 33297 - protein, 286 aa, Pseudomonas syringae pv. tomato str. DC3000
MNEDYPKPPFASQPQNVPGEQGRMDPYPDCGEKSYKGSGRLQGKIALITGADSGIGRAVAIAFAREGAQVAISYLNEHEDAQETKRWVEEAGMRCLLLPGDLAHKQQCEDIVSKTVAEFGHIDVLVNNAAFQMTHEALEDISDEEWVKTFDINITAMFRICKAAVPHMPRGGSIINTSSVNSDMPKPTLLAYAATKGAIANFTGGLAQLLGEKGIRVNSVAPGPIWTPLIPATMTDEDVKTFGSETPLGRPGQPVEVSPIYVLLASDEASYISGSRYGVTGGKPIL

SEQ ID NO: 33298 - protein, 111 aa, Oryza sativa (indica cultivar-group)
MGAADKGSGVQFEDFLPSMARKLGVEGLIEELCKGFELLMDPGAGKITFRSLKRNAAMLGLGELRDDELSEMMREGDLDGDGALDQMEFCVLMVRLSPELMQDESHRAFQC

SEQ ID NO: 33299 - protein, 476 aa, Pseudomonas syringae pv. tomato str. DC3000
MYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 33300 - protein, 550 aa, Vibrio vulnificus CMCP6
MLKTINPTQTQAWNALTAHFESAQDMDLKDLFAQDAARFDKFSARFGSDILVDYSKNLINEETLKHLFALAKETELSAAIKAMFSGEAINQTEGRAVLHTALRNRSNQPVLVDGEDVMPAVNAVLEKMKSFTDRVIGGEWKGYTGKAITDIVNIGIGGSDLGPYMVTEALAPYKNHLNLHFVSNVDGTHIVETLKKVDPETTLFLIASKTFTTQETMTNAHTARDWFLATAGDQAHVAKHFAALSTNAPAVSEFGIDTDNMFEFWDWVGGRYSLWSAIGLSIALAVGYDNFIELLEGAHEMDNHFVSTELESNIPVILALIGIWYNNFHGAESEAILPYDQYMHRFAAYFQQGNMESNGKYVDRNGNPVTYQTGPIIWGEPGTNGQHAFYQLIHQGTKLIPCDFIAPAVSHNPAGDHHQKLMSNFFAQTEALAFGKNEETVKAELVKAGKNAEEVAAIAPFKVFEGNRPTNSILVKQITPRTLGNLIAMYEHKIFVQGVIWNIFSFDQWGVELGKQLANQILPELADGSEISSHDSSTNGLINAFKAFKA

SEQ ID NO: 33301 - protein, 422 aa, Arabidopsis thaliana
MAFSSLLRSAASYTVAAPRPDFFSSPASDHSKVLSSLGFSRNLKPSRFSSGISSSLQNGNARSVQPIKATATEVPSAVRRSSSSGKTKVGINGFGRIGRLVLRIATSRDDIEVVAVNDPFIDAKYMAYMLKYDSTHGNFKGSINVIDDSTLEINGKKVNVVSKRDPSEIPWADLGADYVVESSGVFTTLSKAASHLKGGAKKVIISAPSADAPMFVVGVNEHTYQPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 33302 - protein, 483 aa, Oryza sativa (japonica cultivar-group)
MAAAAAGMGGGGGVQHQETTTTVVQVAAEASRKKVEVRSAGRRGRREMRRIEDATSRQVTFSKRRSGLLKKAFELSVLCDAEVALIVFSPRGRLYQFASASSDLQRTIDRYLNHTKNSSAHEEGEESCVQKWRSEATTLGKKIEAIEGYKSKLLGEGLGSCSVQELQELEVQLEKSLCSIRQKKQKMLMDQILELREKEMNLLKENMVLRDQCKALSSPWSTSVGELKNKQADDDVHRHEDYSGGGVRDDDDRRMMEDVETDLAAANQAGKVLKKGKKKQAKDELDRQKQAEKKRRRLEKALANSAAIISELEKKKQKKREEQQRLDEEGAAIAEAVALHVLIGEDSDEPCHLMLNKHRRCNHWDHSAGFDFAVDAQGADIYPPDGLIQCADHVYAPKGRCIDWGIGQPLPSWGEVKDLQLQAPCYQGMFHQSVACPGFIAAQAVSSLQIGGDSSDITSPSQGATVVNRMLGATNRLNLYREI

SEQ ID NO: 33303 - protein, 421 aa, Oryza sativa
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTVRLITVASIGQQEVFCLGLINDPLVFSVNKSELTKSLFPQIVSFKKK

SEQ ID NO: 33304 - protein, 578 aa, Vibrio vulnificus CMCP6
MTFSIENNKQVVLGEELGKLSDNERLKTQSNFLRGTIEQDLQDRITGGFTADNFQLIRFHGMYQQDDRDIRNERAKQKLEPLHNVMLRARMPGGIITPKQWLAIDKFATEHSLYGSIRLTTRQTFQFHGVLKPNIKLMHQTLNSIGIDSIATAGDVNRNVLCTTNPVESELHQEAYEWAKKISEHLLPKTKAYAEIWLDGEKVETTEDDEPILGKTYLPRKFKTTVVIPPQNDVDVHANDLNFVAIAEKGKLIGFNVLVGGGLAMTHGDTSTYPRRADDFGYIPLEKTLDVAAAVVTTQRDWGNRSNRKNAKTKYTLDRVGTDVFKAEVEKRAGIKFEVSRPYEFTERGDRIGWVEGIDGKHHLTLFIENGRLLDYPGKPLKTGVAEIAKIHKGDFRMTANQNLIVAGVSKSNKAKIEKLAREHGLMDEGVSEQRKNAMACVAFPTCPLAMAEAERFLPQFVTDVEGILDKHGLDKEDNIILRVTGCPNGCGRAMLAEIGLVGKAPGRYNLHLGGNRGGTRVPKMYKENITDKQILEEIDQLVGRWANERLPNECFGDFTVRVGIIEEVIISKRDFYA

SEQ ID NO: 33305 - protein, 161 aa, Brassica napus
  misc_feature (2)..(2): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (33)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (42)..(42): Xaa can be any naturally occurring amino acid
  misc_feature (48)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (60)..(63): Xaa can be any naturally occurring amino acid
  misc_feature (78)..(78): Xaa can be any naturally occurring amino acid
  misc_feature (80)..(80): Xaa can be any naturally occurring amino acid
  misc_feature (86)..(86): Xaa can be any naturally occurring amino acid
  misc_feature (92)..(95): Xaa can be any naturally occurring amino acid
  misc_feature (99)..(99): Xaa can be any naturally occurring amino acid
  misc_feature (104)..(105): Xaa can be any naturally occurring amino acid
  misc_feature (109)..(109): Xaa can be any naturally occurring amino acid
  misc_feature (121)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (129)..(129): Xaa can be any naturally occurring amino acid
  misc_feature (131)..(134): Xaa can be any naturally occurring amino acid
  misc_feature (143)..(145): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (155)..(156): Xaa can be any naturally occurring amino acid
  misc_feature (160)..(160): Xaa can be any naturally occurring amino acid
MXSSMLFLRCVSPTSPGHAXMVAXFXGLKXSAXFPXTXLADXDITSIXXXXXRXSCMXVXXXXGKKKFETLSYLPDLXEXELTEEXEYLLRXXXXPCVXFELQXXFVYXEHVCTPGYDDGXYXXRWXVXLXXXXDSARVMKEXXXVKXGXPXAFXXIIGXD

SEQ ID NO: 33306 - protein, 431 aa, Corynebacterium glutamicum ATCC 13032
MSTTTPTRATKSVGTVLALLWFAIVLDGFDLVVLGATIPSMLEDPAWDLTAGQATQISTIGLVGMTIGALTIGFLTDRLGRRRVMLFSVAVFSVFTLLLAFTTNVQLFSLWRFLAGVGLGGALPTAIAMVTEFRPGTKAGSASTTLMTGYHVGAVATAFLGLFLIDGFGWHSMFIAGAVPGLILLPLLYFFLPESPQYLKISGKLDEAQAVAASYGLSLDDDLDREHEEELGESSSLSSLFKPSFRRNTLAIWGTSFMGLLLVYGLNTWLPQIMRQADYDMGNSLGFLMVLNIGAVIGLYIAGRIADKNSPRKTALVWFVFSAFSLALLAVRMPLIGLYGIVLLTGIFVFSSQVLIYAFVGENHPAKMRATAMGFSAGIGRLGAISGPLLGGLLVSANLAYPWGFFAFAGVGLLGALIFSASKTLRHRENA

SEQ ID NO: 33307 - protein, 303 aa, Populus tremula
DVNFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 33308 - protein, 473 aa, Arabidopsis thaliana
  misc_feature (173)..(173): Xaa can be any naturally occurring amino acid
MDLLSSLPDEVRCLILSFLTTKESASTSVLSKKWRNLFALVPNLDFDDSEFLHPEEGKRERDGILQSFMDFVDRVLSLQGNSSIRKFSLKCETGVPPARVNRWLCEVLQRDVSDIDLTIDLGYGYYLPEELFVSETLVNLKLKSAFNIDWWPGAEGTSLPMLKSLCVYGVRVXFCDDELQELLPCFPVLEELQMSNMQWLDSDETVSSATLTTLHITGIRSENPKSISFDTPNLLSFVYTDFVAEDYPLVNMKNLSLARLALRANDDQIKRVRGPSNDLLEYDVVRHFGNVVKLMNGIQNVQELHLCPDTLELLSVCCESMPVFNNVKKLLIYSDEDRGWQAVPVLLRNCPRLETLIFEGIVHHVTDKCGDACDCIFRKDKGRSLKSCPVKVVEINGFGVTMKEKYLIEHFLDYFSCLKEMKIYINCEEDGVTQQVMKNREVSKLVLDEMEEYNEFYSCNVKLFLCKKKSIPQ

SEQ ID NO: 33309 - protein, 476 aa, Gibberella zeae PH-1
MVMGTSPIALARQPRLLMRLSGLNSKRLASTAALEGSGWAGYALAKKISPSAASCVLISPRSHFVFTPLIASTAVGTLEFRAAVEPCRKLTHTEFHQAWASDIDFANKSITVEANHRDGVTARSGKDLKGPEFQIPYDKLVVAVGCYSQTFGVEGVKEHACFLRDATDARTVRLRVLQKFEQAALPSTNTAERKRLLHFAVVGGGPTGIEFAAELHDLIHEDLSKLYPDLMPHVAITIYDIAPKVLPMFDQNLAAYATNIFKREGIRIKTEHHLQGIRRQGDVLLMRIKEEPEEVAAGVVVWSTGLMQNPLVGKTVGREVEGLGKIAKNDKTGGFAVDSHLRVQVESRDLNGKEITKSLPDVYAIGDCANIEGQALPATAQVASQQATYLGKRFNSGISSQGPPTAPFHFRNWGTMAYLGGWRAIHQNGADELKGRAAWILWRTAYLTKSMSFKNKLMIPYYWLITWIFGRDISRF

SEQ ID NO: 33310 - protein, 128 aa, Yersinia pestis
ADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEA

SEQ ID NO: 33311 - protein, 425 aa, Leifsonia xyli subsp. xyli str. CTCB07
MPTASLTYPGGVAEFPMLPSSQGPGSIDLSSFTRQTGLTSLDYGFVNTAATRSSITYIDGDAGILRYRGYPIEQLAGNSTFLEVAWLLIHGELPSASELADFDARIRRHTLLHEDLRRFFSALPHDAHPMSVLSSAVSALSTFYQDSLSVHDPEQVELSTVRLLAKLPVIAAYAHKKSIGQAFLYPDNSLSFVDNFLRLNFGTLAEPYEVDPVLSRALERLLILHEDHEQNASTSTVRLVGSTQANLFASVSAGINALYGPLHGGANEAVLQMLAGIRDSGEGVQKFVERVKNKESGVKLMGFGHRVYKNFDPRARLVKQSADEVLSALGVHDPLLDIAKELEEVALADQYFIDRKLYPNVDFYTGVIYKAMGFPTRMFTVLFAIGRLPGWIAHWREMMLDPGTKIGRPQQLYVGSPERSWPSSR

SEQ ID NO: 33312 - protein, 320 aa, Coprinopsis cinerea okayama7#130
MGFTTLVTCDVYLGMFGWWAEVSQYRFIKPPSLLFTSYAYLTPRLMANWARFFSSFRNVIAFFKEAWFLGRPAWTVKDIPDLSGKVYIVTGGNSGLGADTVRALLKHRARVYIAARNEEKSLAFIEELFDETGHKAHFLKVDLADLGSVEAAASEFNRKEARLDVLFNNAGTLNLSIEAVTNGYDMAFHTNVLGPFYFTKLLLPHLLQTARLSDTKDHVRIVNLTSSAHHFAGSPPIDFSSLKDGPGRRKYTDLDHFYAQSKAAMVLFSNELARRYAEKGVISLAVNPGNFATSLTRGIQDYWRNTFSANPEILAVYLSP

SEQ ID NO: 33313 - protein, 341 aa, Aspergillus nidulans FGSC A4
MDIPTLNFRDFTSGTQSQRDTFCSNLYTSLSTLGFVKIKNHTIPDEILDQVFDWSKHFFALPLESKTLAAHPVQANPHRGWSCVGQEKLSVIRQGKAVFDLKESFDLGPENDPLYPNIFPDDSVIPGFRPFMESFYAQCQALHLTLLSAIALSLNQDASFLSDRCGTNSSELRLNHYPATKISDLQSGKKMRISSHTDFGTITLLWQDGVGGLEVEDQNHEGVYLPVGPTSTESSSGADTDCDSGREMIVNVGDCLQRWTNDRLRSANHRVTLPAEMKDKSRPEISNDLVPDRYSVAYFGKPDRGALVAAIPELVEEGEEVRYKGGMTAWEYNQSRLLQTY

SEQ ID NO: 33314 - protein, 258 aa, Pseudomonas syringae pv. tomato str. DC3000
MPVIANRDTQLCMSMAARPGNFGVRFHNHLFQQLDLNFYYKTFSPNDLTAAVAGIRSLGIRGSAVSMPFKEACIELVDELDVSAAAIQSINTIVNTDGHLKAFNTDYIAVAQLMESHAVPHSAFALRGSGGMAKAVAFALRDAGFTDGLIVARNQQAGQRLAEACGFRWQADLGSARPPLLVNVTPLGMQGPQGDELAFDMQAIEAADTIFDVVATPADTPLIQAARRLGKRLVSGDEVAAIQALEQFVLYTGHSPDR

SEQ ID NO: 33315 - protein, 406 aa, Cryptococcus neoformans var. neoformans JEC21
MVKITFKTVQNKLFTVDAQDSDTVADLKKKIQETQTFPVENQKLIYSGKILNDASSVESLKIKEKDFLVVMVSRPKATPAATPAAPATPAPSTPAPAPAASEQASVANPAVPAPSAPAAESAPASAPAPAAESAQPSAVESGLGGSFVTGPALQAAIDGMVEMGFERDQVIRALRASFNNPDRAVEYLMSGNIPSVEGTAPAAPAPAAPSTPSAAAAPAQPAAPSEPAAQPVASAPPASAGGSADNLFAAAEAAMNRDRGVPAAAGAPGLPGAPGLPGAGAGMPGGMGGGDQLSAIRQMVQQNPAMIQPLLQQIATEHPELAQLIAQNPEALYELLGGGGGEGDDDDEFGEGPVMRVNLTQEEAAAVERLEALGFDRQTVLQAYMLCDKNEELAANFLFENMEEDQ

SEQ ID NO: 33316 - protein, 318 aa, Aeropyrum pernix
MLIDHYIMDFMSITPDRLSGASLHLIKAGGKRLRPLITLLTARMLGGLEAEARAIPLAASIETAHTFSLIHDDIMDRDEVRRGVPTTHVVYGDDWAILAGDTLHAAAFKMIADSREWGMSHEQAYRAFKVLSEAAIQISRGQAYDMLFEETWDVDVADYLNMVRLKTGALIEAAARIGAVAAGAGSEIEKMMGEVGMNAGIAFQIRDDILGVIGDPKVTGKPVYNDLRRGKKTLLVIYAVKKAGRREIVDLIGPKASEDDLKRAASIIVDSGALDYAESRARFYVERARDILSRVPAVDAESKELLNLLLDYIVERVK

SEQ ID NO: 33317 - protein, 352 aa, Oryza sativa (indica cultivar-group)
MADEWWSASQRSHGTSACSAAPSPLTADRVSCGWTSPAAAAAAESTSSITFQDPSRSSAAHHQPLSDAASSLGDPHMVDWTQAFLSGRSDASFQAVLQDDMAASTRPFRAQPTAADEAVMTNPFRDMGVGQGLLLDQASAPLHGLSFDAGEPAVAPATHSITTSFGDYQHSASYDAAAAVMQFSQTPRAPSLPAAAQMQFLSGSYQLPFGGAPPLPSQLLLQAMQPKPSCSSNANTLLAKVRKEKLGDRITALQQLVSPFGKTDTASVLHEAIEYIKFLHEQVASLSSPYLKNGNPLQHFQQKGSESTKDAEQPKPDLRSRGLCLVPVASTYTVASETVPEFWHPTFGGTFR

SEQ ID NO: 33318 - protein, 760 aa, Nostoc punctiforme PCC 73102
MSEFTKTLCPYCGVGCGLEVSPPAQLGKATNRDGQGNPTWRVRGDKAHPSSQGMVCVKGATIAESLDKNRLHYPMVRDSLDQEFRRVSWDEAFNLITQRIQTVRFTQGPEALCMYGSGQFQTEDYYIAQKLMKGCLGTNNFDANSRLCMSSAVAGYIQSFGSDGPPCCYEDLELTDCAFLIGTNTAECHPIVFNRLEKYHKKNRKVKMIVVDPRRTPTAEAADLHLAIRPGTDIDLLNGIAHLLMRWNYIDTMFMDDCTSNFPAYAEVIRHYSPEVVARQCGISIEDLETAARYWGESRRVLSLWSMGVNQSSEGTAKVRTIINLHLMTGQIGKPGAGPFSLTGQPNAMGGREAGGLAHLLPGYRVVKNPQHRAEVEEFWGLKPGQISPNPGLTAWDMITGLESDAVGLLWIAATNPAVSMPDLERTKKALLRSPFTIYQDAYYPTETSAYAHVLLPAAQWGEKTGVMTNSERVVTLCQAFRQPPREAKADWEIFAEVGRRLGFEKEFAFANSAEVYAEFVQLTQNRPCDMTGISHEQLTQGPTQWPYPAKKVESVFIDTETGLLSFQPEEETFSDKEAEKKRKYHTLRMGKRLYTDLRFHTPDGRAQFGAYYSKGLAEPPDPDYPFVLTNGRLYGHWHTQTRTGRIEKICKMHPEPFIEIHPRDAAKLGILDNQCVQVRSRRGKAQFPAKVTKAIAPGTVFVPMHWGSLWADNAEANALTHPESCPDSLQPELKACAVQLIPISVEVAVKDYQFQSSQC

SEQ ID NO: 33319 - protein, 233 aa, Geobacter sulfurreducens PCA
MKNRSSMVRGMFLGAGAVAISAVLAFGSGGVGVTADEALQQLMDGNKRYVAGQMKTCSASDTAKRESLAKGQKPYAIILSCSDSRVPPEIIFDKTMGEIFVVRVAGNIPDPVVLGSIEYAAEHIGSPLVMVLGHERCGAVTATVEAKGKAEGNIGSIVKTIAPAAAKALKEGKGKSKAEVVEAATDANLDLVAASLTKKSPVIRHLVKEGTLKIVKAKYDLDDGTVVLMDGKK

SEQ ID NO: 33320 - protein, 736 aa, Cryphonectria parasitica
MAAAAPQEQQQQQQKEEDGELPPPSEAITQAGGGVSGAGPARSITTVSAAVLPYLEKIFNCHADTSQAWHRGQAETFIRCTQAGDPNGSAEGLPADLATKDELDFNDFLRYMTSDATSAVTPLNAQTGGDLSYPLSSYFISSSHNTYLTGNQLSSDASTDAYKNVLLRGCRCIEIDVWDGDESDSEASGYSSSDLEDHDPKKAAAARAKRKAKVDKAKAKIPKSVLQKLEQTSLGKKLEKYVEKKTEPKAPASPSTSSAAAAAAAPAPAPAAKDDSKVKVASQASSSPAPPLVEKLPALAAAVIEPRVLHGYTLTKEVSFREVCLAIKEYAFAVTDLPLIVSLEVHAGPEQQEIMVKIMNETWAGLLLDPPEKEADVLPSPSDLRRKILVKVKYAPPGQEVSAAAASDEDVSTPGQVAAPGSPEAKKKKKPSKIIHALSALGIYTKAVSFKSLHQPEATMPSHVFSLGEKSVREVHEKQGQDLFEHNRKYLMRAYPSGFRVGSSNLDPTPFWRKGIQIAALNWQHWDEGMMLNEGMFAGSGGYVLKPPGYRHDKPNAPAETAHVQHRTLDLEIKVLAAQNLPLPPETSVKSFNPYVKVELHVEAGGERHGHFPADGHECDLATAAAAKAAAARRSEDDEEVEGEYKARTKTAKATCDPDYKGEILEFKAIPGVVEELSFVRFIVRDDVKFRRDDLAAWACVRLDRLRMGYRFVRLMDAKGKESEGAILVKVMKKVY

SEQ ID NO: 33321 - protein, 388 aa, Oryza sativa
  misc_feature (371)..(371): Xaa can be any naturally occurring amino acid
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAXKPKKMKIMPNSAIPTAS

SEQ ID NO: 33322 - protein, 733 aa, Rhodopseudomonas palustris CGA009
MTDTNETLELPPETKPAEPAAKPQAAPGYNVFNDTKAVREGLPYPLGSCWDGHGTNFALFSANATKVEVCLFDGDTERRIELPEYTDEVFHGYIPDIGPGTFYGYRVYGPYEPENGHRFNPNKLLLDPYARAHAGLLTWDPAVFGYVMESGDDTTFDERDSARFVPKCVVVDPDFDWKGEPGRKFVPWDQAIIYETHVKGFTKLHPDVPEHLRGTYAGFGTKPVVDYISSLGVTAVELLPIHTFVNDSYLLDKNLVNYWGYNTIGFFAPDPRYAADVPNSLREFKEMVARLHDVGLAVILDVVYNHTAEGNELGPTLSFKGIDNASYYRLLPEQKRYYINDTGTGNTVNLTHPRVIQMVNDSLRYWAGEMHIDGFRFDLGTILAREHYGFDEQSGFLKSVMQDPLLSSVKLIAEPWDCGPGGYQVGGFPPGWAEWNDKFRDTARDYWRGEAPAAALAPRLSASGDVFNRQGRRAWASVNFITAHDGFTLNDWASYNDKHNEANGEDNRDGHSDNRSWNCGAEGPTDDETILSLRERQKRNMLATLLLAQGTPMLLAGDEFGRTQNGNNNAYCQDNEISWVHWDHDEAAQHLRAFTQRLLELRRTTPTLRRSRFLTGQYDETLDVRDVTWINANGGEMQQEHWDDSNVKCFGMLLDGRAQTTGIRRLGEEATVLLVLNGFDGMVEFTLPEVPHGTKWSLLIDTNLPHGVPDEEFECGAAYQVTARSVLLFKLGK

SEQ ID NO: 33323 - protein, 316 aa, Pseudoalteromonas tunicata D2
MSAVLAALKAQSTIVADTGDIEQIKKHKPQDATTNPSLLLNASKIEAYQPLLQRAWAYAKEHQSDVAKQVELACDYFAVLIGKEIADVVPGYISTEVDARLSFDSQAMIAKAKELLALYQLEGVSQDKVLIKIASTWEGIKAAEVLEQEGIKCNLTLLFSQAQARACADANVFLISPFVGRILDWHVANGMEKPTDPLQDPGVQSVRNIYEFYKTHGYNTVVMGASFRNTGEILALSGCDKLTISPALLSELENMTDAPNYQLEKFTVQFDKPDALTESQFRWLHNQDPMATEKLAEGIRAFAAAQVDLENCFKKL

SEQ ID NO: 33324 - protein, 469 aa, Xanthomonas campestris pv. campestris str. ATCC 33913
MSVENVEKLIKDNKVEFVDLRFVDMRGVQQHITFPASIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGAKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLTKGGVNLFSGDGYGGLSQMALWYIGGIFKHARAINAFANSGTNSYKRLVPGYEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 33325 - protein, 128 aa, Yersinia enterocolitica
EDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEA

SEQ ID NO: 33326 - protein, 573 aa, Pseudomonas syringae pv. tomato str. DC3000
MRRRKRRLEKMTTTSRPLYISYAGPSLLEMPLLNKGSAFTPQERIEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMGNLLDFQLRLAQKSADVAGWTAGTETFPQLLDVVTHAGATVLIGVSGQRGLFTEQVVRELYKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLAAIERNFWLPGYRAYRRRSV

SEQ ID NO: 33327 - protein, 464 aa, Escherichia coli
MVRSQLSRADAPCLLTSLRRQLMAMFGFPHWQLKSTSTESGVVAPDERLPFAQTAVMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKSVSASAFDSWMAVMTVLCIGLVAVFTRGMIQRLLILVGLIVACLLYGVMTNVLGLGKAVDFTLVSHAAWFGLPHFSTPAFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNRVDLSQNGNLIMVAVTLVLGAGDFALTLGGFTLGGIGTATFGAILLNALLSRKLVDVPPPEVVHQEP

SEQ ID NO: 33328 - protein, 128 aa, Yersinia enterocolitica
EDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGMVVEA

SEQ ID NO: 33329 - protein, 638 aa, Leifsonia xyli subsp. xyli str. CTCB07
MSENAVAHRDDLRNVAIVAHVDHGKTTLVDAMLRQTNSFGDHEHVEERAMDSNELEREKGITILAKNTAISYKGKHAPNGPITINVIDTPGHADFGGEVERGLSMVDGVVLLVDSSEGPLPQTRFVLRKALEAKLPVILAVNKTDRSDARIEEVVGEAQDLLLGLASDLADDVPDLDLDAVLDVPVVYASGRAGAASRNRPANGELPDNDDLEPLFEAILEHIPAPSYDPGAPLQAHVTNLDASPFLGRLALLRVHNGTLKKGQTVAWVRHDGDIHNVRVTELLMTKALERYPAESAGPGDIVAVAGFADIMIGDTLADPEDVRPLPAIHVDDPAISMTIGTNTSPLVGKTKGHKLTARMVKDRLDRELIGNVSLRVFDIGRPDAWEVQGRGELALAILVEQMRREGFELTVGKPQVVTRTVDGKTHEPYEHLTIDIPEEHLGAITQLLAARKGRMENMTNHGTGWVRMEFIVPSRGLIGFRTEFMTTTRGTGIANAISHGYDQWAGPIVTRSNGSIVADRQGVVTPYAIIQLQERMTFFVNPTEEVYEGMVIGENSRADDMDVNITKEKKLTNMRSSTADTFESMTPSRQLTLEESLEFAREDECVEVTPEAVRIRKVELDATARGRAAARLKRQDS

SEQ ID NO: 33330 - protein, 325 aa, Listeria monocytogenes EGD-e
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAQSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 33331 - protein, 117 aa, Coprinopsis cinerea okayama7#130
MQPPVENLAPPKDDPFTPEELAQYDGSDTSKPIYVAIKGTVFDVTRKADVYGAGKSYNIFAGKDGSKGLGMSSLKPEHAIADYSDLGEKERKVLDDWYSFFEKRYNIVGRVVPSPSL

SEQ ID NO: 33332 - protein, 118 aa, Coprinopsis cinerea okayama7#130
MPEMQPPVDNLDPPKHDPFTVDELAQYDGNDKSKPIYLAIKGTVFDVSRRPEMYGPGGKYHPLAGRDASRALGKGSLEKEDLSDNLEGLDEKQREKVDWWFDFFEKRYNIVGSVVGRE

SEQ ID NO: 33333 - protein, 406 aa, Myxococcus xanthus DK 1622
MKAVVFHGIGDIRLDDVEEPRIEKSTDAIVRLTASAICGTDLHMIRGTMPGMKPGTILGHEGVGVIEALGDDVRNLNIGDRVVIPSTIACGNCSYCRAGYHAQCNDANPNGPSAGTAFFGGPQETGPFHGMQAEKVRVPFANVGLVRIPEGVSDEQAILISDIFPTGYMGAELAEIKPGDTVAVFGCGPVGLFAIVSAKLLGAGRVFAIDCHEDRLDLARAQGAEVINFEEEDPLETLKRLTNGIGVDRAIDAVGVDAMHPHHGPAAKKAHQEKAEFKREVKEAAPKTNPKGDNWVPGDAPAQALMWAVEGLAKAGTLSIIGVYPAQVRTFPIGMAMNKNLTMKMGNCNHRKYIPKLLELVRTGVVDPTAILSHVEPMGSAIDAYRNFDARKPGWVKVELEPTQLQ

SEQ ID NO: 33334 - protein, 358 aa, Oryza sativa (japonica cultivar-group)
MATAGVTEHLLSPRAGAGDDMSAGDGEGWCNALAKYEALASSLPSCHGLGSAPYRRYGGFWYPAHLMPATLAARDTFVARPSDVILATMPKSGSTWLKALAFCVVHRGRHAPAAGQHPLLHSSPHDLVPFLHSIYEISRSCRVAPGHRLDAMPSPRILAVHEPLSSLPASVKASGCRVVYLCRDPKDAFVSLRHYLDEIKPEGSTMTPFDEAFELLCDGVSPYGPMWDHAAEYWKESLARPEEVVFLRYESLKEDGVGSVRRLAGFLGCPFTGEELAGGVPETIVELCSMERMRNVEANRDGEHGATWSSFKNSAFFRKGEVGDWKEHMSPEMARRLDDVVEEKLRGSRMSLIRHRQY

SEQ ID NO: 33335 - protein, 541 aa, Pseudoalteromonas tunicata D2
MPHISIEQRLHNSLLDAAQDLQKLHLVELFQLQPTRAEIYQLNIAPIYLDYSKQRINQQALDSLVELAEHKQLSQARDAMFHGEKINHTEQRAVLHTALRNSQRLSSHAPDIAEEINQTKQRMLSFVDKILNQTLRGFTDKPITDVISIGIGGSFFGPKMLQSALVEYQTSNINVHYLANIDGAQIKQLLAKLNPATTLVIVASKSWTTIETQVNANAVMTWFKGKFPEQAAIEKHWVALTAKPELAQAYGIAPEYIFPLWDFVGGRYSVWSAIGLPLALSIGSKAFDELLAGAASMDEHFCQAPLNQNMPVLLALIGYWQQVYLGYNNLMVLPYSHGLKSLPAYLQQLDMESNGKSVNAIGDPIATSGPILWGAEGTNCQHSFMQLLHQGKQQAMIDFIVPAKGETLYPEHHKMMIANCLGQAQALMQGKTEQQAFDELIASNMPTEQAKALAKHKAMPGNTGSNTLVLESLTPYSVGALLALYEHKIFCQGILFGINSFDQWGVELGKQLGNQLMNAITTKNSSQLDPSTQALLKHINL

SEQ ID NO: 33336 - protein, 312 aa, Pseudomonas syringae pv. tomato str. DC3000
MFLVCGEALFDIFTRADDGGSLNRLGFDAIAGGSPFNVAIGLRRLGVEAAFFAGLSTDYLGRRLRAVLEQETVNAEHLIEFDAPTTLAMVAVGSDGSPTYSFRGDGCADRQLRLEHLPELDERVRGIHVGSFSLVVQPIADTLLALVARESARRLISLDPNVRLNPAPDIQRWRTQIAAFAEHAHLIKVSDEDLHLLYPDSDPQQIAEGWLGKRTQLVIVTRGTQGASVFTRQHGTWSVPAKTVVTADTVGAGDTFQAALLTFLSERQLDTPQGLSTLSRETLDEMLNFAVGAAALTCTKVGPDLPYRHQLG

SEQ ID NO: 33337 - protein, 523 aa, Chlorella sorokiniana
CRPPSSPSLSWPPGLRSPALPRAVACARGRSAKRDVAAKRLRSRSPRMDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRLWQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGPSREYNVDLAAGANIAGFTKVADAVKAQGAV

SEQ ID NO: 33338 - protein, 658 aa, Lactobacillus johnsonii NCC 533
MAEKKTFYITTPIYYPSGKLTIGNAYTTIAADTMTRYKKSRGFDTFFLTGTDEHGLKIEQKAEAQGIKPQEFVDKMADSYKDLWKMLDVSYDRFIRTTDEDHVKAVQKIFERLLKQGDIYLGEYTGWYSVEDEEYFTESQLAEVYKDDDGNVIGGKAPSGHEVRLVKEPSYFFRMSKYADRLLQYYKDHPDFILPHSREKEMVNNFIKPGLEDLSVTRTTVDWGIPVPSDPKHVVYVWIDALSNYITALGYGSDNDALFKKYWPADVHLVGKEIVRFHTIYWPIMLMALDLPLPKQIFGHGWVLMRDGKMSKSKGNAVYPEMIVKRYGLDALRYYLMRAIPFGSDGIFTPEDFVERVNFDLANDLGNLLNRTVSMINQYQDGQVAPVASEQDEFAKDLIKTANETIAEYQKQMDALHFSQALDSVWKLISRANKYIDETTPWTLNKEGKSEELSKVMTNLAESLRLIAILIAPVMTQSPVKMFEQLGLDWKNDDQKKLDFGGFDWNIKVTEKPTPIFPRLKNDVEVKYIKEEMKKAKPKKKTRSQQKEEKHITIDDFDKVKIQVGQILSVEPVKGSSKLLMFKLDFGDGNERQILSGIRKFYPDASELLDKKVLAVTNLKPRKMLGHESQGMLLSSEKDGKVKLAIVGDEHEVGAELG

SEQ ID NO: 33339 - protein, 271 aa, Arabidopsis thaliana
MATQSNSGFDSLSSMMSRHAINFQSNTSSEMTPMSPYLGMNMNMINVGSPGFLQTGNSSNGSDSGSGLKLDTSMVSEWSNEEQYILDAGLEKYKDMPSIDMYIQIGNTLPDKSIRDIALRCRWLRRKRRKSEELNCGRRASSSKGKQVESSSKSSIPSVLPHNMASYPFSGPSTSTSKQITSEDLSSYATNLIEQNVRAFSQIRANLSSYKAGDNLDLFRQARNNLITIQNEINNMPGLMNKMPPLPVTINDDLSVMMPFNTMQSGGFHRK

SEQ ID NO: 33340 - protein, 611 aa, Oryza sativa (japonica cultivar-group)
MDFKVASFLLLLLIVTCGAAQGQGNDFVVLDLKTTEIGEDASPMYKEQIASTKIPVTLLRSKHSSLCSACENITSEAVNFLSEKQIQDKIRTILHDTCSQTFSFEQKCLETMDSYATLVFAKIAEIKPAAFCKQYGLCRDMALLSAVKSESTCLFCHHIIDEITSKLKDPDAEFEIIQLLLKECNKIEGHQQQCKRMVLQYVPLVLVNGEKFLEKNDVCAMIQACDAGKRKALNLFSARKLILSAYFVVLPLRDEGAISLGLSTLPGLFAGSLLLTLVAAPVASLAFSLPSIPKPRALVFIHRFFSLSLLVFFVLWFASTPGHSPSISQVSLLNLIAISSTWARVIDVMDNESGSRLFGFIGAGATLGQLFGSLFAATMAWLGPCFWLIARSSYLMYISLFLWLSAVVSSFFYFQLHRWKDPPFTIHLHLPYFQKVTIVATTISSPTARRRTFALINSFIAVFILAGQLTLTGRILTVAGVTVAICASPFIATLNMVALALWPTWVAVAVTETIRKVTTYVLTRPGRELLFTVVSQDEKYKAKVCIDVVVQRLGDATAAGIYSLLFSSLEKKASMVTLYALPLCFVWLLTAFHLGRLQTNLVKVQVASFAS

SEQ ID NO: 33341 - protein, 637 aa, Corynebacterium glutamicum ATCC 13032
MTHPEFRNVAIVAHVDHGKTTLVNAMLEQSGVFSDHGEVADRVMDSGDLEKEKGITILAKNTAIRRKGAGKDGNDLIINVIDTPGHADFGGEVERALSMVDGVVLLVDASEGPLPQTRFVLGKALAAKMPVIIAVNKTDRPDARIDEVVEEAQDLLLELASALDDEEAAQAAEQLLDLPVLYTSGREGKASTENPGNGNVPNSPDLMPLFETLYEVLPEPTADIDGPLQAHVTNLDSSSFLGRIGLVRVHAGTLRKGQQVAWIHYDEEGNQHTKTAKIAELLATVGVARVPATEVVAGDIAAISGIEDIMIGDTLADPENPVALPRITVDEPALSMTIGVNTSPMAGRGGGDKLTARVVKARLENELIGNVSLKVNPTERPDTWEVQGRGEMALSILVETMRREGFELTVGKPQVVTQTIDGKLHEPYEIIVIDVPSEYQGNVTQLLATRKGLMQSMSTTPGSDWIRMEFRIPARGLIGFRTQFMTETRGTGIANSYSDGMDVWAGEIKGRAHGSLVADRSGQITAYALTQLADRGSFFVEPGTETYEGVVVGLNNREEDMDINPTKEKKLTNMRAASADTTVTLAKARSLSLDEALEFCGVDECVEVTPDVLRIRKVILNATERGRARSRAKSLNK

SEQ ID NO: 33342 - protein, 360 aa, Arabidopsis thaliana
MADSESKIYHERQRLQFCLLHCLNNLFQDKDAFTKESLNSIAEKLETNDPNKETWTPLSFVLKPHHNTITGNYDVNVMITALEGKGKSVVWHDKRIGASSIDLDDADTLMGIVLNVPVKRYGGLWRSRHWVVVRKINGVWYNLDSDLVVPQLFRDDDEVRGFLDQNLSLDVIGLIWNLPYNANQLPLASNYRVVITHWSDLNGMFSHVTNYPLDFDVYPQVSSKVSAIYKATGTKRFNANTRPVTPGKQSSVKGPYYKNPGCTTSCGLRLPRKTECTAARLIKDLSCKFVMGLRLVVMRKKKKKRSPPLKKASSSGISQPSVISVVNDNNHRSAAIEDCIQFINSSSSFTRSNSTCGSKS

SEQ ID NO: 33343 - protein, 801 aa, Staphylococcus aureus subsp. aureus N315
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARKIFEVEKV

SEQ ID NO: 33344 - protein, 491 aa, Gibberella zeae PH-1
MSLPADFKWGFATASYQIEGAIDKDGRGPANWDTFCAQAGKIADGSSGVTACDSYNRTAEDISLLKSLGSKAYRFSICWSRIIPLGGRNDPINQAGIDHYRKFVDDLLDAGITPFITLFHWDVPDELDRRYGGLMNREEFPLDYERYARVMFEAIPRCKNWITHNEPWCSAILGYSTGSNAPGRCSDRNKSDVGDSSTEPWIVGHNLLVAHGRAVKIYREEFKPKNGGEIGITLNGDATYPWDPKDPRDIEAAERKIEFAISWFADPIYFGDYPASMRAQLGDRLPTFTPEEKALVLGSNDFYGMNHYTANYVKHREGEAAPEDFVGNLELHFWNHRGDCIGEETQSTWLRPCAQGFRDLLVWISKRYGFPRMYVTENGTSIKGENDMPREKILQDDFRVQYYDDYVRAMADASRLDGVDIHGYFAWSLLDNFEWAEGYETRFGVTYVDYENDQKRYPKKSAQHLKPLFDSLIKKEENGLNGVGKVKAGQT

SEQ ID NO: 33345 - protein, 218 aa, Oryza sativa
NCPLPICLSICLEMADVEEYRCFIGNLSWSTTDESLKDAFGKFGNLTEAKVVFDKYSGRSRGFGFVTFDEKKAMEDAIEGMNGLDLDGRAITVDKAQPQGPGRDRNGDRDYDRDRGSRYDRGRDFGGGGRAPRGSGGGGDCYKCGKPGHFARECPSGDGGGRGDRYGGRDDRYGGGGGGGGRYGSDRGGDRYSGRSRDGGGYGGGGGDRYSRDRSGPY

SEQ ID NO: 33346 - protein, 588 aa, Gibberella zeae PH-1
MSDPPSRIRSILSHLRPHPAAPVNYHTLSPTTFLERAAAIEPDAEAIFHITVNGAVLRRSYAEFADRARGLAYYLLKHGYRRVGVLAPNTPAFLESIYGIVAAGAVIVPANYRLKQEDIAYIFDFAEVDCIIVDNEFVGLLDAYKEKHENVPLIVDMVDFLPHEQAEACFKAVANLAYQDNDATVGQLSGPFDDAVLEGLKHDIAQGSQGWAGLHSQARSEDDMLAIPFTSGTTSKPKGVVYTHRGSYLAAMANIVESGLNIGRCKYLWTLPMFHAVGWTFPWAVVAVRGTNVCLRKIDYPLIWKLLKEEGITHFNAAPTVNTLLVAAKEAEKLPHEVKVTVAASPPTGYLFEQMTKLNLIPVHVYGMTETYGPSTKCYTLPEWDSLPPTEKYAKMSRQGHGFITSLPIRIIKPDQPQGVLIDVAKDGKEIGEIVFMGNICAKEYYKDPAATRELFAGGVLHSGDLAVWHPDGSAQIQDRAKDIIISGGENISSVALESMLAQHPDILEAGAVAVPDSHWGERPKVYVTVKDGKSVTGDEIIQWAKHQSDISRFMVPREVEIVDELPKTSTGKIKKNVLREWAKHGRT

SEQ ID NO: 33347 - protein, 162 aa, Brassica rapa
MVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 33348 - protein, 468 aa, Oceanospirillum sp. MED92
MSEKTLNLIKESNAKWIDLRFTDSHGKEQHVTIPVSDMGDDFFEEGKMFDGSSISGWKGINDSDMILMPDDSASLLDPFSEATTVIVRCNIVEPATGQGYERDPRSVAKRAEEYLKSTGIADTAMFGPEPEFFVFDEVKWHADISGCGYTIASEEASWASSHKIEGGNTGHRPRVKGGYFPVPPIDSLHDLRGAMCDAMEAMDLEIEVHHHEVATAGQCEIGVGANTLTAKADEVQVLKYCVHNVAHAYGKTATFMPKPLVGDNGSGMHVHMSLSKDGVNLFAGDAYAGMSETALYYIGGIIKHAKALNALTNSSTNAYKRLVPGFEAPVMLAYSARNRSASIRIPYVTSPKARRVEARFPDPSANPYLCFSALMMAGLDGIKNKIHPGDAADKDLYDLPAEEAAEIPQVASSLEEALNALEEDREFLTQGGVFTDDMLDAFIELKREEVEKVNMTTHPVEFDLYYSV

SEQ ID NO: 33349 - protein, 204 aa, Triticum aestivum
  misc_feature (49)..(49): Xaa can be any naturally occurring amino acid
MKIPPNMDPGEAFPFSKRGGGINFGPPENLVFLCDQYSTEVLVYLRQNXEPQAGFLSALHHTCASLGPLRQQCITLVDYYIPAFFLEVSVVKPEELCESAHLCPKGAATRSSTRGEACGLCHHVLVEVLTMLKDPNTKLEIVGLLFKTCSKAKNYEPQCKRLVLDYIPLILVKTQNFLETTDVCFATHACKTGMQATIPLSAAL

SEQ ID NO: 33350 - protein, 635 aa, Persea americana
MKGCDCIEPQWSSDDLLVKYQYLSDFFIAVAYFSIPLELVYFVQKSAFFPYRWVLTQFGAFIILCGATHFISLWTFTIHSKTVILVMAVAKVSTAVVSCATALMLVHIIPDLLSVKTREMFLKNKAEELDREMVIIRAQEETGRHVRMLTHEIRSTLNRDTILKTTLVELGRTLGLEECALWMPSHNGSSLQLSLTLRYPISVGATVSIQLPIVNKVFNSIHAVIIPHSCPLARIRPLSGKYVPPEVAAVRVPLLYLSNSQVNNWPELSANGYAVMVLMLPSDSARKWHVHELELVEVVADQVAVALSHASILEESMRAQDMLTEQNAALDLARQEAERAICARNDFLAVMNHEMRTPVHAIIALSSLLLETELTPEQRVMVETVLKSSNLLETLINDVLDLSRLEDGSLKLDIGIFNLHAVFREVINLIKPIAAMKKLSLSLMVAPNVPAFAVGDERRLMQIILNVAGNAVKFTKEGQVSVMACVEKQESLADPQALESYPASSDSHFHLRVQIKDSGCRVSPQDIPHLFTKFCICTRSGVNRSQDGSGLGLAICKRFVNLMEGHIWLQSEGLGKGCTATIVVKLGNNGNKTEESTQVVPRAHPKCGVENLSSRNPFLTISSRTQILKKCLLDF

SEQ ID NO: 33351 - protein, 216 aa, Brassica napus
LCLCFSFLFPLVSRSGRIRKVLLVSKDPKNTYHLYLPGVPGGSEAFELAAKFCYGVVLQFTSANIASLRCVAHYREMTEELSEKNLEVRTEAYLKDSIFNDISNSITVLHSIEKLLPVAEEISLVGRLVNAIAVNACKEQLVSGLLKLDQKFERLAPETEKPSDWWGRSLLILKLDFFQRVVSAMKSQGLNHEIISDILMSYARKSLQIIREPSLV

SEQ ID NO: 33352 - protein, 143 aa, Zea mays
HEMLKKGVDEGRWSEKFVSRIEFKGDMVVATPDIYQVPLTSDVEFIILASDGLWDYMKSKDVVSFVREQLREHGNVQLACEALAQVALDRRSEDNISIIIADLGRTEWKKLPVQRQNMVVELVQAAATVGIVTVGIWMTSLLS

SEQ ID NO: 33353 - protein, 100 aa, Persea americana
PLLGGVRDVPDHNSAETEELARFAVQEHNKKANTRLEFSRVVKAKEQVVAGTMYYITLEVVEAGQKKIYEAKVWVKLWENFKELQEFKPVGDSSSTSSDA

SEQ ID NO: 33354 - protein, 298 aa, Rhodococcus sp. RHA1
MADQYAQQDPTTQYPAPDREHQPELSHPGLTSDMVTAPDHGEKSYRGSGRLDGRRALITGADSGIGRAVAIAFAREGADVVVSCLDEEEADARETVRLVEEAGRRGVVATGDITSEDHCQYLVDLTVRELGGLDILVNNAAFQMVQTGGIADITTEQFDRVLRTNLYALFWLCKKSVAVMEPGSTIVNTSSIQGTNPSPGLLDYATTKAGIIDFTKGLAADVAKRGIRVNAVAPGPIWTPLIPATMPADGYRQFGDDVPLGRPGQPAELAPAYVFLASNESSYVTGEVLGVTGGTPFT

SEQ ID NO: 33355 - protein, 210 aa, Acidovorax sp. JS42
MTSSALVPSSAELCPDRTAEVSRTTAETRITVRVNLDGTGAASLHTGIGFFDHMLDQIARHGLIDLQIDCDGDLHIDGHHTVEDVGITLGQAFARAVGDKKGIRRYGHAYVPLDEALSRVVVDFSGRPGLHLHIPFTAGSIGGFDTQLTYEFFQGFVNHAGVTLHIDNLKGINAHHQCETVFKAFARALRAALERDPRAAGVIPSTKGSL

SEQ ID NO: 33356 - protein, 463 aa, Oryza sativa (indica cultivar-group)
MESDTDLISVLPGEVLQHILSFSRIRAIVRMRRLSRRWRRVIECLQFICLDCRDFKHWKVEKFARFVDNLLLIRSKVDLHTFQLYWFHYLPLNCNDLRKWILYAVKHNVKVLDVELDMYDKTTLPSRIFTCRSVEELSLQMGEAPDEDLEHVGLVLPDIIQLPSLKKLTLSDVEVDQLSLNQFIGRSPNLEDLHLINSATYLDLIASKVLKRLTLDGFMHGPKRFTISAPHLVHFECQGCALQDVSWGEQPSLESAHIDTWGKKYDGESEFIGVLLSAKTLALFGSDVKVMLEKELPACPVFERLTTLEIGNWCLTEDFYAVLRFLQLSPRLGELTLMQKELPHAAGKGAETDAMPIDGMTFQCPLLETVIIQCSKGDDGIDKLVNVLAANGINPKKIQVTFYEDIEEMERPENRRIIEEREKELCNFEKMAKKNPEWVDESRYADSNPETDSDEYDNDYDDF

SEQ ID NO: 33357 - protein, 653 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVANKLAELSKKGVTTIIGGGDSVAAVEKVGVAGVMSHISTGGGASLELLEGKVLPGVVALDEATPVKWIYLSLKLFLLLSFVSRQAALAMAMAASIIQSSPLSFNSNNAKPRIHSSGSLGGIKSQNRVSPLSAVGLSSGLGSRRKSLLICHSAINAKCSEGQTQTVTRESPTITQAPVHSKEKSPSLDDGGDGFPPRDDGDGGGGGGGGGNWSGGFFFFGFLAFLGLLKDKEGEEDYRGSRRR

SEQ ID NO: 33358 - protein, 406 aa, Bordetella bronchiseptica RB50
MAITDVLVPQLSESVSEATLLTWKKQAGAAVEADEILIEIETDKVVLEVPAPSSGVLSEIVMGDGSTVTSGEVIARIDTAAKAAAAPAAAAEAPAAAAAAAPAAAAPAAASSTASGVASPAAAKILAEKGVDAASVAGTGRDGRVTKGDALAAGNAPAAKAAAPVAPPTLSLDGRPEQRVPMSRLRARIAERLLQSQAENAILTTFNEVNMQAVMDLRARYKDKFEKEHGVKLGFMSFFVKAAVAALKKYPVLNASVDGKDIIYHGYFDIGIAVGTPRGLVVPILRNADQLTIAEIEKTIADFGKRAADGKLGIEEMTGGTFSISNGGVFGSMLSTPIINPPQAAILGIHATKERPVVENGQIVIRPINYLAMSYDHRIIDGREAVLGLVAMKEALEDPQRLLLDL

SEQ ID NO: 33359 - protein, 898 aa, Bordetella bronchiseptica RB50
MCNAQAGATPPQIPDPDPVETAEWREALDSLTQAGGPERAAYVLQQLLARATALGVRAPGITRTAYLNTIAADQEPPFPGNLSLEERIASINRWNALAMVVRANQAHGELGGHIASYASAADLFEVGFNHFFRAPAPGFGGDLVYMQPHSAPGIYARAYLEGFLNDVDLAHFRQEITAGAQGLRGLSSYPHPWLMPDFWQFPTGSMGIGPINAIYQARFMRYLEHRSLAMPSDRKVWGIFGDGEMDEPESIAALTLAARERLDNLVFVINCNLQRLDGPVRGNGRIIDELETLYAGAGWNVIKLVWGGDWDALLRRDPDGVLAGTFSHTVDGQFQTFAANDGAYNRQHFFGQDPRLSALVADWSDEAIDRLRRGGHDMVKIHAAYHRATHHRGQPTVILAQTKKGFGMGTAGQGKMTTHQQKKLDDEALLAFRDRFALPISDADCLALKFYKPAEDSAELRYLESRRAALGGYLPRRRTEAPRLAPPPVADWARFALQAAGKEMSSTMAIVRMLTALLKDPQLGPRIVPIVADEARTFGMANLFRQVGIYSAQGQLYEPEDIGSVLAYREARDGQILEEGITEAGAISSWTAAGTSYSVNGLPMLPFYIYYSMFGFQRIGDLIWAAADQRTRGFLIGATSGRTTLGGEGLQHQDGYSHLAAAAVPNCRAYDPAYAYEVAVLVEHGMQRMLDEQCDEFYYLTVTNENLAQPDMPEGEETRTGILRGMHRVRAADATPQVRLLGAGPMLDEAMRAAQLLRDEHGVDAEVWSVTSFSELARGGRGAERAQALGLPCPDGNWLAQCLGDQATPVVAVSDYVRAVPEQIRAWVPGPYRVLGTDGFGRSDTRARLRDFFEVGAPWIVLHALDLLAREDSAWQPALQARREQLQAATRNVPSWQS

SEQ ID NO: 33360 - protein, 768 aa, Bordetella bronchiseptica RB50
MRRKGCAPMDENLTKLALDYHAYPTPGKISVTPTKTLANQDDLSLAYSPGVAAACMAIFDQGNDAASKYTSRSNLVGVITNGTAVLGLGNIGPLAAKPVMEGKGCLFKKFAGIDVFDIELAENDPDKLVDIIAALEPTLGGVNLEDIKAPECFYIEKKLRERMNIPVFHDDQHGTAIISSAAILNGLKVVGKDIGQVKLACSGAGAAAIACLDLLVHLGIKREHIYVVDSRGVIWEGRDENMEPNKRRYAQKTEARTLADVVNGADVFLGCSTAGVLTPEMVKTMAAQPLILALANPEPEIRPELAKAARPDCIVATGRSDYPNQVNNVLCFPFIFRGALDAGATRITEEMKLACVKAIAELAQAEQNDEVARAYAGQELSFGPDYIIPKPFDPRLIVQIAPAVAQAAADSGVATRPIEDIEAYRQKLMGFVYHSGQLMRPLFQQAKQAPKRVVYADGEDERVLRAVQTVIDEKLAEPILVGRPSVIEMRIKKFGLRMVPGQNVEIVDPEDDSRFNDTWNGYYQLRGREGVTPAIAKAMIRKHNTLIGAMLLRRGDADALLCGVASKYDNQLKYVEEVIGRKPGQTYGALNVLMLPNQTLFVTDTHVNENPSADEIANITIQAAEEMLRFGVMPKIALLSHSNFGSRPTDSSRKMAHARKLVAERAPHLEVDGEMHADAALSESIRLQAYPDSTLKGRANLLVMPNLDTGNITYNMLKMTGSNGIAMGPILLGSARPVHILTTSATVRRIVNMTALAVVDAQQEAAEG

SEQ ID NO: 33361 - protein, 226 aa, Brassica rapa
MKKLYRKGTVHPSPQIKSDDHLLSLLPVAIFSLAAVLSPKDREVLAYLLSTASYSSNRNYTSRMNKTKLHEKSRLDNHSPLFHCDCFSCYTCYWVRWDSSPSRQLIHEIIDAYEDSLEKKKHTKKKKNVSGKKDRRKRSGKSSALASPSFGTNDSESLSQVTESIASSCACSSSSKLVEGIGGCNGGLESTEEFHAGDGSEEAEEEKGSVRRFVSFIGEKVFGVWG

SEQ ID NO: 33362 - protein, 971 aa, Kluyveromyces lactis NRRL Y-1140
MLSVSVRNSLRHSSLRVLKTCSKYNPVRIPTCHYHLLSGTKIAKSIREEAFKEIKQIQIKSPSFEPCLKIIQVGTRPDSTAYVRMKLKASEESGVKCIVEKLPEDIDELALLQKIQQVNDDDSIHGLLIQLPLPRHLNEAEVTNAVSYQKDVDGFHRFNVGELSKRGGKPYFIPCTPNGCIRLLKESGIDLRGKRAVVIGRSDIVGTPVASLLKDLNATVTICHRYTENIADVVKNADVVIAACGVPNMVKPNWLKQDAIVIDVGINYVPDASKKSGRKLVGDVDFELCKDKASYITPVPGGVGPMTVAMLVQNVLLAAKRQREESTRMPHIKPLPLKIEAKVPSDIEISRKQKPKYIEAVANELGVHPSELELYGHYKAKVSPKIANRLADNENGKYVLVAGITPTPLGEGKSTTTIGLVQALSAHLHKPSIANVRQPSMGPTFGVKGGAAGGGYAQVIPMDEFNMHLTGDIHAIGAANNLLAAAIDTRMFHEATQKKHETFYKRLVPVKKGVRSFTPSMLTRLNKLGINKTNPDDLNTEEIIKFARLNIDPDTITIKRVVDVNDRMLRQITIGQAPTEKGFTRQTGFDITVASELMAILALSKDLKDLRERVGRIVIGSNYEKEPITVNDIGCAGAIAALLKDAVKPNLMQTLEGTPVLVHAGPFANISIGASSVIADRVALKLVGKPKEADESAESGYVVTEAGFDFTMGGERFFNIKCRASGLTPNAVVLVATVRALKLHGGAPDVKPGQSLPEEYLKENVDLVRNGTANMCKQIENIKQFGVPVVVAINKFESDTEAEIDAIKEAAQRVGAFDVVSTNHWAEGGKGAIKLAEAVIEASKQPSEFKFLYDVNDTVENKLSTIVQKMYGGANIEISEEAQKKIDMYRQQGFGDLPICIAKTQYSLSHDAKLKNVPTGFTFPIRDVRASIGAGYLYALAAEIQTIPGLSTHAGYMNVEIDEDGEIEGLF

SEQ ID NO: 33363 - protein, 126 aa, uncultured bacterium
MKKDIIYTTGAPAPGGALSQAVKAGETIYLAGQVGFDPHTMQVVSTDFDEQARQAFKNLLSVAEAAGGSDRDIVKLNAYLTDVNMFPRFNAIMSEYFSPPYPARATLGIAALPQGAVIEIEAIMVL

SEQ ID NO: 33364 - protein, 160 aa, Triticum aestivum
ELEAAAEEELKITELRLAKLFSAETAAPPTSGSSNRTRPPITTHVLDTALGSPAAGIEVHLEMWKDASSPPSFDNKEFKGWTTLGTSITNNDGRSGQLMDIVDNVAPGFYRISFNTSKYAPSGFFPYVSIIFEIKRSQTTEHFHVPLLHSPFSFTTYRGS

SEQ ID NO: 33365 - protein, 470 aa, Leifsonia xyli subsp. xyli str. CTCB07
MMSWHPSGSLAVLTADEIPSLQRRRLLRRITVLSTFGGLLFGYDTGVISGALPFMRFEGVALSPFEEGVVVSSLLFGAAAGSLVGGRIADRSGRRRLLIGLAIVFFAAALGCTFAPSIAVMVAARVLLGIAVGAASVAVPLFLTEVSPAQRRGQIVTHNELMIVSGQLAAFTVNAAIAAAVPEHAEVWRWMLVVASLPAVVLFFGMLVVPESPRWLILQGRFAEGRAEHQAEREAAEIRDAIEHAPSASFADLVRALGTPWIRRVFLVGVGIAMVQQLTGVNSIMYYGVQILQRAGFDAQAALVGQIANGVISVLATFGGIWLLGRVGRRPLLITGLIGTTSALLLVGTSSAVLAGTPALPFATLTLTVLFLTFQQGAVSPVTWLMLAEIFPARIRGVAFGAAALVLWLTNFLVGFLFPQLVSGMGISPTFFVFAAVGCGALLFVVRALPETRGRSLETLERELEAHYTR

SEQ ID NO: 33366 - protein, 516 aa, Oceanospirillum sp. MED92
MTQKRATKALIILDGYGVESSESSAIQAANTPVWDKLLAENPNSRIQTSGMAVGLPDGQMGNSEVGHMNIGAGRVVYQNFTRISKAIEDGEFFDNAVLVDAMDKAISVGKAVHIVGLLSPGGVHSHEEHIFALLEMAVKRGAEKLYVHAILDGRDMPPRSAEPSLLRTEEKLAELGVGAIATVAGRYFSMDRDNRWDRVQQGYDAMTSGQAPCTATSAVGALQDAYGRDENDEFVQATVITDTEGNPKGVVSDGDALICANFRPDRAREITRAFTEKADFSGFERAATPELASYVMMTQYAADIQADCAYPPQAISNDLGEFLSGIGKTQLRIAETEKYAHVTFFFNGGQEEVYPGEDRILVPSPDVATYDLQPEMSAPEVTEKLVEAIRSGKYDLIVCNFANGDMVGHTGKFDAAVKACEVVDDCVEKVLAALREVDGEALITADHGNVELMVNPETGQPHTSHTNWPVALIYDGPRNGELNLADGALCDLAPTLLSLMGLEAPEEMSGKPLASF

SEQ ID NO: 33367 - protein, 337 aa, Oryza sativa
  misc_feature (304)..(304): Xaa can be any naturally occurring amino acid
MPATAGRVRMPANNRVHSSAALQTHGIWQSAIGYDPYAPENNKHQPPSSSVSANAAAANAAAASAPSASAPSSSSAAASSDNAYTSFQGLLALARITGSNSDETRGACRKCGRVGHLTFQCRNFLSVKEDLDMEDDIDAGIRAASQANAQAKLDEFRKKTSGGKDADEGSDDEDEDDEEDSDDSSDSDIDPELERIIAERERAKSGRKHSRDEEKKTSRHRSSSRGRSKHRRSTKRSDTEDDLEEERSKDKKKKSRRKRHERSDEDSESDSDKKRHRKSRKDRKRRRSHRRSDDTSDEDESGGXRRHRKSESSGSDGDERHGQGAKRSKEKRGKEEC

SEQ ID NO: 33368 - protein, 443 aa, Thermococcus kodakarensis KOD1
MTPEEVVERYSQVISRASHVTYVPIVPSRAENALVWDIEGRAYIDFLADAAVQNVGHNNPRVVEAVKKTADRLLHFTFIYGFPVEPLLLAEKLREIAPLEGAKVAFGLSGSDANDGAIKFARAYTGRRSIIGYLRSYYGSTYGAMSVTGLDFEVRSKVGQLSDVHFIPFPNCYRCPFGKEPGKCRMECVSFLKEKFEGEVHAEGTAALIAEAIQGDAGMVVPPENYFKKLKRILDEHGILLVVDEVQSGLGRTGKWFAIEHFGVEPEIITLAKPLGGGLPISAIVGRGEIMDSLPPLGHAFTMSGNPVASAAALAVIEEIEEKELLKRAQILGERAKRRLEKMKKKHELIGDVRGLGLMLGVDLVKDRETKERAYDEAKKVVWRAYELGLIVAFLQGNVLRIEPPLTIEEEVLDEGLDKLEEAIEDVEEGRVPDEVIEKVQGW

SEQ ID NO: 33369 - protein, 518 aa, Nicotiana tabacum
METVQIIITASCAAIIITLVVCIWRVLNWVWFRPKKLEKLLRKQGLKGNSYKILYGDMKELSGMIKEANSKPMNLSDDIAPRLVPFFLDTIKKYGKKSFVWLGPKPLVLIMDPELIKEIFSKYYLYQKPHGNPVTKLLVQGLVSLEEDKWAKHRKIINPAFHLEKLKHMLPAFCLSCTEMLCKWEDIVSIKGSHEIDVWPHLEQLSSDVISRTAFGSNFEEGKRIFELQKEQAQYFVEAIRSVYIPGWRFLPTKRNRRMKEVEKDVRASIRGIIDKRVKAMKAGEASNEDLLGILLESNFTEAEQHRHKDSAMSIEEVIQECKLFYVAGQETTSVLLVWTLILLSRHQDWQSRAREEVFQVFGNQKPDFDGLNRLKVVTMILYESLRLYSPVVSLIRRPNEDAILGNVSLPEGVLLSLPVILLHHDEEIWGKDAKKFNPERFRDGVSSATKGQVTFFPFTWGPRICIGQNFAMLEAKTALAMILQRFSFELSPSYAHAPQSILTMQPQHGAPLILHKI

SEQ ID NO: 33370 - protein, 433 aa, Thermococcus kodakarensis KOD1
MENVEVVEKPVLKVGIEEKVEPAKAFVFGLQHVLAMFGATVTVPLVVGGAVGLSGDQIAMMIQAVLLAMGIATLLQTIIGTRYPIVQGSSFAFIPGLISIGSTIGMAAVQGALIVGGLIEGLVGWLGIIGKVRKLFTPLVTGVTITLIGFSLANVALMNFFNAYADPNGTNVWKAVLVATVTFLTTVFVALKAKGSLKAMPVVVGAAVGYLISIPLGLTNFSLIESLPMLSIPKPFPWGAPVFDTAAIAILLFAFMVSIIESVGDYHAIATVTGAEITEKHIGRGIGTEGLACSIAGFLGACGTTSYSENIGVVALTKVGSRHVVQVGAIILIFLSLFPKFAGLLASMPAPVLGGLTLALYGMISVTGLRLIKEKVEFTDRNVLILAAALIAGLGAPQLPESLFHALPRILSSILESGMAVGAITAIILERIL

SEQ ID NO: 33371 - protein, 217 aa, Thermococcus kodakarensis KOD1
MMKMPARVVGEEKVKLKKSFIKPWMGIKYLFKKPVTIKIPYEKIEPAPKYRGFHTLDWKKCVGCNFCGQICPARAIEMTWIEVNGHIATRPHPKVDYGRCTFCQFCVDVCPTGALGFSENYYLTTGGLEEDLELYDWVPIHPDKVRELNEKFNDYRFPVERIKFNKETREVTYYLRDGSTIQFKILGYGLRPPKPPAKPAAKPAEKKEGPKAEEKKE

SEQ ID NO: 33372 - protein, 467 aa, Exiguobacterium sibiricum 255-15
MQLKREMTSRHLFMISLGGIIGTGLFLGSGLTISQAGPLGAVLSYIVGGTIMYLTMLCLGEMAVHMPVSGSFQTYTTRFIGPGIGFAVGWIYWLGWAVTVALEITAAGSLMDRWFPNTPIVIWCAIFTVILFGLNAVSAKAFGEAEFWFSSLKVLAILFFIALGGAAWFGWIDMTAARPESLFANFTSNGLFPNGALGVLTTMIAVNFAFQGTELIGVAAGESNDPEKSIPKAIRNTVWRTFIFFVLSITIVGALIPYETAGGISSPFIMVFDAIGIPYAADLMNIVVLTALLSVGNSGLYAATRMLWSMSQEGMISKKLAIVNSRGVPMRALCFTMLFAMLSLLTAFFAEDTVFIWLLSLAGLGAQVGWISISASQIAFRRQFIKNGHTVSELKFKTPFFPVLPIISFSLNMLVLISLAFQADQRIALYIGVPFFLLTWGCYHLFVKGKHIAAQTERQAASSTLES

SEQ ID NO: 33373 - protein, 431 aa, Bacillus anthracis str. Ames
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFDFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGTLVNHRITTFIAWIIAVLVIILNIFLLYQTFVG

SEQ ID NO: 33374 - protein, 169 aa, Glycine max
  misc_feature (21)..(21): Xaa can be any naturally occurring amino acid
  misc_feature (97)..(97): Xaa can be any naturally occurring amino acid
  misc_feature (121)..(121): Xaa can be any naturally occurring amino acid
LIETETVQLLINQVKDNPKLXVMTAHLVAIKHESRGLTMSPVAVATGQQQMRKLSNEYGASRFTPLKGLVVQGRIIVSFHLAMTDMAEKVPSFKHGXASWSGDLSTLDARYVFPVLTALSXVIAPECNLHEGMEGNPVDGSMKNVSRGLGVITVPFPKGYPKAICMLSG

SEQ ID NO: 33375 - protein, 191 aa, Triticum aestivum
  misc_feature (13)..(13): Xaa can be any naturally occurring amino acid
  misc_feature (65)..(65): Xaa can be any naturally occurring amino acid
  misc_feature (102)..(102): Xaa can be any naturally occurring amino acid
  misc_feature (112)..(112): Xaa can be any naturally occurring amino acid
  misc_feature (121)..(121): Xaa can be any naturally occurring amino acid
  misc_feature (127)..(127): Xaa can be any naturally occurring amino acid
  misc_feature (131)..(131): Xaa can be any naturally occurring amino acid
  misc_feature (165)..(165): Xaa can be any naturally occurring amino acid
MQKLRDLKPCAFXCGLDATLGVLLRYVKASSAYLGKSEDSIDFDFTYYRSYTQGEPRANSDVVDXELEQLALCKYDAVPHLGAKIATLPFDGASLPKYPKAXEFLKVKARYXDPDGIFSSXEWSDQXVLGXKGSSNMAEKSCGIEGICICSDDSHCAPEKGYFCXTPGKVFTDARVCSTRRTFGDDLLKEQ

SEQ ID NO: 33376 - protein, 394 aa, Thermococcus kodakarensis KOD1
MANLEVPRELREEAKAHDMYLHPIDKDTYELFFGPQHMATENFSIILKMDGNRVEKAIVNPGFLHRGFEKLAEQRPYFTNIALLLRICVPESDVPENIYSMAVDEIVGWEVPERAIWIRTVVLEMARLSAWMFWIMGFGNEIGLYTAGQWAAAYRERFMRLYEELTGGRVYHIYTVPGGVRRDIPGDKWLRQLRDTVEYLKGKLKDFDEILFDNYIMFERTEGVGVMDKKFALKHAVTGPNLRAVGVPYDVRKDDPYYLYDQLDFEVPVLKEGDSLARVLVRRYEMEQDLYILEQLLDMGPPSGPYMVQDARLKALPRFKPPAGEAYAHVESTKGDFGAFVVSDGTHKPYRVHVRGPSQSHGVTVLEELLKGARLADVPVILKTLDNCPPDIDR

SEQ ID NO: 33377 - protein, 67 aa, Glycine max
MASSVISAPAGTTVNRAGAGMVAPFTGLKSMAGCPSRRTKNDVSSIASSGGRVQCMQVWPPVGREEV

SEQ ID NO: 33378 - protein, 223 aa, Leifsonia xyli subsp. xyli str. CTCB07
MMPTNRPGRIWNELLRGNERFVAGTPRHPRQGVERRESVAQGQAPLAAIFGCADSRLAAEIIFDLGLGDAFVVRNAGQVISDSVVGSLEYAVAVLKVPLILVLGHDACGAVASAIASQAADAEPLPPHIASLIAPIVPAVHRVTNTAMDAAIDPAQVDASAVGREHLRHTVSELLACSEIISDAVAANLLAIVGANYRLQEGRVVPDVVVGLADPAADSPSAA

SEQ ID NO: 33379 - protein, 494 aa, Nicotiana tabacum
MSVFAVISFFLLLFFLFKSYLPSSKTKKNSPPSPSKLPLIGHFHKLGLQPHRSLQKLSNEHGPMMMLQFGSVPVLIASSAEAASEIMKTQDLSFANKPISTIPSKLFFGPKDVAFTPYGDYWRNARSICMLQLLNNKRVQSFRKIREEETSLLLQRIRESPNSEVDLTELFVSMTNDIVCRVALGRKYCDGEEGRKFKSLLLEFVELLGVFNIGDYMPWLAWMNRFNGLNAKVDKVAKEFDAFLEDVIEEHGGNKKSDTEAEGADFVDILLQVHKENKAGFQVEMDAIKAIIMDMFAAGTDTTSTLLEWTMNELLRNPKTLNKLRDEVRQVTQGKTEVTEDDLEKMPYLRAAVKESSRLHSPVPLLPREAIKDAKVLGYDIAAGTQVLVCPWAISRDPNLWENPEEFQPERFLDTSIDYKGLHFELIPFGAGRRGCPGITFAKFVNELALARLMFHFDFSLPKGVKHEDLDVEEAAGITVRRKFPLLAVATPCS

SEQ ID NO: 33380 - protein, 328 aa, Coccidioides immitis RS
MDEREASAMGQNAGIQIGTAQKLQEDIFAWRDGTIATVDLAGEGSFVAVKFTGAGRKAVQQLVRGERPCPDLEQAIAAICDRARDRGVRLLIDAEQQAVQPTIDEWTIEYARRYNNAPSRQALIYGTYQAYLRSTPSTLAKHSAIAQSQGFVLGVKLVRGAYLGTEPRHLIWDTKEKTDEAYDSLAKSVMRRQYGELLVKPPNGPGSFPEVNLVLASHNRASIQRALNIREEQIRRGEDQIEMSYGQLYGMADDISCELVQQRTQAQDLNGGKLEIPKPYKALIWGTVGECTKYLLRRGEENRDAALRTGDTRRAMVKELKRRLLGGN

SEQ ID NO: 33381 - protein, 77 aa, Zea mays
REGRIELPPQDDDLLLRVDFVREVDELLKEVRAVEDKNKQQIGFDPESVAYMLKQQEKMQTMRQVESLLDLASSLKW

SEQ ID NO: 33382 - protein, 517 aa, Nicotiana tabacum
METLFNIKVAVSLVIVIIFLRWVWKFLNWVWIQPKKMEKRLKMEGFKGSSYKLLFGDMKEINTMVEEAKTKPMNFTNDYVARVLPHFTKLMLQYGKNSFMWLGPKPTMFITDPELIREILSKSYIYQEIQGNPITKLLAQGLVSYEAEKWAKHRKIINPAFHLDKLKHMLPSFYLSCCDMLRKWESIASSEGSEIDVWPFLETLTSDAISRTAFGSNYEDGRQIFELQKEQAELILQAARWLYIPGWRFVPTKRNKRMKQIAKEVRSLVLGIINKRIREMKAGEAAKDDLLGILLESNFKEIQMHGNKNFGMTIDEVIEECKLFYFAGQETTSVLLVWTLILLSKHVDWQERAREEVHQVFGSNKPDYDALNQLKVVTMIFNEVLRLYPPGITISRTVHEDTKLGNLSLPAGIQLVLPAIWLHHDNEIWGDDAKEFKPERFSEGVNKATKGKFAYFPFSWGPRICVGLNFAMLEAKMALALILQHYAFELSPSYAHAPHTIITLQPQHGAPLILRKL

SEQ ID NO: 33383 - protein, 114 aa, Brassica rapa
MGCAGSTQSQAEGPVKKIRKPKPWKHTQPISKAELVKMREEFWDTAPHYGGTKEIWDALRAAAEADISLAQTIVDSAGVIVQNNDLTTCYDERGAKYDLPKYVLSEPTNLVEES

SEQ ID NO: 33384 - protein, 555 aa, Vibrio fischeri ES114
MCSIFGILDIKSDPTPLRTTALEMSKKLRHRGPDWSGIYSSDKAILAHERLAIVGLNSGAQPLYSEDKKHILAVNGEIYNHKELREKYADNYTFQTDSDCEVILALYREKGADLLEDLNGIFAFILYDEEKDEYLIGRDHIGIIPMYHGYDEHGNYYVASEMKALVPVCKSISEFPPGHFYSSKDTEPTRYYLRDWMDYDAVKDNPTSKEDLTQALEDAVKRQLMTDVPYGVLLSGGLDSSITSAVAKRFAAMRIEDDEKSEAWWPQLHSFAVGLEGAPDLKAAREVADKLGTVHHEMTYTIQEGLDAIRDVIYHIETYDVTTIRASTPMFLMGRKIKAMGIKMVLSGEGADEIFGGYLYFHKAPNKKEFHEETVRKLLALNMFDCARANKSLAAWGVEGRVPFLDKEFIDVAMRLNPQDKMCGNGKMEKHILRECFEHYLPEAIAWRQKEQFSDGVGYSWIDTLRETAEAKVTDQQMESAKFRFPYNTPTTKEAYVYREIFEELFPLEDAAKCVPGGPSVACSSAKAIEWDESFQNCVDPSGRAVQAVHNEAYD

SEQ ID NO: 33385 - protein, 516 aa, Nicotiana tabacum
MEMMYSIIAAASIAIILVYTWKVLNWAWFGPKKMEKCLRQRGLKGNPYKLLYGDLNELTKSIIEAKSKPINFSDDIAQRLIPFFLDAINKNGKNSFVWLGPYPIVLITDPEHLKEIFTKNYVYQKQTHPNPYAKLLAHGLVSLEEDKWAKHRKIISPAFHVEKLKHMLPAFYLSCSEMISKWEEVVPKETSFELDVWPDLQIMTSEVISRTAFGSSYEEGRIVFELQKEQAEYVMDIGRSIYIPGSRFLPTKRNKRMLEIEKQVQTTIRRIIDKRLKAMEEGETSKDDLLGILLESNLKEIELHGRNDLGITTSEVIEECKLFYFAGQETTSVLLVWTMILLCLHPEWQVRARKEVLQIFGNDKPDLEGLSRLKIVTMILYETLRLFPPLPAFGRRNKEEVKLGELHLPAGVLLVIPAILVHYDKEIWGEDAKEFKPERFSEGVSKATNGQVSFIPFSWGPRVCIGQNFAMMEAKMAVTMILQKFSFELSPSYTHAPFAIVTIHPQYGAPLLMRRL

SEQ ID NO: 33386 - protein, 274 aa, Triticum aestivum
  misc_feature (232)..(233): Xaa can be any naturally occurring amino acid
  misc_feature (258)..(258): Xaa can be any naturally occurring amino acid
  misc_feature (262)..(262): Xaa can be any naturally occurring amino acid
MDPKLVEVTQLFDRFKAAFKASNFDVCSTLLSQLKVLLTKFPSLPPLFQQTPNAVEELKLAREIYEQAVILSVKMEDQDAFERDFCQLKPYYMDTCGIIPPSSEEYPIMGANLLRLLVQNRIAEFHTELELLPAKALDNAYIKHGVELEQSFMEGAYNRVLSARQTAPHETYIYFMDLLVKTVRDEIAGCSEKGYDYLSINDAKQMFKFSSDKELQQYIAEEHPEWDVKDGXXLFQKAKDPNPARNSGGPVINKPWYXKELXRLCDWLALFPQL

SEQ ID NO: 33387 - protein, 146 aa, Oryza sativa (japonica cultivar-group)
MRGVGGPLLTIGDLLSDLAVDGGADLAGGEVSVPSSPSSAGQQAEEADPSELNRLFGEHYDNLMKALQENDPSWPSLMLKLCTALKTADKLVSCASIDAEQLLQKVELLERLLVRGDRAVTAIVEELQRSRPSEDSHSSKSKPSGK

SEQ ID NO: 33388 - protein, 345 aa, Zea mays
MGILCLGASSTLLCGEDRNNVLGLGCGNELVEVGSGHDGLDSVVGAVFPVDTDEAVRALLEKETDHKPQDGYAERLERGGLEYSWRRDAMDWICKVHSYYRFGPLSLYLAVNYLDRFLSSYDLPHDKPWMRQLLSVACLALAVKMEETVLPLPVDLQVCDVKFEFEARTIGRMELLVLATLKWRMQAVTPFTFISYFLDKFNGGKPPSMALASRCTEIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNIRSSSSNDNQVSKRRRLSISPI

SEQ ID NO: 33389 - protein, 453 aa, Salmonella enterica subsp. enterica serovar Paratyphi A str.
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGRGRGQNQGGAGRSQQPRRQDSGAAKAKPKPRTGEGKPAGDKARPPRRPRRITPAQ

SEQ ID NO: 33390 - protein, 275 aa, Ralstonia solanacearum GMI1000
MKNCFDFRGKTALITGASSGIGREFAYALAKRGAKLLLVARSRDKLHDLTAELRRDYACDADFLTVDLSAPDAIPTVAHLLKATGTVVDVLINNAGFATYGRFETIPWTRQRDEVLVNCMAAIELTHLLLPGMQARSDGAVINVASTAAFQPDPYMAIYGATKAFLLSFSEAVWAENRHRGIRVLALCPGATQTGFFDVVGAKEAAVGTPMPVASVVQDALWALDRNRSYRIVGTQNRLLANLQRLLSREMSARLVEKILRPRGAQELETGDTSA

SEQ ID NO: 33391 - protein, 552 aa, Coprinopsis cinerea okayama7#130
MSGKLASSYASWAELQKIYDHQHSKLVLKDLFAQDPERFKKFSKEYTSSTNPETTILLDYSKNLITEPILAKLLDLAREAGVEEWRDKMFAGEHINNSEGRAVLHVALRAFGEINTTEEGVSQVGSVLAHIKEFTEAVRSGQWKGYTGKSIDTIVNIGIGGSDLGPVMVTEALKPYSKRDLKAKFVSNVDGTHIAEVLRECNPETTLFIIASKTFTTQETITNAETARSWFLDTAKDKAHVAKHFVALSTNTKAVTAFGISEQNMFQFWDWVGGRYSLWSAIGLSIALVIGYENFEALLKGAHGMDMHFREAPLERNLPVLLAVIGIWYNDFYGSQTHALLPYDQYLNKFADYFQQGDMESNGKSVTKNGERVNYQTGPIIWGASGTNGQHSFYQLVHQGTKLIPADFIAPATTHNPINHSKHHRILLSNFFAQPEALAFGKTEEEVRAELGSGAAEEVVKSKVFEGNRPTNSIMFPLLTPEVLGALIALYEHKIFTQGVIWGINSFDQMGVELGKVLAKKILAQLEKPEDVQGHDSSTTGLIHYYQKWRKE

SEQ ID NO: 33392 - protein, 257 aa, Oryza sativa (japonica cultivar-group)
MLVFWDLTRPKSAGHNCHPIPLWEREFCIYVGGISWHRFCDNKRYVCMYKNIEQWDDSEAFDNFKNAKARFWANYHGQPSDISLPDPDMYIDKVDHNSKIDPELIADLNMVRLPFEMDDELLPADGLGSTDTDNKCQQRQNQSRNWDIYVEKPTEVNKWEQDSRSNMDWGTKHESWNEWSKNCSGWGSALADSSWGNWNNSNNHHSSNNRASFNGINRNRYQDPSSISGRKRNSGGYIQQRNSRQRNQIEGYQGSRW

SEQ ID NO: 33393 - protein, 400 aa, Bordetella bronchiseptica RB50
MSTSQKKPTVQQKKPAAQPAEKAAFKPKKSVALSGVVAGNTALCTVGRTGNDLHYRGYDILDFAGSAEFEEIAHLLVHGKLPNKAELKAYKEKLRALRGLPAQLQNVLECLPASSHPMDVMRTAVSVLGCVLPEKDDHNTPGARDIADRLMANLGSALLYWYHYSHNGRVIDVQTDDDSIGGHFLHLLHGAKPSDEWVRAMHTSLILYAEHEFNASTFTGRVIAGTGSDMYSSITGAIGALRGPKHGGANEVAFEVQKRYETPDEAEADIRQRVENKEVIIGFGHPVYTVSDPRNKVIKDVAKKLSRKAGSTKMFDIAERLETVMWDIKKMFPNLDWFSAVSYHMMGVPTAMFTPLFVIARTAGWSAHIIEQRIDNKIIRPTANYVGPEDQTYVPISKRA

SEQ ID NO: 33394 - protein, 639 aa, Oryza sativa (japonica cultivar-group)
MTTPKPSPTIRRLDVASPVPADIDIANAVSPLPIADIAAELGLRPEHFDLYGKYKAKVLLSVLDELKGQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHEASQSDKALFNRLCPPNKEGKRRFADVMLRRLIKLGISKTDPNELTPDEVRRFARLDIDPESITWRRVMDVNDRFLRKITIGQGPDEKGMVRETGFDIAVASEIMAVLALTTSLADMRERLGRMVIGNSKAGEPITADDLGVGGALTVLMKDAIHPTLMQTLEGTPVLVHAGPFANIAHGNSSIVADKIALKLVGKGGYVVTEAGFGSDIGTEKFMDIKCRYSGLMPQCAIIVATIRALKMHGGGPDVVAGKPLDHAYVSENVALVEAGCVNLAKHIANTKSYGVNVVVAINKFASDTEAEMDVVRNASLAAGAFDAVVCTHHAHGGKGAVDLGLAVQRACESQADPLKFLYPLESGIKEKIESIAKFYGASGVEYSEQAEKQIEMYTKQGFSNLPICMAKTQYSFSHVPSMKGAPSGFVLPIRDVRASIGAGFIYPLVGTMSTMPGLPTRPCFYEIDVDTATGKVMGLS

SEQ ID NO: 33395 - protein, 727 aa, Pseudomonas syringae pv. phaseolicola 1448A
MNTKSTPTAEDNSAPQDNPGSTPSRIREGLPFPLGASWDGLGVNFALFSANATKVELCLFDSTGEIELERIELPEYTDETYHGYLPDAHPGLIYGYRVYGPYDPKNGHRFNHNKLLIDPYAKQLVGELKWSEALFGYTIGHPDGDLSFDERDSAPFVPKSKVIDEAYTWGRDQRVGTPWDKTIFYETHVRGITMRHPEVAEELRGTFAGLGSAPVVDHIRKLGVTSVELLPIHAFVNDQHLLQKGMTNYWGYNSIAFFAPDPRYLASGKIAEFKEMVAHLHHAGLEVILDVVYNHTAEGNELGPTLSMRGIDNASYYRLMPDDKRYYINDSGTGNTLDLSHPCVLQMVTDSLRYWASEMHVDGFRFDLATILGRYHDGFDERHSFLVACRQDPVLRQVKLVAEPWDCGPGGYQVGGFPPGWMEWNDKFRDTVRAFWKGDEGQLADFAARMTASGNMFNQRGRRPQASVNFITAHDGFTLHDLVSYNDKHNEANDENNQDGSNNNLSWNHGVEGPTEDAEINTLRLRQMRNFFATLLLAQGTPMIVAGDEFARTQHGNNNAYCQDSEIGWINWDLDEDGAALLKFVTRVIKLRQTYPILRRSRFLVGDYNEEIGVKDVTWLAPDGNEMSVEQWHDANGRCLGMLMDGRAQETGIRRPGADATLLLVVNAHHDGVNFTLPEVPEGTHYECLIDTNQDDARSKEHFAFGSQYTVTPRSLLLFELKREDQQ

SEQ ID NO: 33396 - protein, 557 aa, Methylococcus capsulatus str. Bath
MSDIEIAQRAKMLPIIDLAREKLGIPAASLDPYGHYKAKVALDYIDGLKDRPDGKLILVTAISPTPAGEGKTTTTVGLGDALNRIGKKTVMCLREPSLGPCFGVKGGAAGGGHAQVVPMEDINLHFTGDFHAVGVAHNLLSALIDNHINHGNALDIDPRRIQWKRVVDMNDRALRKIVVGMGGTANGYLREDGFDIVVASEVMAILCLATSMADLKERLGRIIVGYKSDGKTPVYARDLKAHGAMAALLKDAIKPNLVQTLENNLAIIHGGPFANIAHGCNTVTATQTALKLADYVVTEAGFGADLGAEKFIDIKCRMAGLNPAAVVLVATVRALKFHGGVKKEDLNQENLAALEAGFANLERHVHNIREHYGLPCVVSINHFSFDTEAEIAWLMKKCEALGVKAVLARHWAEGGKGAEALARTVADIVDHQPGRHTFVYGDEATLWNKIETIATKIYGAAGISADAKVKAQLEAWNADYGHYPVCMAKTQMSFSTDPNAKGAPSGHTVAIREVRLANGAGFVVAIAGDMMTMPGLPKVPAAEHIDVDDDGRISGLF

SEQ ID NO: 33397 - protein, 139 aa, Pseudomonas syringae pv. phaseolicola 1448A
MLFCEKALRKCTLSAFIERAKNGSLVMSKELQITDLHPGEGKEAVKGALITTHYTGTLEDGTVFDSSHQRGKPFQCVIGTGRVIKGWDQGLMGMKVGGKRKLFVPAHLAYGDRTMGAHIKPGADLTFEIELLEVLTRDD

SEQ ID NO: 33398 - protein, 268 aa, Corynebacterium glutamicum ATCC 13032
MVNYVDRETTLCISLAARPSNHGVRFHNWLYAELGLNYLYKAVAPADITAAVAGIRGLNIRGAGVSMPYKSDVIPLIDELHPSAERIRSVNTIVNNDGHLVGYNTDYTAVYHLLEEHRVNPNARVAIKGSGGMANAVVAALAEYGLSGTVVARNHTTGSALASRYGWEYSATVPEDAKILVNVTPMGMNGPDQDVVSFGEDEVDRADVIFDCVAFPVETPLIKLAKEKGKQTIDGGEVAALQAAEQFHLYTGVLPTNDQIIAAEEFSK

SEQ ID NO: 33399 - protein, 666 aa, Chlamydia trachomatis D/UW-3/CX
MAGNSDLDIDILEKIAGTIKQLSIESIQKASSGHPGMPLGCAELAAYLYGYVLRYNSKDSRWVNRDRFVLSAGHGSALLYSCLHLAGFDVNLEDLQQFRQLQSRTPGHPEFRETDGVEATTGPLGQGVGNAVGMALSLKMLGARFNQPANSIFDAKVYCLAGDGCFMEGVSHEACSFAGSLGLDNLVLIYDHNEIILDGTLHDVSIEDTKQRFLAYGWDVFETDGHDFESLHQVFTQIKKSQCKPTLIIAHTIIGHGSPKEGTNKAHGSPLGEDGVAQTKSFWHLPEEKFFVPSAVKMFFAAKQQEGKKLQEEWQERFRVWSKQAPEQHQEYLRLIQEISIQELEEILNLIDMPESIAGRAASNKVIQVLAEDIPSLVGGSADLSSSDGTWIAKEGTISASDFLGRNIRYGVREFGMGTIMNGLAYSQVFRPFGGTFLVFSDYLRSAIRLAALSKLPVIYQFTHDSIFVGEDGPTHQPIEQIMSLRAIPGLRVIRPADANEVKGAWLAALESAGPTALILSRQNLPTLKETKRSFREGVRKGAYILVKEEGDRPDYTLCASGSEVHLAIEVAQSLMALDNRVRVISFPCWELFERQDVEYRESVIGGDLGLRVSIEAGTALGWYKYIGSNGLAIAMDGFGMSGAPNEVAETCGFTVDNIVQRILSV

SEQ ID NO: 33400 - protein, 488 aa, Triticum aestivum
SAPGTACADTLEFVDVSANLLIGARPACMRSNSSARTVLDAGNCFRDAKLQRPSTYCSPGALAALLPPPQGSGAEQGGGKGGGVGMVLGIVGGVVAGALLIALVMVVVLRRARRQHPGVMALPKSPLIRAAKKGDSAKATAKMSQKIATPADKRHASQAAMVNTLEVPAYRVYTTEELQEATDNFASSNLIKKSALAQHYNGQLQDGTRVLVKCLRLKPKYSPQSLSHYMEIISKFRHRHLVSIIGHCIVNDQENPTIASSVYLISECVTNGSLRSHLTEWRKREMLKWPQRVTAAIGIARGIQFLHNAIAPDIVQNDLNIENILLDKTLTSKISGFSLPMISTSKNGKLFSENPFAVQEENDHYSAQSAEQGDKDDIYQFGQILLEVITGKPTASQSELEPLRAQLSEALAEDPDMLKDMADPTIRGTFAVDSLSKVTEVALNCTAGDPSDRPSVDDVLWNLQYSMQVQDGWASSESLSLSVKSQAW

SEQ ID NO: 33401 - protein, 158 aa, Glycine max
  misc_feature (98)..(98): Xaa can be any naturally occurring amino acid
  misc_feature (100)..(100): Xaa can be any naturally occurring amino acid
  misc_feature (115)..(115): Xaa can be any naturally occurring amino acid
  misc_feature (130)..(130): Xaa can be any naturally occurring amino acid
MDSSLISFPAVTTVNRAGAGMVAPFTGLKYMAGFPTIKTNNDITSIASNGGRVQCMHVWPPLGKKKLETLYYLADLDDAQLLEEVEYLLRKGWIPCLXIXLEHGFLYREHNRLPXYYDGRYCTMCKLPMXCCTDASQVSEELQEATTAYSSCFMRIIA

SEQ ID NO: 33402 - protein, 120 aa, Thalassiosira weissflogii
MLNLDNQKAIDNLHKNFIKPNLPKIQIGDTVKLGVKIIEGNKERVQFYEGTVIAKKNSSINTTITVRKVLQGIGIERIFLIHSPKIASIEVLRHSKVRRSKLYYLRNLRGKASRLKQRFE

SEQ ID NO: 33403 - protein, 631 aa, Oceanospirillum sp. MED92
MMVDNTEQNNQMLSQTATVDKDSVQPFPKSRKVYVEGSRPDIQVPMREITLDDTPTGFGGEKNDPLYVYDTSGLYTDPEADIDVRKGLPGLRENWILEREDTEQLDGLTSEYGRVREADLRLDHLRFDLQRKPRRAKAGQNVTQLHYARQGIITPEMEYIAIRENMKLAKAKAEGNVVAQQHPGHSFGAQLPEEITPEFVRKEVAEGRAIIPANINHPELEPMIIGRNFLVKINGNIGNSAVTSSIEEEVEKMTWGTRWGADTIMDLSTGKNIHETREWILRNSPVPIGTVPIYQALEKVNGVAEDLNWEVFRDTLIEQAEQGVDYFTIHAGVLLRYVPMTAKRMTGIVSRGGSIMAKWCLAHHKENFLYTHFRDICEICRDYDVSFSLGDGLRPGSVYDANDEAQFAELETLGELTKVAWEYDVQVMIEGPGHVPMHMIKENMDKQLKECHEAPFYTLGPLTTDIAPGYDHITSGIGAAMIGWYGCAMLCYVTPKEHLGLPNKDDVKEGIITYKIAAHAADLAKGHPGAQIRDNAMSKARFEFRWEDQFNIGLDPDTARAYHDETLPKESAKVAHFCSMCGPKFCSMKISQEVRELDEAEVAAINAQAEQGMQEKSAEFKETGAEIYHKV

SEQ ID NO: 33404 - protein, 513 aa, Nicotiana tabacum
MTVTASCAAIVITLLVCIWRVLNWIWFRPKKLELLLRKQGLEGNSYKVLYGDMKEFSGMIKEAYSKPMSLSDDVAPRLMPFFLETIKKYGKRSFIWFGPRPLVLIMDPELIKEVLSKIHLYQKPGGNPLATLLVQGIATYEEDKWAKHRKIINPAFHLEKLKLMLPAFRLSCSEMLSKWEDIVSADSSHEIDVWSHLEQLTCDVISRTAFGSSYEEGRKIFELQKEQAQYLVEVFRSVYIPGRRFLPTKRNRRMKEIKKDVRASIKGIIDKRLKAMKAGDTNNEDLLGILLESNIKEIEQHGNKDFGMSIEEVIEECKLFYFAGQETTSVLLLWSLVLLSRYQDWQARAREEILQVFGSRKPDFDGLNHLKIVTMILYESLRLYPSLITLTRRCNEDIVLGELSLPAGVLVSLPLILLHHDEEIWGEDAKEFKPERFREGISSATKGQLTYFPFSWGPRICIGQNFAMLEAKMALSMILQRFSFELSPSYAHAPRSIITVQPQYGAPLIFHKL

SEQ ID NO: 33405 - protein, 300 aa, Arabidopsis thaliana
MSSSEAFPVMQEIMLEFRAGKMSLQGTRVVPDARKGLVRIARGDEGLIHFQWLDRNQNTVEDDQIVFPDEALFEKVNQSSDRVYILKFNSDDRKLFFWMQEPRAEGDAELCSSVNQYLNQPLEFPGEEGLAAAITEELEDMAEDNTSSRAGNLVVPNLSSEVSDVTSSSGPVKLADLQRILNNLSGGPVGIAGDQDEGLALGDILKPELIMPLLEALPVQERLSSHLPEGHSRAEDILELLQSPPFRQQVDAFTYVLRTGQIDLIQFGIDPSKYKFTVDSFLEALEDSVSTQSRDAMDES

SEQ ID NO: 33406 - protein, 548 aa, Populus trichocarpa x Populus deltoides
MEANKDQVQEFIFRSKLPDIYIPNHLPLHTYCFEKLSQFKDNPCLINGPTGDIYTYADVELTSRKVASGLYKLGLQQGDVILLLLQNSPEFVFAFLGASFIGAISSTANPFYTSAEIAKQATASKAKLIITHAAYAEKVQQFAQENDHVKIMTIDSLTENCLHFSELTSSDENEIPTVKIKPDDIMALPYSSGTTGLPKGVMLTHKGLVTSVAQQVDGENPNLYFHERDVILCVLPLFHIYSLNSVFLCGLRAGSAILVMQKFDTVSLMDLVQKYKVTIAPLVPPICLAIAKSPVVDQYDLSSIRTVLSGAAPLGKELEDTVRAKLPNAKLGQGYGMTEAGPVIAMCLAFAKEPFEIKSGACGTVVRNAEMKIVDPETGESQPRNKTGEICIRGCQIMKGYLNDPEATERTIDKDGWLHTGDIGYIDEDELFIVDRLKELIKYKGFQVAPAELEAMLIAHPNISDAAVVPMKDEAAGEVPVAFVVRSNGSKITEDEIKQYISKQVIFYKRIGRVFFTEAIPKAPSGKILRKDLRARVSAGDLPCTSDS

SEQ ID NO: 33407 - protein, 417 aa, Oryza sativa (japonica cultivar-group)
MEISSSLNKRKLGEAQHDGDRVVIKKRQSVSMDMEVLHCPVCFQILRPPVFQCDLGHLVCSPCRDNLPAGGKCPSPSCFGTPSVRCVAMERVVNSVEVACAYAEHGCPDKIAYANITEHEKTCPHAPCFCPEPGCGFAAASAAALADHFTAPRHNWPSHKLSYSQPFELRVHPGKNVLVGEEDGALFLLNVSPAAEHAVVSLFSVQPHHGASGFGRSASHFGCSVEFSCFLGHLQCSTLVTVTSSSLSDGMPEECFFSVPELQDSVDGDAGVGVDIRITIDEAVPLFSCVDGMEDDDDEDCDDDVDANNGDDDENDGDTSDDEDEDDEDGTKLNFLVLSGTAWNPASDAQWNSFCFEGHCEASTLEAVKISSLSDGLPKDRFFSVPKQQDGDAGVVLGITIDDVEDVEDEDSDEECE

SEQ ID NO: 33408 - protein, 429 aa, Vibrio fischeri ES114
MADKKATLHIEGQSPIDMPIMDGTIGPEVIDVRKLGANGYFTFDPGFLATASCESQITYIDGDKGVLLHRGFPIDQLANNADYLEVCYILLNGEAPNREEYETFKDIVTRHTMVHEQISSFFHGFRRDAHPMAVMCGVVGALAAFYHDSLDINNDEHREIAAFRLLSKMPTLSAMSYKYSIGQPFIYPRNDLTYAENFLHMMFANPCEEYEVNPVVARAMDKIFTLHADHEQNASTSTVRLAGSSGANPFACIAAGIASLWGPAHGGANEACLRMLEEIGSVDNIDEYVAKAKDKDDPFRLMGFGHRVYKNYDPRATVMREACHDVLKELNIKDPLLDVAMELERIALSDEYFVSKKLYPNVDFYSGIILKAIGIPVSMFTVIFAMSRTVGWIAHWSEMHSDPTNRIGRPRQLYTGEELREFKPLHERE

SEQ ID NO: 33409 - protein, 557 aa, Populus trichocarpa x Populus deltoides
MEAKNDQAQEFIFRSKLPDIHIPNHLPLHTYCFENLSRFKDNPCLINGPTGEIHTYAEVELTSRKVASGLNKLGIKQGDVILLLLQNSPEFVFAFLGASIIGAISTTANPFYTPAEVAKQATASKAKLIITQAVYAEKVQEFVKENVHVKIVTVDSPPENYLHFSELTNSDEDDIPAVEINPDDVVALPYSSGTTGLPKGVMLTHKGLVTSVAQQVDGENPNLYFHEKDVILCVLPLFHIYSLNSVLLCGLRVGSAILLMQKFEIVTLMELVQKYKVTIAPFVPPVVLAVAKCPVVDKYDLSSIRTVMSGAAPMGKELEDTVRAKLPNAKLGQGYGMTEAGPVLSMCLAFAKEPFEIKSGACGTVVRNAEMKIVDPDTGRSLPRNQSGEICIRGSQIMKGYLNDPEATERTVDNDGWLHTGDIGYIDGDDELFIVDRLKELIKYKGFQVAPAELEAMLIAHPDISDCAVVPMKDEAAGEVPIAFVVRANGSKITEDEIKQYISKQVVFYKRISRVFFTEAIPKAPSGKILRKDLRARLATGDFLIKFQHDTYMQKQQ

SEQ ID NO: 33410 - protein, 286 aa, Geobacter sulfurreducens PCA
MPFTGATRVLGIIGQPVSHSLSPLMQNAALQAMGLDYAYVPFAVEEDCLADAVRGLAALGVVGFNVTIPHKSAILPLLDRLSPEAELIGAANVVKREGSDLVGYNTDGTGFIQSLSEDLGFTPAGCRILVMGAGGAARAAVASLAGAGAASVVIANRSIARGEELSAAFRRHFIGTQFAAIPLDPENLNRCVQNFDLLVNTSSVGMGGTAFPGMDLSRMGPHGAVYDMVYVPAVTPLLAEAERCGIRYANGIGMLAAQGECALELWTGVRPPEGLMKACLMAALMS

SEQ ID NO: 33411 - protein, 426 aa, Pseudoalteromonas tunicata D2
MTISQDLFERALASIPGGVNSPVRAFNGVGGTPLFITKAQGAYTFDADGNKYIDYVGSWGPMIMGHNHPAIKNAVLAAVENGLSYGAPTETEILMAEKVKALVPSIEKVRMVSSGTEATMSAIRLARGFTGRDKILKFEGCYHGHADSLLVKAGSGALTMGVPNSPGIPADFAKHTLTVSFNNLDEVKAIFEKYADEIACIIVEPVAGNMNCIPPVAGFLEGLRAVCDQYKSVLIFDEVMTGFRVALGGAQQYYNIVPDLTCLGKVIGGGMPVGAFGGKKEIMDFIAPVGPVYQAGTLSGNPIAMAAGLAALELISAPGLHADLEAKSKRLCEGFEQAAAEAGIALTTNYAGGMYGFFFTDAAKVTSYQQATQCDVERFKRFFHLMLEEGVYLAPSAFEAGFICSEHGDAEIEQTIAAAKRAFAKL

SEQ ID NO: 33412 - protein, 260 aa, Bacillus cereus ATCC 10987
MLKSYRTALVSLSLLLVFVLSGCSNAAPIDAHSTGIWDHYFVYPISFMIQFVAHHIPGASFGIAIIIMTLVIRSAMIPLAVSQYRSQAKMKKMQPELQKLKKKYGDVSKDLEKQKQYQKEMSELMKSGGWNPLAGCWPIFIQMPIFSALYYAISRTEEIRTSSFLWVNLGHADPYHILPIIAALTTFIQMKVFQSNITAGEQVQMLKMQQIMMPAMILFMGFAAPSGLVLYWITGNLFTMTQTIVLRRIMEREELQLQKA

SEQ ID NO: 33413 - protein, 602 aa, Ustilago maydis 521
MPYAPPRSSRAPTSIPFELSLSTHPNAPHHRSSLTPVAFLLRAALIAPRKLAIAHPERGYSFTYEQWAARCLSLAFGLLSVPGFKTGDRVAVISPNAPLIADAHWSIPAAGGIITPINIRNTPKEVAYVLEHSGSTIILCDHEFTHLVPENPGNRVTVIISRDSGGQDASDDYERFLDRGWQEWQRAEQAELEKYRARSKRGAEPKTGWKLLCAPHDEEQPIALCYTSGTTGRPKGVLTNHRGAYLAAVANAFEANITQESVYLWVLPMFHACGWTYPWAVTASLATHHTIRKVDNAVIWHALVNHNISHYCGAPTVQIGLVNHPAARKLERRVNVAVAASAPTANLLAKMESLNLHPVHVYGLTETYGPFTRRYFEPEWAKLDVDSRARMMARQGHSYLTSDEVRVVRTESSTDSSSDDLIDVQRNGQETGEIVIRGNMVMIGYYNDTAATNKAIIKGWFHTGDLAVRHPGGEIQILDRGKDIIISGGENISSLMVEQELAAHTDVLECCVIARPHEKWGERGQAFVVLTEQAKAKRNIDEIKKHGSHENRAFIQSLKKHCKDRMSGFAVPEWFDIVDELPKTSTGKVQKNVLRARFASKL

SEQ ID NO: 33414 - protein, 279 aa, Clostridium perfringens ATCC 13124
MNNVLMAFLLTLLAGLATGIGSCIAFFAKKTNKKFLCVSLGFSAGVMIYVSMIEMFQTAKESLVGVMGIKAGNWITVISFFAGIAIIALIDKFVPEEENPHEVRSVEEVENEIEEYNGENKEGKVDIKDKTLMRTGIVTALAIAIHNFPEGLATFVSALEGASLAIPITIAIAIHNIPEGISVSVPIFYATGDKKKAFLYSFLSGMSEPIGAIIGYTLLRNIFNDITLGILLSAVAGIMVFISLDELLPTARKYGEHHLAIYGLIAGMVVMAVSLLLFI

SEQ ID NO: 33415 - protein, 313 aa, Leifsonia xyli subsp. xyli str. CTCB07
MSVTVLGSANLDLVYRVERIPSPGETVLAAGAVPVGKGNNQVTAVARSGADATFIAALGKDAAAERLIASLTESGVALCLRRVDEPTGTAVIKVDEGAENAIVVDAGANGELLRLTSGEREAIAAADALLMQLETPVETVTEAALAARAAGTAVVLNAAPIPPVPAELMQAVDLLIVNEHEAARLAAAVADAPDPADEEAVATVLSGLGLAVIVTLGARGALVCVPGEPVEPVPGLRVDAVDTTGAGDTFCGALLAELDRSGAFVDAGGDLRRSALVAAAAFATAAAALSVQCPGAVLSIPTLEEIHDFRSSR

SEQ ID NO: 33416 - protein, 573 aa, Trichoderma atroviride
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 33417 - protein, 413 aa, Arabidopsis thaliana
MLQIPLLYSHHQFLPKVNLSLETNFSYISKMPETEYSFGRSFLSLRRDQAHLMDPTSFSEPMTMEVELDSFQRQVAEKFIDLNASADEAEILSLEWIGKLLDSFLCCQEDFRVIIFNHKPQLLKQPMDRLIEEYFERSVKALDVCNAIRDGIEQIRQWQKLIEIVISALDTNQRQLGEGEIHRAKKALIDLAIGMLDEKDSSNTHRNRSFTRNKDHNQHIGYIRSLSWSVSRSWSASRQLQGIGNNLATPRASDVMATNGLALTVYTMTSILLFVTWVLVAAIPCQDRGLHVHFYFPRHFQWAVPVMSLHDKIMDESKKRDKKKKGCGLLREINQIERNSRMLSDLIDSDNFSLTDEKCTLEVKERVQELMNVCEAIKEGLDPFDRKVRDVFHQIVRTRTEALDSLGKLQNQE

SEQ ID NO: 33418 - protein, 335 aa, Oceanospirillum sp. MED92
MYEIPGFTDEHHIPSAIAVLTSGGDSPGMNPAIRGVVRAALHRGIKVFGINKGYSGLIIGDLEEMNSASVTNIVQRGGTILKSDRCEAFKDPAVRHQAAEVLKEKGIDTLVVIGGDGSLTGAHYLTLENDIRVIGLPGTIDNDIYGTDDTIGFDTAVNTALEAIDKIRDTALSHESLFLVEVMGRNSGFIATHVGIACGAEMIVIPEYEVKVDAISSQLASNREQGKGSSGIIVVAEGPKPGLTYDLAKQLKNHGQQPKVCILGHIQRGGIPSGHDRILASCLGASAVDYLCAGYNDIMIGVRRGKIVDTPLAQVIEKSKELDEALFQRALLLHK

SEQ ID NO: 33419 - protein, 162 aa, Brassica napus
  misc_feature (121)..(121): Xaa can be any naturally occurring amino acid
  misc_feature (150)..(150): Xaa can be any naturally occurring amino acid
MDSSHCFATGKSSSVLPKLTFKNVDNNKFWGEKIKSNGFFKRFASDLNSNKFGNRKFKHSSVVYAVATSKNPNEAMIVKPSVFEKRKADPKNVAAIILGGGNGAQLFPLTNRAATPAVPAXGCYRLIDIPMSNCINSCINKIFVLTHFNXSASLNRHSTTYL

SEQ ID NO: 33420 - protein, 114 aa, Lactococcus lactis subsp. lactis
MNLIESINAAQLRTDIPDFRPGDTVRVHAKVVEGTRERIQMFEGVVIARKNSGINETYTVRKISNGVGVERIFPVHTPRVEQIEVIRHGKVRRAKLYYLRALTGKKARIAERRR

SEQ ID NO: 33421 - protein, 176 aa, Triticum aestivum
  misc_feature (127)..(127): Xaa can be any naturally occurring amino acid
MAPTVMASSDTSVAPFQGLKSTAGLPVSRRSNGASLGSVRNGGRIRCMQVWPIEGVKKWDTLSYLPPLSTEALLKQVDYLIRSKWVPCLEFSKVGFIFREHNASPGYYDGRYWTMWKLPMFGCTDAXTQVINEVEEVKKEYPEAYVRIIGFDNMRQVQCVSFIAFKPPGCEESGKA

SEQ ID NO: 33422 - protein, 1070 aa, Exiguobacterium sibiricum 255-15
MPKRQDIQKILVIGSGPIVIGQAAEFDYAGTQACQALKEEGYEVVLVNSNPATIMTDPTVADRVYIEPLQAEFVARIIRKERPDALLATLGGQTGLNLAVELDRLGVLAEYGVELLGTKLTAIEEAEDRDLFRKLMFKLGHGVPESEIVHTVEEAEQFCAKIGLPIIIRPAYTLGGTGGGIAETMDEFIRIVEGGLKASPATQVLLEKSIAGMKEVEFEVMRDATNQAIIVCAMENFDPVGVHTGDSIVFAPTQTLSDRDYQMMRNVSLDIIRVLGIEGGCNIQFALDPVSFTYYVIEVNPRVSRSSALASKATGYPIAKLAAKIAVGYALSELKNPITETSFASFEPALDYVVAKIPRWPFDKFESADRTLGTQMKATGEVMAMGRTMEEALLKAVRSLEIGQADLHMNRFAEMNEADLHRHIIKATDERLFALYAGIERGHTVEQLHEWTSIDRLFLEKLHHIHRIEQDIVKHGLTPERLRHAKRYGFSDQMLARITQQTETAIRQIRNESGLHPVYKMVDTCAAEFASDTPYYYGTYEVENEAVPTTRPSILVLGSGPIRIGQGVEFDYATVHSIQAIREAGYEAIIVNNNPETVSTDFSISDRLYFEPLTTEDVLEVIRNEQPIGVIVQFGGQTAINLAESLEAEGVKILGTSLEDLDRAEDRKQFEAALTQLDIPQPPGKTAVTVTEATAAASELGYPVLVRPSYVLGGRAMEIVYGEQELEHYMKHAVIASPERPVLVDRYLTGMELEVDAICDGTDVVIPGIMEHIERAGIHSGDSIGVYPPQRVPQAIKELIVDYTTRIAKAFRIKGLLNIQFVFADGELYVLEVNPRASRTVPFISKVTGLPVARLATNVILGDTLASYGLTSGVLPEEKLVSVKVPVFSFAKLKEVDPSLGPEMKSTGEVIGTDRTLEKALYKGLIASGMAIPEHGRVLLTVADQDKQEMLDLAKRFTALGFTLLATAGTASVLEEHGLRVQVVGKLGSEQGSMLEWIEKAEVEYVINTMSRDSQVTKDGFIIRRAAAENNVVCLTSLDTAEALLRVIESLSFEASAIQPFDYMKKAVAR

SEQ ID NO: 33423 - protein, 453 aa, Oryza sativa (japonica cultivar-group)
MASYDKAIESYKRAVTTAASLAASAMLVRGVVNELVPYEVRDLLFSGVGYLRSRMSSQHMVIIEETEGWTNNQLYDAVRTYLATRINTDMQRLRVSRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 33424 - protein, 138 aa, Lilium hybrid cv. 'Star Gazer'
MASKALLMLGVLIVAALFVTSDAGRELAEETKENTEKRATEAGVADQKYGGGYNNGGGYPGGGGGYHNGGGYPGGGGGYPGGGGGYPGGGGGYHNGGGGGRCYNGCCRRGYYGGCRCCAHPDEIPDPEYRAEPAYGHP

SEQ ID NO: 33425 - protein, 400 aa, Aspergillus nidulans FGSC A4
MGSIGNTLAELDASVVKITRSTELRHVPLPGSLEELSHSYCTDHMVTARWTAAGGWETPEVKPFQNLSIPPTASCLHYATECFEGMKVYRGFDGKLRLFRPDLNGERLSNSAVRASLPSFRFQELKTLIAKLMQIDGLRWLPKDQPGRFLYLRPTLIGSGTQLGVQAPAEALLFIIAVPWPDPATRLKATPGEALGLKLLTSAPDTIRAWPGGFGYAKLGANYGPSLAAHGKAQAQGFDQVLWLFGEDRQVTEAGASNFFIVWENAQTGKRELVTAPLENQLILPGVTRRSVLELARSRLNQAVGDLEAVEVVEKTFTIWDVEAAWKEGRVVEAFVCGTAFFITPVKLIRNGAVDIQLLKPGQTAGYAAQIKSWLEAVMYGKDGAENHEWSYIIENESEK

SEQ ID NO: 33426 - protein, 487 aa, Triticum aestivum
TNQSGMAGGDEGSLVPRQVPGSYGMPFVSAIRDRLDFYYFQGQDKYFESRVEKYGSTVVRINVPPGPFMARDPRVVAVLDAKSFPVLFDVDKVEKKNLFTGTYMPSTSLTGGFRVCSYLDPSEPIHTKVKQLLFSLLASRKDAFIPAFRSHFSSLLATVESQIVLGGKSNFNTLNDATSFEFIGDAYFGVLPSASDLGTTGPTKAAKWLIFQLHPLVTLGLPMILEEPLLHTVHLPPILVSGDYKALYKYFFAAATKALDTAEGLGLKRDEACHNLLFATVFNSYGGLKVLLPGILARIAGAGEKFHQKLVAEIRAAVADAGGKVTIEALEKMELTKSAVWEALRLDPPVKFQYGRAKADMNIESHDAVFAVKKGEMLFGYQPCATRDPRVFGSTAREFVGDRFVGEEGRKLLQYVYWSNGRETESPSVDNKQCPGKNLVVLVGRLLVVELFLRYDTFTADVGVDLLGTKVEFTGVTKATSGPESAV

SEQ ID NO: 33427 - protein, 373 aa, Oryza sativa (japonica cultivar-group)
MEGRPGRRRRRRVKAPTRAAGMDWISGLPDEILHHIMSFLNARQAVQTCVLSRRWSDLWRTVPCINADFNEFDFIDYQGDDEDYNDEVAFKRFVNRMLELRDPATMMDKFWLKYKISDGYNEYKDSNVDANRWISHALQKQARVMEVVVFSFPLELDHSVFTSCYLRKIGFSCVSLHQGFFKQLDAGCPELEELFLHDCTIADEEIFSQSLKVLTIDDTEFSKANKAYISIPSVTSLTLSSPENSTPMLKDMALLTTTSVSVKFYTFSYGFDANDLRQCLWSLSGVTNLELNYEGTELTFENNLQWCPEFINVVNLTLGQWCLDANFYALIVFLQNSARLEKLTLNLAKFHIKHWGQYEEEDELPAFVRYEER

SEQ ID NO: 33428 - protein, 586 aa, Triticum aestivum
  misc_feature (358)..(358): Xaa can be any naturally occurring amino acid
  misc_feature (427)..(427): Xaa can be any naturally occurring amino acid
  misc_feature (446)..(446): Xaa can be any naturally occurring amino acid
MLRKCYSTEPNPFPFHFANHPRRDPDPDRSIIRLRHLNPPSVPRRPPLIPAAMGSVDLVLKPACEGCGSTSDLYGTGCKHTTLCSSCGKSMALSRARCLVCSAPITNLIREYNVRANASTDKAFSIGRFVTGLPPFSKKKNAENKWSLHKEGLQGRQLTDKMLEKYNRKPWILEDETGQYQFQGHMEGSQSATATYYLLMLHGKEFHAFPAGSWYNFSKVAQYKQLTLEEAEEKMNKRKTSATGYERWMMKAATNGPAAFGSDMMKLEPANDGEKESARHKKGKDNEEGNNSDKGEENEEEEAARKDRLGLSKRGMDDDEEGGKDLDFDLDDDIEKGDDWEHEETFTDDDEAVDIDPXEERADLAPEIPAPPEIKQDDEENEEEGGLSKSGKELKKLLGRSSGQNESDADDDDEEDDQDDESSPVLXAPKQTDQPKDEPVDNSPAXKPTPSSGHARSTPPASKSKQKRKSGGDDAKASSGAASKKAKVESDTKTSSIKEETPSSSKPTPKASASSRSANVSPVTEDEIRTVLLAVAPVTTQDLVSRFKSRLRGPEDKNAFAEILKKISKIQKTNGHNYVVLREDKK

SEQ ID NO: 33429 - protein, 684 aa, Candida albicans SC5314
MTSQYNGDTNSTTIDPNNREGGSVIDQSNNLPSSSSSSLNHSHFQKPQVSNLTKNLLSSSGGQTTPVATNVNSNTASNQQNLFTNTPSSYTEPITNRVLPNLKASASQMSNSFSGSFHQSHVHNHNDSINYIPSSHNTPTAVSSSYTSHHSYPASLSSVNNFISQPSQQQQQQPIPLSFKPPGVVPNSIPTTNVHNDTANRFSSVSSTGSPFSNSPFATSTQFQSPASIAQPVHPSSLQQVQQQRFPNSFPNTTVTHFPNPPNLQQSAINRTQHNNNNYNHHHHHQQQPIVTDTSVSTSGSTTPVENQRPAVKSVQSTPSLPHGNQHDQSARSSASSQSFQTYVQPEPDHYMPYSEFLHNLSVKDSQDESAAYEEHLNIVEYPVNDLIVMLSCLLTKIIEANDKLHPNHFENTIAIRQRLKEEKRLKKLQRQNKLQSENDDAYDEDDIDVDRTDRSFHGNNDGMDQDDDSNANVQNNDNIDNDDEEEDDDEDDEMKNKYLANVLAFHGTNIPGISLQSYLGRVLKYCPVTNEVFLSLLVYFDRIAKKANNLNQKKKNSNSNGNSTGGTGSDNQSSEAEQLFVMDSYNIHRLIISGITVSSKFFSDIFYKNLRYAKVGGLPLEELNYLELQFLLLLDFKLMISVEDLQNYGDLLLRFWKREQIANELVPNNNDNETKEHQTQTQS

SEQ ID NO: 33430 - protein, 478 aa, Ralstonia solanacearum GMI1000
MHAQHFIANRLMAADSGLRIKVFDPSDGQPFAEIARGNATDISVAVHAARRAFDGIWGRLAPAERGRLLMRVALRLADHEEELARLEARDTGKPMRQARADARAIARYFEFYAGAADKLHGQTIPYQPDTTVLTVREPHGVTAHIIPWNYPMQIFGRSVGAALAVGNACVVKPAEDACLSILRVAELAAEAGLPDGALNVVTGYGHEAGAALAAHPGINHVSFTGSPETGKLIVRAAAENHVPVTLELGGKSPQILFADADLDAAIPAVVSGIVQNAGQTCSAGSRVLIERGLYETVLDRLASVFEAIKVGPSTLDLDCGPLINPRQQQRVWDFVSDAQHANIPVMAQGLVVPEAPETGYYQAPMLLRDVPPTHRLAQQEVFGPLLAAMPFDGEAEALALANGTPYGLVAAVWTRDGARQLRLARALKAGQVFINNYGAGGGVELPFGGTGQSGHGREKGFEALYGFTTVKTIAIRHG

SEQ ID NO: 33431 - protein, 231 aa, Saccharomyces cerevisiae
MSEFLNENPDILEENQLPTRKEDSTKDLLLGGFSNEATLERRSLLLKIDHSLKSQVLQDIEVLDKLLSIRIPPELTSDEDSLPAESEDESVAGGGKEEEEPDLIDAQEIYDLIAHISDPEHPLSLGQLSVVNLEDIDVHDSGNQNEMAEVVIKITPTITHCSLATLIGLGIRVRLERSLPPRFRITILLKKGTHDSENQVNKQLNDKERVAAACENEQLLGVVSKMLVTCK

SEQ ID NO: 33432 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAMVLPLELTVCGFTVGYWNQDITVWITTFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEDKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 33433 - protein, 335 aa, Zea mays
  misc_feature (71)..(71): Xaa can be any naturally occurring amino acid
  misc_feature (145)..(145): Xaa can be any naturally occurring amino acid
  misc_feature (253)..(253): Xaa can be any naturally occurring amino acid
MSSRMAGAALLRHLGPRLFAAGPAVSGLTARGGMPAAARLLPARMASTAAEAAREDAGANKRHGGTEKHEXEEAAGGQSKKAVVSYWGIDTPKLVKEDGTEWKWTSFRPWDAYTSDTSIDIGKHHAPTTLPDKAAYLIVKSLHVXPMDLFFQRRHASHALLLETVAAVPGMVGGMLLHLRSLRRFEHSGGWIRALLEEAENERMHLMTFLEVTQPRWWERALVLTAQGVFFNAYFVGYLLSPKFAHRVVGYLXEEEAVHSYTEYLKDLEAGIIDNTPAPAIAIDYWRLPADAKLKDVVTVVRADEAHHRDVNHFASDIHYQGMKLKDTPAPLSYH

SEQ ID NO: 33434 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRREVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTLLFSR

SEQ ID NO: 33435 - protein, 412 aa, Triticum aestivum
  misc_feature (300)..(300): Xaa can be any naturally occurring amino acid
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAXPDVKAKFIIEAANHPTDPEADEILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 33436 - protein, 330 aa, Campylobacter jejuni RM1221
MNLPILDLQAYEKDKSTFLKNLREIASKIGFFYLINTSIDKNLNEKLFKLGKEFFNLSRSSKELISMVHSPQFRGYTSEGFEYTAGTKDYREQLDIGTERDALNWNLNSPLWQRLEGPNLWPSEIPELKKTFLTWHKQTKKACLKLLKTFAQALDLPSNAFDKLYGENSYEHCKIIHYPKSSKNITQGVGSHKDGGLITFVFQEKQSGLEAFIDGKWLSIPPLENSVVVNIGEFLELATNGYLKATIHRVNLSPKERFSIAYFLGVQLDKDIPIFKLNPELAKESKGVDTDPKNPLLRNVASNYFKRMIRSHPDVASIYHSDLIEKFSFA

SEQ ID NO: 33437 - protein, 397 aa, Burkholderia thailandensis E264
MSQVKRLTDLIAEGKLSGKRVFIRADLNVPQDDHGNITEDTRVRASVPAIQAALDAGAAVMVTSHLGRPTEGEFTPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAVATVKKVADIEADDMILDIGPETAKALAGQLEKAGTIVWNGPVGVFEFDQFGNGTKTLADAIANSAAFSIAGGGDTLAAIAKYGIHDKVSYISTGGGAFLEFLEGKKLPAVEVLETRA

SEQ ID NO: 33438 - protein, 334 aa, Prosthecochloris aestuarii DSM 271
MTKVKVGINGFGRIGRLVFRQALANDKIEITAINDLCDTKTLAHLLKYDSTHGVFNAEVSVEDDKLIVNGKSILICSEKDPAQLPWKELGIDLVVESTGLFTKRAAAAKHLEAGAKKVIISAPAKDAVDATIVVGVNDDIITGEEEIISNASCTTNCLAPMAKVLEDNFGIEKGFMTTVHAVTNDQRILDLPHSDLRRARTAMSSIIPTSTGAAKAIGLVVPELAGRLDGMAMRVPVPDGSVTDLTVILKKPATKEEINAAIQAAAEGNMRGVLEFCTDPIVSQDIVGNANSCIFDSLLTMSTGTMVKVVGWYDNELGYSTRVIDLLEIYSHFV

SEQ ID NO: 33439 - protein, 473 aa, Leifsonia xyli subsp. xyli str. CTCB07
MPKILIVGGGYAGFYTAWKLEKQLRKGEAEVTMVDPLPYMTYQPFLPEVAAGSIEPRHAVVAHRRHLATTNVITAKVTYIDHAKKTATIQPAIGEAYEFEYDQVVVTAGAVSRTFPIPGVADQAVGLKTIEEAVYIRDRLLANFDKAAALPAGPERDRLLTVVVVGGGFAGIEIFAELRSFASALLAKYPELSFEDTRFHLIEAMGRIMPEVSLPTSHWVIKNLAERGAQIHLETQLTSAVDGRIELSTGESFESDLIVWTAGVMANPTVVRHTDLPIEERGRVRTRADLRIGTDEEFVSGAWAAGDVAAVPDLTGAGVGGFCVPNAQHAVRQAKLLAKNLIADLRGELPRQYYHKSLGAVAGLGLGIGVLQSGKLAIKGVLGWFAHRGYHGLAMPSWERKWRVLWGWWNNFWLSRDIVSLPGLSQPRAAFEEFAARPKPAVEAAPAQAPKKAAGSKAAAKPDTKEPAEVTAT

SEQ ID NO: 33440 - protein, 631 aa, Bordetella bronchiseptica RB50
MIHLDGAAVDPAVLQGMTDAIAHRGPDGEGHWIDGNVGLGHRRLAIIDLSPAGHQPMISADSRYVLSYNGEIYNFRELRAELQGEGCQFRSQTDSEVLLHALIVWGVERTLSRLNGMFAFAWWDTRERKLLLARDRYGVKPLYFSMQGTTLAFGSEQKAILASAAFRRNLNKAALLEYFTFQNIFTDQTLLEDVHLLPAGHYAYLDCAKERPQLRLTQYWDFNFHEPAVPGTDTEYREELSRLFRQAVQRQLVSDVELGSYLSGGMDSGSITAVAAASHPYIKTFTCGFDLNSASGIELAFDERSKAEYMSYFFKTEHYEMVLKSGDMERVLPALAWHLEEPRVGQSYPNYYAAKLASKFVRVVLSGAGGDELFGGYPWRYYRAVVNNDFEHYVDKYYLFWQRLIPNSTLKQVFRPVWSDVSHVWTRNIFRDVFNSHADQLYSPEDYINHSLYFEAKTFMHGLLVVEDKLSMAHGLESRVPFLDNDLVDFATRCPVRLKLNNLADVIKLNENEPGHKTNKYFEKTRDGKQILRDVMRDYIPSDIAQAEKQGFSAPDASWFKGESMDFVKRTLFSKHARIYEIMDADTVRSLVAEHLSGERNRRLLIWSLLNVESWLAQYLDHGGVAGKGLA

SEQ ID NO: 33441 - protein, 395 aa, Prosthecochloris aestuarii DSM 271
MKRDYYEVLGVGRSATKDEIKKAYRKLAMKYHPDKNPDNSEAEEKFKEANEAYEVLSNDDKRRRYDQFGHAGVGSSASSQGGPFGGGGTGDLGDIFSAFNDMFGGGARGGGSPFGFEDVFSGGGGRRSRSAGVSGSDLKIRLKLSLEEIAKGVEKTLKIKKQVACDVCNGTGSKTGELETCPTCQGTGEVRQASKTMFGQFVNIAACPTCGGEGRVVKERCTACHGEGIKQGETTVKVNIPAGVEDGNYLTLRGQGNAGPRGGMNGDLIVVIEEVEHKIFARRGDDVVYNLTLSYADMVLGTKVDIPTLEGRVKMTVPPATQPNTVLRISAKGIGHLKAPGRGDHLVRVNVFVPKDPSHQDKELLKELNKSVHMVPDEKKEHEKGFYEKVKDIFS

SEQ ID NO: 33442 - protein, 468 aa, Corynebacterium glutamicum ATCC 13032
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 33443 - protein, 239 aa, Zea mays
FRADPASGTWFVDDDPPPFPVPTSNSAYVDLILKPTEDDLKIWPHSFEYRLRVALSPGGDLMLTSRIRNTNADGKPFSFTFAYHTYFKISDISEVRVEGLETLDYLDNLQDRARSTEQGDAIVFESELDRIYLGTPSKIAIIDHEKKRTFVVRKGGLPDAVVWNPWDKKAKAMSDFGDDEYKRMVCVEAAAIEKTVTLKPGEEWTGKLELSAVPSSYYSGQLDPDRVIQDSTVPEDSIS

SEQ ID NO: 33444 - protein, 462 aa, Listeria monocytogenes EGD-e
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPSLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 33445 - protein, 426 aa, Leifsonia xyli subsp. xyli str. CTCB07
MAAIEAVGAREILDSRGNPTVEVEVLLEDGTVSRAAVPSGASTGAFEAYELRDGDKGRYLGKGVEKAVDAVLDEIGPAIEGFEASDQRIVDEAMIELDGTDNKKRLGANAMLGVSLAVAKAAADSADLPLFRYLGGPNAHVLPVPMMNIINGGAHADTGVDIQEFMILPIGAETFSEGLRWGVETYHSLKALLKSKGLNTGLGDEGGFAPELEHNRAALDLIAEAIEKAGFTVGSQIALGLDVASTEFFENGVYRFEGQDRTAAEMSAYYTDLANNYPLVSIEDPLAEDDWEGWAHLNAEIGSTLQLVGDDLFVTNPKRLAQGIQQKAANSILVKVNQIGTLTETLDAVSLAQRSGMTAVLSHRSGETEDTTIADLAVATDSGQIKTGAPARSERVAKYNQLLRIEEELGEAAVYAGRSAFPRYQG

SEQ ID NO: 33446 - protein, 502 aa, Arabidopsis thaliana
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESSYKFLAFNAGPRTCLGKRLTFLQMKTVAVEIIRNYDIKVVEGHKPKPVPSVLLRMQHGLKVSVTKI

SEQ ID NO: 33447 - protein, 374 aa, Oryza sativa (japonica cultivar-group)
MLGIARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAAIRDPDPVVFLENELLYGESFPVSAEVLDSSFCLPIGKAKIEQEGKDVTITAFSKMVGYALQAAEILSKEGISAEVINLRSIRPLDRATINASVRKTNRLVTLEEGFPQHGVGAEICMSVVEDSFEYLDAPVERIAGADVPMPYAANLERMAVPQVEDIVRAAKRACYRAVPMAATA

SEQ ID NO: 33448 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMTFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSG

SEQ ID NO: 33449 - protein, 298 aa, Arabidopsis thaliana
MAEFMEPNLVSNFDDEKSNSVDTRSIFQMGFPLESEEIVREMIEKERQHSPRDDYLKRLRNGDLDFNVRIQALGWIWKACEELQFGPLCICLAMNYLDRFLSVHDLPSGKAWTVQLLAVACLSLAAKIEETNVPELMQLQVGAPMFVFEAKSVQRMELLVLNVLRWRLRAVTPCSYVRYFLSKINGYDQEPHSRLVTRSLQVIASTTKGIDFLEFRASEIAATVALSVSGEHFDKFSFSSSFSSLEKERVKKIGEMIERDGSSSSSQTPNNTVLQFKSRRYSHSLSTASVSSSLTSLS

SEQ ID NO: 33450 - protein, 371 aa, Oryza sativa (japonica cultivar-group)
MNTTAKLLALAVFAAAAILSLDSRSDVRQLEIRDGDVELIPLLDGAAGPESIVFGDAGDGPYTSVSDGRILKWLPPPERRWVEHSCSVPELLDSCRGSKDTKREQECGRPLGLKFNSKTGELYVADAYLGLRVVSPGENVSRPLVPKRTGSPFSFSNGVEIDHETGVIYFTETSTRFQRREFLNIVITGDNTGRLLKYDPKENKVEVLVDGLRFPNGLAMSIDGSYLLLAETTTGKILRYWIKTPKASTIEEVAQLPGFPDNIKMSPRGGFWVGLHAKRGKIAEWSISYPWLRKLIFKLPAQRIQRITSFLTGFGRQVIALRLSEDGKTIEAMSVHGDVRKLFKSISEVEEKDGNLWIGSVLSPFLGLYRI

SEQ ID NO: 33451 - protein, 522 aa, Pseudomonas fluorescens Pf-5
MNAYSPPNDPEVVDIAIIGAGFAGLCMAIKLKQAGIEDFFVAEHAASLGGTWRDNHYPGCACDVQSHVYSFSFAPNPNWTRQFAPQPEIREYLENCARDFALAPYLHFNMGLQQAVFDEARERWHLRFSNGREVSARVLISGMGGLSRPAIPDIPGLDTFTGKRFHSQQWDHRYALQGKRVAVIGTGASAIQFVPKIAPRVAQLKLFQRTPPWIMPKPDRELSAVERWAFKHLPFTQRLVRSALYWALESRVIAFARRPRLMKVVQRVALRHLRKQVPDPVLRQRLTPDYTIGCKRILISNDYYPALTRGNVRLITDDIQRIDGDAVITADGNRHPVDCIIFGTGFQATDPIPRGLLFGRHGQDLMDSWARGAHAYLGTCLPGFPNFFMIVGPNTGLGHNSMILMIEAQVDYILKALDQMQRERIASIEVRPQVESQYNQRLQQRLAGAIWSTGGCRSWYLDPRSGQNTTLWPGSTWSFKKTLQHFELQDYQASHLPHTQPAAAPAAARPLHLEEAALNEKL

SEQ ID NO: 33452 - protein, 140 aa, Triticum aestivum
  misc_feature (115)..(115): Xaa can be any naturally occurring amino acid
MLRLRLHPCPRFSPPGSHPAFPRQLAASPLPELPFQSTVTALRTRAPPLQAAVSRAASGEEQRGVYEDEEDADLDNALTKTRQLVECAMFASVAGLAYFLSNSLAIEVHSLLSLXNYFSCFFQLPIVISSLRWGLEAGRK

SEQ ID NO: 33453 - protein, 440 aa, Oryza sativa (japonica cultivar-group)
MSSTLMASCCFIISYKRPRPIIATFVPFLLLLFFFAVVVAASSSSNGTAAALHPGEELLRLERVRAQLARSPDGDVIDCVPSHLQPAFEHPRLRGQKPEEPPSARPTETTRRRRRRRRSHAHGGGGGEHREEEDDGEHGLRQAWWAAGEACPEGTIPVRRTTEADLLRASSAAAAGGRFGMKPRGVGVVGGAARRDSTSSGHEHAVGYMSGGQFYGAKASLNVWPAKVASPAEFSLSQIWLISGSFGNDLNTIEAGWQVSPQLYGDNNPRFFTYWTNDAYQETGCYNLHCSGFVQTNSRIAMGAAISPISSFAGRQFDITLLIWKDPKQGHWWLQLGSGALVGYWPSFLFSHLGARADMAQFGGEVVNTRPSGSHTPTQMGSGRFPGEGYGRAAYFRNVQVVDWDNNLIPAAALRLLADHPACYDIAGGQGAAWGRFLCD

SEQ ID NO: 33454 - protein, 380 aa, Pseudomonas syringae pv. phaseolicola 1448A
MAKRDYYEVLGVERGSSEADLKKAYRRLAMKHHPDRNPDDKASEELFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTNVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGTQGGPTGDLYVVINVREHAIFQRDGKHLFCEVPISFTDAALGGELEVPTLDGRVKLKIPEGTQTGKQFRLRGKGVAPVRGGGAGDLMCHVAVETPVNLSKRQRELLEEFRTSLENDESHSPKASGWFEGVKRFFGDL

SEQ ID NO: 33455 - protein, 218 aa, Pseudoalteromonas tunicata D2
MTQDEMKKAAAWAALEYVEKDSIIGVGTGSTVNHFIDALGTIKGDIRGAVSSSEASTEKLKALGIEIFELNDVDGLSVYVDGADEINPANEMIKGGGAALTREKIVAAVAKKFVCIVDSSKQVDVLGNFPLPVEVIPMARSYVARELVKLGGDPMYRQGVVTDNGNVILDVFNLQISQAKQLEQQINQIVGVVTNGLFAARGADVVIVGTPDGPKILK

SEQ ID NO: 33456 - protein, 330 aa, Burkholderia thailandensis E264
MSSTASPSLSAAHLLTPIASDMEQVNRVIRQSLASDVLLINQIAEYIIGAGGKRLRPALLLLVAGALGEHTSQKHVLAAVVEFIHTATLLHDDVVDESELRRGRKTANALFGNAASVLVGDYLYSRSFEMMVGVGKMRVMEILSEATTIISEGEVLQLLNMHDADVDEARYMQVIRYKTAKLFEAAARLGAVLAGADAPTEAAAAEYGRRIGTAFQIMDDWLDYAGTAEAMGKNAGDDLREGKPTLPLIYLIERGTPEQSTLAREAIEHGGTDRFDTIFDAITRSGALDHTLECARQEAQAAAAAISSFPPSIFKESLLELCFYSTSRQS

SEQ ID NO: 33457 - protein, 507 aa, Candida albicans SC5314
MLASKKKRTRRIKRQPICEQIPTSNTAFFFTLDIPIMPVNFLTSVVFDGPEVIPYWDQIKEYGPTVLPILLTLAGAKYYFHGATNTWERDMHGKVFMITGGTSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRNVRVLIATCSSQNLGDVDLNDLLWSNKRYPATQPWKVYGTSKLLLGLFAKEYQRQLMGYERKDKAPCNVRINLINPGIVRTPSTRRFLSLGTVWGLIIYLILFPIWWLFFKSAEQGAQSFYFALFAPIFMKIEGGNVVQECKIMTKVRKEYTDDDLQQKVFHNTEELIKQIETKSAIERKKHENAKKTPEQKAKERQEELNRKRDLHIKPETPEELESKLNSLRNQIGMGTGISSNEMPLFPDDETLKKVISSKKNASSNNSGGSKSNKSQKKSKKV

SEQ ID NO: 33458 - protein, 292 aa, Pseudomonas syringae pv. phaseolicola 1448A
MIAGSMVALVTPMDAQGRLDWDSLSKLVDFHLQEGTNAIVAVGTTGESATLDVSEHIEVIRRVVAQVAGRIPVIAGTGANSTREAVELTTNAKTAGADACLLVTPYYNKPTQEGLFQHFSHIANAVDIPQILYNVPGRTACDMLPETVARLSTVKNIIGIKEATGNLQRAKDILASVSSDFLVYSGDDATAVELMLLGGKGNISVTANVAPRLMSDLCAAAMRGDAETARAIHEKLMPLNNTLFIESNPIPVKWALHEMGKMPAGIRLPLTWLSEACHEPLRQALRQSGVLV

SEQ ID NO: 33459 - protein, 122 aa, Mycoplasma gallisepticum
MNKLNKQNIINHVNNLQLKKSVPNFQVGDTVSVSIKIADEKRTRIQKFDGLVLRRKGSGLSETFIVRKESSGVGVEKNFHVHNPNIEIELKRKGKVRRAYISYMRERSGKSARIKEKVVNTK

SEQ ID NO: 33460 - protein, 417 aa, Zea mays
TGAVDNDDDGGGCRYLVLISYRGLGNRMLAITSAFLYALLTRRVLLVDRGYGNTLPDLFCEPFPGTTWALPLDFPLDKEFRDLDETAPESYGNVAVNRSGSVSGMRFVYLHLDHAASQANRLVYCDDDESFLRRMQWAILRTDQYMVPGLFFNPTHQGELDRLFPRKDSVFYLLSRYLLHPTNDVWGMVTRYYNAYLSGADERLGIQIRVLFGGDKPAQHVLDQILACTSRERLLPGVVTTQGPAPAPPLPAAAGARARRRSKAVLVTGLSGWYHDSIREMYWESPAADGEVVSLFQPSHEEHQLWYQNKHDMKAAAEIYLLSLTDNIVTSAWSTFGYVGYALGGLRPYLMFLPENQTAPDPPCTRAMSMEPCSHGAPSFECTRKEIGTIINTGLLLPHVRACEDISWGLKLTDPDE

SEQ ID NO: 33461 - protein, 311 aa, Zea mays
MEIFVPLANRLGVASWKDQLENLCFKYLNPEEHEELSSKLRESFDEELITSAVDKLDKGLRDAGVSYHSLSGRHKSLYSIHCKMLKYRSLHTVVMSEGVHPFEVQIRTREMHLQAEYGFAAHWRYKEGTCRHSFVLRMVEWARWVLTWQCEAMDRERTASLGSDDGTVSVRPPPACPFPQHAEDCPYSYTRQCNHDGPLFVILLEHGKMSVQEFPANLTVMDLMDRVGANSSRWSPYSIPMKEDLRPRVNGEPICDPDRRLNMGDVVELTPALPRKSLSGYREEIQRMYDRGGFALSARGGGGGGGGARRC

SEQ ID NO: 33462 - protein, 129 aa, Prototheca wickerhamii
MTNFKDIIKKIEYKFSKHQLPDIKVGDLIRLGISIQESGKQRVQPFEGTVIALHKAGLNTTITVRKILQGIGVERVFPIHASCLTSIQVLRRSQVSRAKLYYLRNRTGKATRLKEKFEKLPPIWVNKLP

SEQ ID NO: 33463 - protein, 549 aa, Bradyrhizobium sp. BTAi1
MTQPQRMTAPTLPTYSPRGLALLRDPLLNKGTGFTEQERDALGLRGFLPAGVLSMQAQAERILVNLRSLPSDLEKYVALNALHDRNEALFFRVVCDNIDEIQPLIYTPTVGLACQKYGLIFQRPRGLFISANDRGRIAEILANWPYRAKLIVVTDGERILGLGDLGANGMGIPVGKLSLYSACAGIHPEECLPVMLDVGTNNEEFLKDPYYIGLRQKRITGAAYDEFVDEFMTAARAAFPGVLIQFEDFANHAAFKLLHKYRDDACVFNDDIQGTAAVALAGLFSALRITGGRLRDQRVLFLGAGEAATGIADLVVSAMMAEGLSEAEALQRNWLTDSRGLVVKGRENLHGHKLRYAHEQAPIGDFLTSIRTLKPTAIIGVAAVGGAFTPEVLQAMAELNERPIIFALSNPTSKAECSAEAAYRYTQGRALFACGSPYDPVKLDGKTFVPRQGNNSYIFPGVGLGAIASGARLVTDEMFMAAAHTLANCVTGADLEQGSLYPALPRIREVSALIGAAVAGVAYQNGLASGPAPNDLLGFVEQKMYDPRY

SEQ ID NO: 33464 - protein, 137 aa, Nephroselmis olivacea
MTKEDKEKKEKIEYRPLPAIAVGDLVKVGLLILEGDKERVQTYEGTVISKHRAGLNSTITVRKTFQGVGIERVFCLYSPRMVFVEFIRHSKARRAKLYYLRNRVGKQSRLEERFDLVTNTILLDLLASESDPSNSRT

SEQ ID NO: 33465 - protein, 230 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGDRDDRYSSRDDRYSSRDDRYGGRDGGRDDKYGGSNGSSRYGPDRGGDRYSGSRDGGSRSSGGGDRYSRDRSGPYDRRSRDEY

SEQ ID NO: 33466 - protein, 236 aa, Candida albicans SC5314
MRSIKSVVVGDGGVGKTCLLISYTTNTFPNDYIPTVFDNYSASVMIDGEPIKLGLWDTAGQSEYDRLRPLSYPQTEIFLCCFSVISPDSFQNVKSKWIPEILHHCPKDILILLIGTKVDLRDDLHVLDELTARNLSPVTFDQGNKLAREIGAIKYMECSAATQVGVKEIFDYAIRAVLDPPNANKGEYVTNDSVPGMGVNNSSGSKKHNEKNGSGTATAGTGKKRKIKRAKKCTIL

SEQ ID NO: 33467 - protein, 619 aa, Arabidopsis thaliana
MVMNNPANNNPVAASSASAVALAPPPHPPQPHRPSTSCDRHPDERFTGFCPSCLFDRLSVLDITGKNNNAVASSSKKPPSSSAALKAIFKPSSSSGSFFPELRRTKSFSASKAEAFSLGAFEPQRRSCDVRVRNTLWSLFHEDAEHNSQTKEGLSVNCSEIDLERINSIVKSPVFEEETEIESEQDNEKDIKFETFKEPRSVIDEIVEEEEEEETKKVEDFTMEFNPQTTAKKTNRDFKEIAGSFWSAASVFSKKLQKWRQKQKLKKHRTGNLGAGSSALPVEKAIGRQLRDTQSEIAEYGYGRRSCDTDPRFSIDAGRFSLDAGRVSVDDPRYSFEEPRASWDGYLIGRAAAPMRMPSMLSVVEDSPVRNHVHRSDTHIPVEKSPQVSEAVIDEIVPGGSAQTREYYLDSSSSRRRKSLDRSSSTRKLSASVMAEIDELKLTQDREAKDLVSHSNSLRDDCCYVENNYEMGVRENVGTIECNKKRTKKSRWSWNIFGLLHRKNGNKYEGEERRSGVDRTFSGSWNVEPRNGFDPKMIRSNSSVSWRSSGTTGGGLQRNSVDGYISGKKKVSKAENGMLKFYLTPGKGRRRGSGNSTAPTSRPVPASQPFGSRNVMNFY

SEQ ID NO: 33468 - protein, 628 aa, Bordetella bronchiseptica RB50
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIGAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGRAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDAGQTKHIFRKAMRGIVPDSILDRDDKIGFATPEQQWMQATAPQMRQWLVDAADIPFLRNAEVTAQFDAMIAGATPFSWQAWRWVNFQRWMQHATVLP

SEQ ID NO: 33469 - protein, 300 aa, Oryza sativa (japonica cultivar-group)
MQGEEYMLKGDDFAKAKLGPKKPFRPIKPRGCWADDRLTTHQGPLNLITLCTHVNVPFIGRRTRINWTEEENLHLLSYWIHYSTDPVKGIDRKSEFYWKAVADVFNTSAPTNGHKRSVKQLKTHWGDVKRDITKFCGVYGRLKATWKSGQSDDMVMNSAHAIFEKENKDKPFTLEYMWREVKDLPKWCRIVQEDSGNKRTKEETISKEKRPDGQKKAKAGLKGKGKDAAPSPLGNQPSQNMILYHEAMSLKATAMIKSAKEKKYQTYLKLLEKDTSNFSEAHHKRHEGVLDQLAKELAGE

SEQ ID NO: 33470 - protein, 558 aa, Streptomyces coelicolor A3(2)
MSPREDTVLSTMQDVPLLISRILTHGSAIHGSSQVTTWTGEDEPHRRSFAEIGARAAQLAHALREDLAVGDDERVATLMWNNAEHVEAYFAIPSMGAVLHTLNLRLPPEQLAWIVNHAADRVVLANGSLLPLLAPLLPHLKTVEHVVVTGPGDRSLLDGAAVQVHEYEDLIAGKPTAYDWPELDERAAAAMCYTSGTTGDPKGVVYSHRSIYLHSMQVNMAQSMGLTDQDTSLVVVPQFHVNAWGLPHATFMTGVNMLMPDRFLQPAPLAAMIEGERPTHAAAVPTIWQGLLAELTARPRDVSSLTQVTIGGSACPPSLMEAFDALGMRVCHAWGMTETSPLGTIARPPAHVIGTPEEFAYRLTQGRFPAGVEARLTGPGGERLPWDGESAGELEVRGNWIAGAYYNGPGADPLRPDDKFSADGWLKTGDVGTISHDGFLTLTDRAKDVIKSGGEWISSVELENALMAHPDVAEAAVVAVPDDKWGERPLATVVLREGASTDFAALRTFLAEDGKIAKWQLPERWTVIETVPKTSVGKFDKKVLRRQYAEGGLDVTRL

SEQ ID NO: 33471 - protein, 198 aa, Campylobacter jejuni subsp. jejuni NCTC 11168
MIISAKFITSLVKFDENLSSNFSEVAFLGRSNVGKSSLINSLCKQKNLAKSSATPGKTQLINFFEVICRRNEEKFNINFIDLPGFGYAKVSKNLKEIWNQNLDEFLKLRTSIKLFIHLIDSRHTHLEIDVNLNDYLKRFLRPDQKILKVFTKCDKLNQSEKAKLKNEFKDSILVSNLNKFGLDSLEDIIINQTLGLDK

SEQ ID NO: 33472 - protein, 553 aa, Triticum aestivum
  misc_feature (334)..(334): Xaa can be any naturally occurring amino acid
  misc_feature (351)..(351): Xaa can be any naturally occurring amino acid
  misc_feature (370)..(370): Xaa can be any naturally occurring amino acid
  misc_feature (411)..(411): Xaa can be any naturally occurring amino acid
HYRTSLYKKAGWYRSGIPGISCTHTNTRVLTHSLHRGQGKGRTERNGATAMAAANGAKGFEVPELDIKFTKLFINGQFVDAASGKTFETRDPRTGEVIARIAEGDKADIDLAVKAAREAFDNGPWPRMPGCARARIMHKFADLVDQHVEELAALDTVDAGKLFMMGKMMDIPGGANLLRYYAGAADKIHGETLKMARPLHGYTLKEPVGVVGHIVPWNYPTTMFFFKVSPALAAGCTMVVKPAEQTPLSALFYAHLAKEAGIPDGVLNVVPGFGPTAGAAIASHMDVDKISFTGSTEVGRLVMQAAATSNLKPVSLEQGGKSPVIVYDDADVDXAVTLVNMATYMNKGGDXAVAGTRKYVREGDLRRPLXRKSVELAKKSVVGDPFQPPTYIKGPQVDKDQYEKVLKYIEXGKSEGATLLTGGKPCSDKGYYIEPTIFTDVTDDMSIAQEEIFGPVMALMKFKTVDEVIQKANSTRYGLAAGVVTKNIDTMNTVSRSVRSGVVWVNCYFAFDPDAPFGGCKMSGFGKDMGTDALEKYLHTKTVVTPLYNTPWL

SEQ ID NO: 33473 - protein, 692 aa, Clostridium perfringens ATCC 13124
MKRIQSTCNYCALACNLDFYTEDGKIKRVVPTPHYPVNKGFSCIKGLNLDKQCTKFNGSKKPLLKMKDGERKAIEWKEAFDLFASKMTAIQEKYGKESVAYISTGQLPTEEMALLGHVGRSYMGINGDGNTRLCMASAVVAYKQSFGFDAPPYTLKDLELSDTIFFIGANPVIAHPIAWGRVRKNKDAKIITIDPRKSETAMNSDMWIDIKTKGDLALFYTLANVLIEKGWINQDYINNYTEGFEDFKAHVKKYTLEDVEERTGISKMRVLELAKIIHEGKRVSFWWTMGVNQSYEAVRTAQAIINLALITGNMGREGTGANSLTGQCNAMGSRMFSNTTALYGGGEYNNKERRKVVADILGMDENMLPTKPTLDYEQIIKGINKGEIKGLWVVCTNPRHSFSNNEEFKKAMKNLDFFVVQDIYEDTDSSKECDLYLPSVPAIKKEGFLINTERRLSALVPVLEKEEDELSDYEILLGIGEALGMGSLLDKWRTPEDAFKLLRECSKGMPCDITGVSYERLRDSKGIQWPCRKGEELESDERRLFEDGKYYTPSGKAKFIFEDVTENPNATNEEFPFNLNTGRGTVGQWHTHTRTREIQAVTNIVSQKAYVDINRKDAEKLDIKENDEVLIHSSNGHTSKFIARLTDNLKEKTLYAPIHYIETNLLTPSVFDPYSKEPSYKTVQVNIEKVRK

SEQ ID NO: 33474 - protein, 321 aa, Bacillus licheniformis ATCC 14580
MSLDVMTFGESMAMFYANEAGGLHEASSFSKALAGAETNVAVGLSRLGFRVGWMSKVGADSLGTFILNELKKEGVDISEVKRTADRQTGILLKSKVESGDPDVTYYRSGSAASTMSIDDYPAEYFKQAKHMHVTGIPPALSREMRGFARHAVHQMKKDGKTISFDPNLRFQLWPDQQTMVHTINEIAAQADWFLPGINEGKLLTGCNSPEDIAKHYVMQGVKVIVIKLGKEGAYYRTSEKEGYVPGYQVEKVVDTVGAGDGFAVGMISGLLDGLPLEEAVQRANAIGALAVMAPGDMDGLPSRDQLKAFMAGEKNNQKIGG

SEQ ID NO: 33475 - protein, 344 aa, Triticum aestivum
  misc_feature (297)..(297): Xaa can be any naturally occurring amino acid
  misc_feature (320)..(321): Xaa can be any naturally occurring amino acid
  misc_feature (336)..(336): Xaa can be any naturally occurring amino acid
SMIEVAAKKGARELNFKGKLMAQIEWIPDSIGKLTGLVTLDISENRLVALPPTIGKLSSLTKLDLHANRIAQLPDSVGDLRSLICLDLRGNQLTSLPSSIGRLANLEELDVGANHIVSLPDSVGSLTRLKKLLVETNDLDELPYTIGHCVSLVELQAGYNHLKALPEAVGKLESLEILSVRYNNIRSLPTTMASLTKLKEVDASFNELESIPENFCFVTSLVKLNVGNNFADMQSLPRSIGNLEMLEELDISNNQIRVLPDSFGMLQHLRVLRAEENPLQVPPREIALKGAQAAVQXYMAEHAAKKTTKPQPAKAKELGXXSAFLPSPNKRKHDRXDTDMIRLK

SEQ ID NO: 33476 - protein, 561 aa, Glycine max
MNKVGWSFKSFKTLLVVASITFPILLTLTLVHQNNNSVSDLFQGFHVLSGRTLNTNATAILSKDHDIIRESTLGPKNHSFEDGKNALSLSTTTIANDKLLDGLLVSSFDEASCFSRYQSYLYRKASSHKPSKYLIFKLRNYEHLHQSCGPSTKSYNKVMRKGTKFSKNDASTKCKYLVWTASNGLGNRIVTLVAAFLYAILTDRVLLVKFGTDMHGLFCEPFPGTSWLLPRNFPYWKDQKHIETYESMLKNNKVNTSHELLPAFIILNLQHTHDGHNNFFHCDQSQDLLQRIPVLILWSDQYFVPSLFMIPSFRQDLSKMFPEKDTVFHHLGRYLLHPSNEAWEIIRKFYEAHLAKANERIGLQVRVFNTHRAPHQTIINEIIACTLQHKLLPDFDMQKSATSPLKKPSKAVLVASLFSEYGQKLRTMYQANTTVTREVIRVYQPSHEERQKSNNDMHNIKAWTEIYLLSLCDALVTSPKSTFGYVAHSLGGLKPWILQRAYGETIPDPPCRRAKSMEPCFHYPPKYDCRANSTVDFTSIFHHMKHCEDVSSGLRLVNVKH

SEQ ID NO: 33477 - protein, 863 aa, Neurospora crassa
METTLPLPFLRRVSVPPGLNDIKEGLSREEVSCLGCVFFEVKPQTLEKILRFLKRHNVEFEPYFDVTALESIDDIITLLDAGARKCLSRPSSWPTSPHMVPRCPHCHWKQRCFAFLRHRERPFALRLRSDCLRGCTVSGGGQRQENYPLLHQARSWGRSRTVHPGRRQRNAIPILPSTGLTTKKDEAGKLAISTILSSVWKSDRPDGLLPTVVVDEHDTALGLVYSSAARVNEALRTQTGVYQSRKRGLWYKGATSGDTQELVRISLDCDNDALKFVVKQKGRFCHLDQSGCFGQLKGLPKLEQTLISRKQSAPEGSYTARLFSDEKLVRAKIMEEAEELCTAQTPQEIAFEAADLFYFALTRAVAAGVTLADIERSLDAKSWKVKRRTGDAKGKWAERRASTLRRRLAATSAPVTKEAAQETTPEKITMRRFDASKVSTEELDAALKRPAQKSPMPSTMIIVPIIEDVRKNGDKAVLSYTHKFEKATSLTSPVLKAPFPKELMQLPEETIAAIDVSFENIRKFHAAQKEEKPLQVETMPGVVCSRFSRPIEAVGCYIPGGTAVLPSTALMLGVPAMVAGCNKIVFASPPRADGTITPEIVYVAHKVGAESIVLAGGAQAVAAMVRPESITKVDKILGPGNQFVTAANMFVSNDTNAAVGIDMPAGPSEVLVIAHKDANPAFVASDLLSRAEHGVDSQVILIAIDLDEEHLQAIEDEVHRQATELPHVQIVRGSIAHSITVQIKTVEEAMELSNKYAPEHLILQIKEAEKAVDLVMNAVVFIGATPSAWHYSAGVNHSLPTYGFAKQYSGVNLASFVKHITSSNLTAEGLKNVGQAVMQLAKVGARGSRRAVSIRLEHMSKSN

SEQ ID NO: 33478 - protein, 999 aa, Ralstonia solanacearum GMI1000
MLLTRKPAAQDAKTGQASRPGAATLSGSLARGLAGALPTMDRRTFLKRSGIGVGAGLAASQLSLVKKATVVGEARAAEGKDDIVVRRTVCSHCSVGCAVDAVVQNGVWVRQEPVFDSPINMGAHCAKGAALREHGHGEYRLKTPMKLVDGRYQRISWEQALNEIVARMNAIRQETGPDSFFFVGSSKHSNEQSYLLRKWVSFFGTNNCDHQARICHSTTVAGVANTWGYGAMTNSYNDMQNAKCALYIGSNAAEAHPVSMLHLLHAKETGCKVIVVDPRYTRTAAKSDEYVRIRSGTDIAFLFGVLHHVFKNGWEDRQFIHDRVYGMDKVRDEVLAKWTPDKVEAVCGVPEAQVRKVAEMMAMNRPSTLVWCMGQTQHTIGNAIVRASCIVQLALGNIGRPGGGANIFRGHDNVQGATDVGPNPDSLPGYYGLAAGAWKHYAAVWGVDYDWIKGRFASQAMMEKSGTTVSRWIDAVLEKNELIDQDHNVRAMFYWGHAPNSQTRGLEMKRALDKLDLLVVIDPYPSATAAMANMPAADGTPPNPNRAVYLLPAATQFETSGSCTASNRSLQWREKVIEPLFESQPDHVIMQALADRLGFGNELSKRLKVTEYKRAGMTWREPGTESILREINRSNWTIGYTGQSPERLQAHMRNMHLFDVRTLRCQGGKDPVTGYDLTGDYFGLPWPCYGTPELKHPGSPNLYDTSKHVMDGGGNFRANFGVERDGVNLLAEDGSYSLGAELTTGYPEFDHVFLKKLGWWDDLTDVEKKAAEGKNWKTDLSGGIQRVAMKHGCHPFGNAKARAVVWNFPDPIPQHREPLYSTRPDMVAQYPTHDDKKAFWRLPTLYKTVQQRNIENKVYEKFPIILTSGRLVEYEGGGEETRSNPWLAELQQENFVEINPKAAADRGIRNNDYVWVKTPTGAQIKVRALVTERVGVDHAFIPFHFSGWWQGKDLLDYYPEGAHPIVRGEAVNTATTYGYDSVTMMQETKTTVCQIERFA

SEQ ID NO: 33479 - protein, 524 aa, Debaryomyces hansenii CBS767
MSTDKLKSYVEEISPYLTQWYVIALGGILVWYIGTSIKAYQFKQKYGCKEPPLVPGGFLSIKLLLDLLKTKSEGTMLEYAEHFFSLVKSQTFKLKLATVPIIFTQDPENIKAVLATQFNDFALGTRHAHFKPLLGDGIFTLDGDGWKNSRLLLRPQFAREQVAHVQTLEPHLQTLAEHISNKKGETFDIQELFFRLTVDAATEFLFGESVYSLRDGTVKDVAPLDFDGKSSFADSFNLSQSYLASRAYSQMFYFLINNKEFRNSNTKVHKFCKHYVEQALATSQDELDKKSKDGYIFLYELVKQTRNPKILQDQLLNILLAGRDTTAGLLSFTFFELARNPDVFEKLKNEIYTHFGDGANPRIETITFESLKRCEYLKFVLNEVLRLYPSVPINFRVSTKDTTIPRGGGPDKQDPVYVAKGTTVAYSVYTTHRLEQYYGKDSREFRPERWAENKKVGWAYVPFNGGPRICLGQQFALTEASYVVVRLIQMFPNLVSRDDRPYPPRKNVQLTMCHQDGVFISLNK

SEQ ID NO: 33480 - protein, 218 aa, Desulfovibrio desulfuricans G20
MQPKLVLENTIYTLEQLVSFNAPQIALAGRSNVGKSSLVNTLAGRKGLARTSSTPGKTRSINFYKVDPDGYYVVDLPGYGYARCSKAEREKWAKLIRRYLVETPAVCAIAILLDCRLSPQKLDVELAAFARQAGLPLLPVLTKADKCKQQERALRQREWRTILGGEVPLLFSSKTGMGKDKLWQELHRLAFPDMAFDTPSDGAPEPADEPEAASERAE

SEQ ID NO: 33481 - protein, 222 aa, Brassica napus
  misc_feature (166)..(166): Xaa can be any naturally occurring amino acid
  misc_feature (193)..(193): Xaa can be any naturally occurring amino acid
  misc_feature (212)..(212): Xaa can be any naturally occurring amino acid
MGKGPLSFRRLSSIRRRKKGSSVKDDPNQSSNPSSPPPPSPINAGGSVAAGTTGKVKKKAGGARLWMRFDRTGAMEVVECDKSTIIKRSSVPARDLRILGPVFSHSSNILAREKAIVVNLEVIKAIVTAEEVLLLDPLRPEVLPFIDRLKQQFPQRNALEATPNVXTFDPEAGEGLQSELPFEFQVLEMALEXVCSIVDTSVASLETDAWPXLDELTKNVST

SEQ ID NO: 33482 - protein, 396 aa, Idiomarina baltica OS145
MDYQLSKRVNSIQPSPTLAVTQKANELRSAGKDVIGLGVGEPDFDTPDFVKQAAIKAIEDGKTKYTAVDGIVELKQAVSDKFKRDNQLEYGLDEIIVSAGGKHSIFNLLSAWLNPGDEVVIPAPYWVSYPDMVKLVEAEPVIVHTDLEQRFKITPEQLRDSLTEKTRLMFINSPSNPSGTAYSAEELRALADVLVDFPNVLIATDDMYEHILWDRSQFANIVMVAPELRDRTVILSGVSKAYAMTGWRIGYAAGPAPIIAAMKKIQSQSTSNPASISQHAAVAALNGDQSCIDTMVSAFKERHDYLVSALNEIEGIECVKGDGTFYTFARIQNLIEKAGVANDVELCEKLLTEANVALVPGSAFGTEGYCRLSFATSLDTLKEAVARINQFVKALK

SEQ ID NO: 33483 - protein, 377 aa, Bacillus licheniformis ATCC 14580
MKAVTFQGPQHVEVSQVEDAKIEKSDDIVVRITSTAICGSDLHLYQGNFPLPKGFQLGHEPMGIVEETGPDVTKVKKGDRVVIPFTVACGHCFYCENKLESQCDNANPHYDSGGYFGYSEKFGNHPGGQAEYLKVPFGNFTPFVIPESCEMEDESLLFLSDVLPTAYWSVLHAGVKKGDTVIVLGCGPVGLMAQKFAWMEGAKRVIAVDYLDYRLKQAEALNRVEVFDFTKYPDMGEHLKEITKGGADVVIDCVGMDGKKSPLEYLEQKLKLQGGTLGPIQISTKAVRKCGTVQITGVYGSNYNMFPLGAFFSRNVTLKMGQAPVIHLMPEIYKKIEENQFDPKEIITHQLPLEEAGRAYHLFNDHEDDCIKVILKP

SEQ ID NO: 33484 - protein, 477 aa, Bacillus licheniformis ATCC 14580
MKGKRSNAWLYFFGALGGVLYGYDTGVISGAILFMKDELGLNAFTEGLVVSAILIGAIFGSGLSGRLTDRFGRRRAIMSAAVLYCIGGLGTALAPSTEYMVAFRIVLGLAVGCSTTIVPLYLSELAPKESRGALSSLNQLMITIGILLSYLINYAFSDAGAWRWMLGLALIPSIGLLIGIFFMPESPRWLLTKGKEEKARRVLSKMRGGERVDQEVKEIKEAEKQDQGGLKELLEPWVRPALIAGVGLAFLQQFIGTNTIIYYAPKTFTNVGFEDSAAILGTVGIGTVNVLMTLVAIRFIDRIGRKPLLLFGNAGMVISLIVLSFSNLFFGNTSGAAWTTVICLGVFIVVFAVSWGPIVWVMLPELFPLHVRGIGTGVSTLMLHAGNLIVTLSFPVLMEAMGISYLFLCYAAIGIAAFLFVFFKVTETKGKVWKRSSRICGTSTAESRQLTHSRLNDRQKDGQGPILFCVKRPADHG

SEQ ID NO: 33485 - protein, 460 aa, Oceanospirillum sp. MED92
MLDDNNKASATTADIQALDAEHHLHPFTNTGALNKKGARVITKGEGVYLWDSEGNKIIDGMAGLWCVNMGYGRKELVEAANTQMNQLAYYNTFFQTTHTPVAELAREIASVTPGDLNHIFFANSGSEAIDTIIRLVRQYWAIKGKPYRNILISRENAYHGSTVGGTSLGGMSGMHKQGAPLVPNIERIRQPYWYGEAGDMSEEEFGIACAKALEEKILEVGPDNVAAFVGEPIQGAGGVIVPPANYWAEIQKICQKYDILLAADEVICGFGRTGSWFGSETLGITPDIISMAKGLSSGYLPIAAVAVGDRISNALIEHDDDFNHGYTYSGHPVSAAVAIANIRLMKEENIVDYVANDIGPYFQQKLRDTLGEHPLVGHIEGVGLVAGIALVKDKATKELFPDDLDIGMICRDHCFNNGLIMRAVGSRMVLSPPLVISRDEVDELIEKARLCFDLTLKSVS

SEQ ID NO: 33486 - protein, 445 aa, Oceanospirillum sp. MED92
MSSNNDKEFDLFITDLNGNLRGKRMPANALSKVMEEGVKLPRSVIGFDFWGDDVLDNGLVFETGDSDGICMPVHDEAVPVPWADSPRNQILATMFNPDGTPFSADPRQALNAVVDRFKKLGLTPVVATELEFYLMDGKSEETQRPQPPILVEGHGRRLAETDCYSIDEMDGLSSFFAEVREVCEQQGVPADTIISELGPGQFEINLNHVPNPMLAGDQAIMFKRLVRGIARKHGYSATFMAKPYANKSGNGFHVHFSLLNEAGINVFDNGGDEGTDVLKHAVAGLMNTMADSMLAFAPHMNSYRRFMVGAHAPTCASWGYENRTVAIRIPDSPPVARRIEHRVAGADANPYLVLATILAGALYGIENKLMPPAPIAGDAYTEANQDLILPNKWDDATDIFNRSDVMREYLGEEFVRVFTAAKRQELRKLHAQISDIEYESYLGFL

SEQ ID NO: 33487 - protein, 389 aa, Anabaena variabilis ATCC 29413
MKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAEYARVPFADTGLFKIPDGLTDEQVVFLTDIFPTGYMAADNCNIQPGDIVAVWGCGPVAQFTIRSAYLLGAERVIAIDRIPERLQMAKDQGKAEILNYEEVNVSEALKEMTGGRGPDACIDAVGLEAHGTGLEGVYDEVKQAVRLETDRPHVLRQVMMDCRKGGHVSIPGVYVGVVDKIPMGAAMNKALVFKMGQTHVHKYLNTLLDHIQNGRIDPSFVITHRLPLDEAPRGYGIFKDKKENCIKVVLKP

SEQ ID NO: 33488 - protein, 127 aa, Oryza sativa
  misc_feature (9)..(9): Xaa can be any naturally occurring amino acid
YSVNEGHAXTGNGPTTKYVKKCRFPKDGSFAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAEE

SEQ ID NO: 33489 - protein, 466 aa, Corynebacterium efficiens YS-314
MKFHCKFTCPRCRDGNVEFMTVDEQVSNYYDMLLKRNAGEPEFHQAVAEVLESLKIVLEKDPHYADYGLIQRLCEPERQLIFRVPWVDDNGQVHVNRGFRVQFNSALGPYKGGLRFHPSVNLGIVKFLGFEQIFKNSLTGLPIGGGKGGSDFDPKGKSELEIMRFCQSFMTELHRHIGEYRDVPAGDIGVGGREIGYLFGHYRRLANQHESGVLTGKGLTWGGSLVRTEATGFGTVYFVQEMIKAEGETLEGKKVIVSGSGNVATYAIQKVQELGAVVVGFSDSSGWVSTPNGVDVAKLREIKEVRRARVSSYADEVEGAEYHTDGSIWDLTADIALPCATQNELDGDNARTLADNGCRFVAEGANMPSTPEAIDVFRERGVLFGPGKAANAGGVATSALEMQQNASRDSWSFEYTDERLHRIMKNIFKSCADTAKEYGHEKNYVVGANIAGFKKVADAMLAQGVI

SEQ ID NO: 33490 - protein, 366 aa, Eurotium herbariorum
MAEFVRATIFGTTFEITSRYTELQPVGMGAFGLVCAARDQLTGAPVAVKKIMKPFSTPVLSKRTYRELKLLKHLGHENIICLSDIFISPLEDIYSVTELLGTDLHRLLTSRPLEKQFIQYFLYQILRGLKYVHSAGVVHRDLKPSNILINENCDLKICGFGLARVQDPQMTGYVSTRYYRAPEIMLTWQKYDVEVDIWSAGCIFAEMLDGKPLFPGKDHVNQFSIITELLGTPPDDVIETICSENTLRFVKSLPKRERQPLTSRFKNADPEAVDLLERMLVFDPKKRIRAGEALAHEYLAPYHDPTDEPEAQEKFDWSFNDADLPVDTWRIMMYSEILDFHNIDQSEDAGQVLVEGVGDGQQAFAA

SEQ ID NO: 33491 - protein, 196 aa, Triticum aestivum
MVVYTQEHVYRHPWDRVTAAAWRKFTDPASRTALSHVADVHTLQRRVDTDAGRLHAARSITVRSPPLPFILRRLLPAAAASPSGAAICHCVETSVVDAPRRAMDIVVRNVSLRGIIEVEERSTFRPHPDRPDDWTQFRQETTIRCRPLAKLAAVAEKVKTRCAERFLQNSAKGREVVERICRYLEAEAAGAAPSAV

SEQ ID NO: 33492 - protein, 374 aa, Arabidopsis thaliana
MTMMSDLSEDLVEEILCRVSITSLGAVRSTCKGWYVLSKTRVLCKAETKHQFLGFMKKNYKLCSMRFDLHGNFNEEGGEEFMNPSIKKSGNLLDQLDICKVFQCDGLLLCVTKEENTRLVVWNPYSGQIRWIKCNNSYHRYEGYAIGYNNNRKHKILRFSDMSFSTYKIYDFISNSWRVLDIAPNWHINPDQRGASLKGNTYFFAREKREDEEDEDILWQPVEYLLCFDFTTENFGQLHPLPFEQYIDDAGALSSFGEEKLAALFQSFASSVVEIWVTSMIEANAVSWIPFLKVDMKPHCSFRFRLPFDGGSFFIDEEKKVAVVIHVDVVAESEMNRYEDVAYIIGENGSYVPSLAQINQSVEFENEREEEEAN

SEQ ID NO: 33493 - protein, 629 aa, Oryza sativa (japonica cultivar-group)
MDAVAFPPPPAPFLDDDLDFGDFAFADPQPAAAAAFDAFGAYDDDWGDFVDSRLGSNPDGGSSAAAPAEKPPSWEKPRGPLPLSLFGADEDEEEEEGPAELPPTAADQRGASHASSNGSKPADLKDLIAGLYGSHPQPSSTDAAEVGTQEGSAVAAAEEEEEDGDGFEDDGWEFKAAAPSSSSDAVQDGGRQAHGDLTQDVPKSMSSDQEGWSLFTSVSENLNNVQTTDHVGTRESAGQSVKAFSYFPPNNAAILDLYKESEPIDAVHIMQCSSESVQSSSDMFSNTEMNSSFGTDENHSIKSASDRILIDFYHKLREESLTVISQYKKDLKESQKNSMLSDEKNEVMTETEREIQEICKELQDSSLAKGFCKDEHPSKDVCISELLNSAKEDHLKDFDKEYHLTEIIAMALEDMSSAVKLYKHSVSILRTLEIASKEEQCDYVSAWYSMLLSCAQELQHGAMIWQESCHANVGETVISQGAHYFIALGEIYRVAQILHISMLSFKPWVLADPGMLSKMLVCWNSCVNSWTSGLGMALTMVVDSKNLHAPVAKVLLESIININDIEVPNLQSFLPSDKMACKLTLLPTSLVPGMEVIIWDADHYFVKVANLWANQISSDPPQFSVSRVA

SEQ ID NO: 33494 - protein, 80 aa, Glycine max
MLSATAIGALLGLGTQMYSNALRKLPYMRHPWEHVVGMGLGAVFVNQLLKWEAQVEQDLDKMLEKAKAANERRYIDGDDD

SEQ ID NO: 33495 - protein, 538 aa, Oryza sativa (japonica cultivar-group)
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 33496 - protein, 123 aa, Triticum aestivum
LVPLYRTFIDPQRIAAFTRAPPKIFEGANVGCKFELFGGNVAGEYTELLEPTKIVQKWRLDTWPKGHFSRLEIVFDQNDIDNVTVMRVTWSGVPIGHEEVTKKNWKEYYVRSIKQTFGFGAIL

SEQ ID NO: 33497 - protein, 377 aa, Sulfolobus tokodaii str. 7
MHGLREGTKVTTEGYDEETGAITTPIYQTTSYIYPIGEKYRYSREVNPTVLKLAEKISELEEAEMGVAFSSGMGAISSTLLTLAKPGSKILIHRDMFGRTYRFFTDFMRNLGVEVDVANPGEILEMVKVKKYDIVYVETISNPLLRVIDIPALSKICKENGSLLITDATFSTPINQKPLVQGADIVLHSASKFIAGHNDVIAGLGAGSKELMTKVDLMRRTLGTSLDPHAAYLVIRGIKTLKIRMDVINSNAQKIAEYLQEHNKIKSVYYPGLKSHPDYETARRILKGYGGVVTFEIKGSMNDALNLITRFKVILPAQTLGGVNSTISHPATMTHRTLTPEERKIIGISDSMLRLSVGIEDVNDLIEDLDKALTSLN

SEQ ID NO: 33498 - protein, 391 aa, Prosthecochloris aestuarii DSM 271
MGLWRLNPVKEAVRFFSRISGGCRSNAIVLAGINLSQGVCDTPVPGVVLEGASHALSQRQNSYTHYAGIGGLREALAEKYRTMYGIDVDPQQEIVVSAGATGAMYCAFQALLNPGDEVIVFEPYYGYHISTLNALQAVPVFLSLTSPDWTFSEADLEAAVSSRTRAILINTPGNPSGKVFTLAELQRIADFAEEHDLFVFTDEIYEHFLYDGRRHHSPFALPGMRKRTVLISGFSKTFSVTGWRIGYAISDARWAQAIGYFNDLVYVCAPSALQPGVAAGLATLDTSYYLSLSAEYGFKRNRFCRALGEAGLNAVLPQGAYYVLADVSHLPGSTTRDKAMHILRTTGVASVPGSAFFRNENDQHLVRFCYAKDDVVLDAACERLMKLKEMD

SEQ ID NO: 33499 - protein, 372 aa, Idiomarina baltica OS145
METIKSRAAVAWGPGEPLKMEEIDVAPPKKGEVRVKIIATGVCHTDAYTLSGADPEGIFPAVLGHEGGGIVESVGEGVTSVEVGDHVIPLYTAECGECKFCTSGKTNLCQAVRATQGKGLMPDGTTRFSKNGEPIYHYMGTSTFSEYTVLPEISVAKIPKEAPLEKVCLLGCGVTTGMGAVKNTADVQEGDTVAVFGLGGIGLAVIIGAVQAKASRIIAIDVNEDKFEIAKQLGATDFVNPTDYDKPIQEVIVDMTDGGVDFSFECIGNVEVMRSALECCHKGWGESVIIGVAGAGEEISTRPFQLVTGRVWRGSAFGGVKGRSQLPDYVQQYMDGKFDLDTFITHNMSLEEINEAFELMHEGKSIRSVIHY

SEQ ID NO: 33500 - protein, 189 aa, Brassica napus
MSGRDRISGLPESLLTQILSHLPTKQSVQTSVLSKRWENVYLSVPGLDLDCSVLPNYDADEGLLSFLTFIDKLLEFSPELSLFKVKIKCRNTMIDGFTDRIGTMIDRGTQHLDVVSSTDYYEDTLSDLLPVVDFMPMNLLTSKTLVYLKLSSSGLMDPGFVSMPCLRFLHLEEVNGLCIWRACVGMFCA

SEQ ID NO: 33501 - protein, 293 aa, Bacillus licheniformis ATCC 14580
MSKICVIGSSSMDLVVTSPKRPAAGETVLGESFKTVPGGKGANQAVAAARLGAEVHMIGCVGDDHYGKAILDNFQANGVLTDYVEPVTGQESGTAHIVLADGDNSIIVVKGANDHVTPEYVQKALPAIKQADIVLIQQEIPEETVDYVSGLCSSLGIPLLLNPAPARPLRPETVEHAAYITPNEHEASVLFQGMSREEALKRYPEKLFITEGKNGVRYHNGLEERVVPSFPVNAIDTTGAGDTFNAGFAVALSEGQSIESALRFANRAASLSVLKFGAQGGMPKRDEVERELS

SEQ ID NO: 33502 - protein, 123 aa, Zea mays
  misc_feature (15)..(15): Xaa can be any naturally occurring amino acid
  misc_feature (25)..(25): Xaa can be any naturally occurring amino acid
  misc_feature (30)..(32): Xaa can be any naturally occurring amino acid
  misc_feature (39)..(39): Xaa can be any naturally occurring amino acid
  misc_feature (49)..(49): Xaa can be any naturally occurring amino acid
  misc_feature (57)..(57): Xaa can be any naturally occurring amino acid
  misc_feature (60)..(60): Xaa can be any naturally occurring amino acid
  misc_feature (63)..(65): Xaa can be any naturally occurring amino acid
  misc_feature (68)..(68): Xaa can be any naturally occurring amino acid
  misc_feature (80)..(80): Xaa can be any naturally occurring amino acid
  misc_feature (86)..(86): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(98): Xaa can be any naturally occurring amino acid
EEVIIPNGEGVNVEXFLGWRARFEXELPFXXXKIIPDPXFKPLKEKKIXGRQYFESXRHXVKXXXKVXDEDEEEEEDIEXDDDFEXDEEEMXEXYXXXKLEGYFSPKKVFWGSLRNPNVVICS

SEQ ID NO: 33503 - protein, 427 aa, Oryza sativa (japonica cultivar-group)
MRCLPFLHGDSKEEDPVNKSASVRSLSTTSTERDVRSGSDFNSLNVSDMSAESIRRTQYPSFTDRPSNLRVFSFSELKNATRNFSRSLMVGEGGFGCVYRGVIKNSDEPTERTEIAVKQLNRKGLQGQKEWLTELNVLGIVEHPNLVKLIGYCAEDDERGVQRLLVYEYMPNGSVDDHLSSRSNSTLSWPMRLKVALDAARGLKYLHEEMEFQVIFRDLKTSNILLDENWNAKLSDFGLARHGPSEGLTHVSTAVVGTLGYAAPEYMQTGRLTAKSDIWGYGVLLYELITGRRPIDRNRPKGEQKLLDWVKPYISDIKRFPIIIDPRLEGHYNLKSMTKLASVANRCLVRLPKSRPKMSEVYEMVQKIVASIETGTPQPPLHYHGSVSEPGSKRPKKGSLKRRFQEFKFGCRQIVWRSWKPEIIKTC

SEQ ID NO: 33504 - protein, 388 aa, Arabidopsis thaliana
MMMPHLSEDLVEEILSRVPAISLKRLRYTCKQWNALFNDQRFSKKHRDKAPKTYLGLTLKDFRIYSMSSNLHGLLHNNNIDLLMEFKGKLSSLNDLNDFEISQIYPCDGLILCSTKRNTRLVVWNPCTGQTRWIKRRNRRMCDTFAFGYDNSKSSCLNNYKILRVCEKIKGQQFEYEIFEFSSNSWRVLDVNPNCIIEGRSVSVKGNSYWFATITKTHYFIRRFDFSSETFQKLPLPFHIFDYNDSRALSAFREEQLSVLHQSFDTEKMDIWVTNKIDETTDWSWSKFFTVRLINRLDYPISMMMKSPLSFFIDEKKNIILCYDKHRENTYKSLVLIVGKDKVYREFYFPESYELGRTYLCNYVPSLVQIKQSGLISTRKRKRKDFSS

SEQ ID NO: 33505 - protein, 129 aa, Corynebacterium efficiens YS-314
MSHDPTPISDNPAEFTLDPVIAARLKLNDAGLIPAVVQAVDTREVLMMAWMDTHALAYTLATRRGTYYSRSRDEYWIKGLTSGNVQEVTDVALDCDGDTVLVTVHQTGGACHTGARTCFDADPLLGPGQ

SEQ ID NO: 33506 - protein, 331 aa, Zea mays
NEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQGAQEAEGHLLGSESVLVLPTKDASLYCGLLRNFEGLVKRPHGSIISLMAVLYCTTASVFAGKEKMEPGQSGTEQASPRGNDWEVVQLTASAYAAAPAPRKPEPSDEAEAKRYGAKGDDLAAGLPHVRPLLRVSERGREPPRRRRHQRTTAQGQGGALRAY

SEQ ID NO: 33507 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKRGQTSTLANELSAALLGLFWQQRGWLAHDFLHHQVFQDRFWGDLFGAFLGGDCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFPSMPRHNFSKIQPAVETLCKKYGVRYHTTGMIEGTAEVFSRLNEVSKAASKMGKAQ

SEQ ID NO: 33508 - protein, 202 aa, Schizosaccharomyces pombe 972h-
MLQTLIGVHSYMPWCYEIPAMAIFLRSTITLPIAIASLKTARRFVQVQPLIKEAKKRCRTNTDFRTVRKKLYKRFNCHPLMIYALPITQLPLFAFASYQLRQAVDVCPESMSTEGMLWFTDLTLPDPHGVLPAVLAVTYLTNMSILKRPSDSRLLKIFNTAGIMSAFFVSFMAFKTSTALSLYWTTSAIYSLVQNVALRKLL

SEQ ID NO: 33509 - protein, 397 aa, Triticum aestivum
  misc_feature (293)..(293): Xaa can be any naturally occurring amino acid
  misc_feature (305)..(305): Xaa can be any naturally occurring amino acid
MASSPPLKKVLVPIANGTEPMEAVITIDVLRRAGADVAVASVEPGAAQVAASWGVKLAADALLADLAEADFDLISLPGGMPGASTFGDCKILENIVKKHAEKGKLYAAVCAAPAVALGAWGLLNGLKATCHPSVMDKLPSEVQAVESRVQIDGNCVTSRGPGTTMEYSVVLVEQLYGKEKADEVAGPMVMRPQHGAEFSMKELNSTSWNAGENPQILVPIANGTEEMEAVMIIDILRRAKANVVVASLEGTLEIVASRNVKMVANVLLDDALKQQYDLILLPGGLGGAQAYAXKSDKLIGFIKKXQAEANKLYGAICASPAIALEPHGLLKGKKATSYPAMWSKLTDQSECKNRVVVDGNLITSQGPGTSMEFSLAIVEKLFGRERALELAKSMVFV

SEQ ID NO: 33510 - protein, 309 aa, Glycine max
MAQQEVVEGFKFEQRHGKERVRVARVWKTRQGQHFVVEWRVGITLFSDCVNSYLRDDNSDIVATDTMKNTVYAKAKECSDILSAEDFAILLAKHFVSFYKKVTGAIVNIVEKPWERVIVDGQPHEHGFKLGSEKHTTEAIVQKSGSLQLTSGIEGLSVLKTTQSGFVNFIRDKYTALPDTRERILATEVTALWRYSYESQYSLPQKPFYFTEKYQEVKKVLADTFFGPPNGGVYSPSVQNTLYLMAKATLNRFPDIAYVSLKMPNLHFLPVNISNKDGPIVKFEDDVYLPTDEPHGSIQASLSRLWSKL

SEQ ID NO: 33511 - protein, 357 aa, Mortierella alpina
FVPDHPGGSVILTHVGKDGTDVFDTFHPEAAWETLANFYVGDIDESDRAIKNDDFAAEVRKLRTLFQSLGYYDSSKAYYAFKVSFNLCIWGLSTFIVAKRGQTSTLANELSAALLGLFWQQRGWLAHDFLHHQVFQDRFWGDLFGAFLGGDCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMMVYFLVSQAVCGNLLAIVFSLNHNGMPVISKEEAVDMDFFTKQIITGRDVHPGLFANWFTGGLNYQIEHHLFP

SEQ ID NO: 33512 - protein, 309 aa, Glycine max
MAQQEVVEGFKFEQRHGKERVRVARVWKTRQGQHFIVEWRVGITLFSDCVNSYLRDDNSEIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 33513 - protein, 437 aa, Saccharomyces cerevisiae
MAVSKVYARSVYDSRGNPTVEVELTTEKGVFRSIVPSGASTGVHEALEMRDEDKSKWMGKGVMNAVNNVNNVIAAAFVKANLDVKDQKAVDDFLLSLDGTANKSKLGANAILGVSMAAARAAAAEKNVPLYQHLADLSKSKTSPYVLPVPFLNVLNGGSHAGGALALQEFMIAPTGAKTFAEAMRIGSEVYHNLKSLTKKRYGASAGNVGDEGGVAPNIQTAEEALDLIVDAIKAAGHDGKVKIGLDCASSEFFKDGKYDLDFKNPESDKSKWLTGVELADMYHSLMKRYPIVSIEDPFAEDDWEAWSHFFKTAGIQIVADDLTVTNPARIATAIEKKAADALLLKVNQIGTLSESIKAAQDSFAANWGVMVSHRSGETEDTFIADLVVGLRTGQIKTGAPARSERLAKLNQLLRIEEELGDKAVYAGENFHHGDKL

SEQ ID NO: 33514 - protein, 545 aa, Zea mays
MYTLPVRATTSSIVASLATPAPSSSSGSGRPRLRLIRNAPVFAAPATVCKRDGGQLRSQTREIERERKGGHPPAGGHKRGGERGQRRGGEEEEDEQLPLPSEKKGGASEGEAVHRYPHLVTPSEPEALQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHSHFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAAYTFHFVEDWVKIGFIAKMKVKKEHASVPFDDQCSILEKEAVNVSLENLKTYPFVKEGLANGTLKLIGAHYDFVSGEFLTWKK

SEQ ID NO: 33515 - protein, 335 aa, Arabidopsis thaliana
MAPEINTKLTVPVHSATGGEKRAYVTFLAGTGDYVKGVVGLAKGLRKAKSKYPLVVAVLPDVPEDHRKQLVDQGCVVKEIEPVYPPENQTEFAMAYYVINYSKLRIWEFVEYNKMIYLDGDIQVFDNIDHLFDLPNGQFYAVMDCFCEKTWSHSPQYKIGYCQQCPDKVTWPEAKLGPKPPLYFNAGMFVYEPNLSTYHNLLETVKIVPPTLFAEQDFLNMYFKDIYKPIPPVYNLVLAMLWRHPENIELDQVKVVHYCAAGAKPWRFTGEEENMDREDIKMLVKKWWDIYNDESLDYKNVVIGDSHKKQQTLQQFIEALSEAGALQYVKAPSAA

SEQ ID NO: 33516 - protein, 375 aa, Trichophyton rubrum
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIIFETFNAPAFYVSIQAVLSLYASGRTTGIVLDSGDGVTHVVPIYEGFALPHAISRIDMAGRDLTDYLMNILAERGYSFSTTAEREIVRDIKEKLCYVALDFQEEIQTAAQSSSLEKSYELPDGQVITIGNERFRAPEALFQPSVLGLEPCGIHVTTYNAIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 33517 - protein, 224 aa, Synechococcus sp. CC9311
MSNVQSCFMGMFKPSKSMKKQAFQGRYRALIPVANGNEDLEVIAMIDVLRRADIDVVIASVNNEETVTLMKGSRLVVDEPLVNVVHQQWDLIAMAGGIPGAMNLAASTLLRERLRLQHKNKGIIGAICLSPALVLKPAGVLDEMKIVTGNPLAIKTPEQSWPADHFTSILGDRFDATFRVISDEEQQIVLSQTPGTAIEYAIAMVKMLCGEERANAIINYFLVR

SEQ ID NO: 33518 - protein, 242 aa, Bradyrhizobium sp. BTAi1
MRAHQIMTRPVITVTPDTSIVEAANIMLQRHVSGLPVVDASGKLIGVVSEGDFIRRTEIGTGRKRGRWLRFILGPGKSAADFVHEHGRKVSEVMTKSPLTITEDAALAEIVEIMEKNHVKRLPVVKGDQVVGIVSRANLLQAVATLGRQVPDPTADDDHIRNRVIDNLEKNDWCPFGLSVIVKDGIVHLSGVITEERSRQAAIVATENVAGVKKVHDHLCWVDTMSGMYLNSPEDEEMAKAS

SEQ ID NO: 33519 - protein, 244 aa, Zea mays
  misc_feature (152)..(152): Xaa can be any naturally occurring amino acid
MKQEAATSIVVTQEDVLHHYKEPPPRREDDPPALAASLSLPSSLSEDDGDAMPQPSSYAVLPRREGELVSAEELLLVPPLNFAMVDHGVYRSGFPDASNLPFLETLRLRSVLCLCPEPYPEANLEFLRAHGIKLFQFGIDGSKFWTFDTEIXEPFVNIPEDRIREALEVILDASNHPVLIHCKRGKHRTGCVVGCFRKLQRWCLTSIFDEYQRFAAAKTRVSDLRFMELFDVSSIKHLAFESSV

SEQ ID NO: 33520 - protein, 200 aa, Synechococcus sp. CC9311
MSSKLRLGVAGPVGSGKTALVQALCRRLRDRLQLAVVTNDIYTQEDAQFLTRSGALEPERIRGVETGGCPHTAIREDCSINRAAVSELEHQFPGLDLVMVESGGDNLAASFSPELVDLCIYVIDVAAGDKIPRKGGPGITRSDLLVINKIDLASFVGADLGVMEQDTLRMRRNRPWCFTNLRTEEGLDRVEEFVLQQIPN

SEQ ID NO: 33521 - protein, 239 aa, Zea mays
MDATLLLLPANCTAAASGRMRPRLPAGPHVASPGPSARPRTSIRASAVSAALAVRGLPQHASVAGQSTGSYRVGDVMTKREELHVVKPTTSVDDGALFLICCTCLPYFRSVERDHSILLFFAALEMLVKHRISGFPVIDDDWNLVGVVSDYDLLALDTISGAGPAEADIFPEVDSTWKTFHEIQKLLSKTNGKVIADVMTPAPLVVRETTNLEDAARLLLVTKYRRLSVVDSSGKLVGI

SEQ ID NO: 33522 - protein, 108 aa, Brassica napus
MQQAYEQALDEEAGYDDYYSDDNGLDEYDEEEEEEVPPKEEVEYLELRQRIKESIRKKSGSGGVNAQSSQDRRKKQLPYNDFGSFFGPSRPVISSRVIQESKSLLENE

SEQ ID NO: 33523 - protein, 110 aa, Paxillus involutus
MPAEDIKSKAHFDELINSGKTIFIDFHATWCGPCKVISPLFQKLSNEHQGDNVAFYKVDIDDQAEIAQEVAITAMPTFKVYKDGALVGNLIGANQSRLTELVGEHAPKTV

SEQ ID NO: 33524 - protein, 476 aa, Campylobacter jejuni subsp. jejuni NCTC 11168
MGKFVNNIDDFFKFCKQNEVLFVDFRFTDMIGTWHHITYNLHAINEETFQTGIPFDGSSIHGWQPIEKSDMILKPDAQSAFLDPFTADPTIIVFCDVYDIYKGQMYEKCPRSIAKKAIEHLKNSGIADTAYFGPENEFFVFDSVKIVDTTHCSKYEVDTEEGEWNDDREFTDSYNTGHRPRNKGGYFPVQPIDSLVDIRSEMVQTLEKVGLKTFVHHHEVAQGQAEIGVNFGTLVEAADNVQIYKYVVKMVAHLNGKTATFMPKPLYGDNGNGMHVHMSLWKNGVNLFYDKDGYSGLSQTAINYIGGILKNARSVAAFTNPSSNSYKRIVPGFEAPCILTYSCQNRSASCRVPYGIGKNSARIEIRFPDSTANPYLAFVSLLMAGLDGIKNKTIPVGPMDENLFDLTLDEIREKGIEQLPHTLRGSLEALIRHNSYLKPVMSDIFIDDYQHLKFETQVWPVEARPTAYEFKTCYSC

SEQ ID NO: 33525 - protein, 272 aa, Shigella flexneri 2a str. 2457T
METYAVFGNPIAHSKSPFIHQQFAQQLNIEHPYGRVLAPINDFINTLNAFFRAGGKGANVTVPFKEEAFARADELTERAALAGAVNTLKRLEDGRLLGDNTDGVGLLSDLERLSFIRPGLRILLIGAGGASRGVLLPLLSLDCAVTITNRTVSRAEELAKLFAHTGSIQALGMDELEGHEFDLIINATSSGISGDIPAIPSSLIHPGIYCYDMFYQKGKTPFLAWCEQRGSKRNADGLGMLVAQAAHAFLLWHGVLPDVEPVIKQLQEELSA

SEQ ID NO: 33526 - protein, 156 aa, Fragaria x ananassa
MASRSTASLALFLVVNLLFFTMVANACNTCPRPKPKPRPRPRPTPSPGTPSTPSPGTPSTPGTPSTPSGTATCPRDALKLGICANVLNNLLNVTIGTPPVQPCCTLIQGLADLEAAVCLCTAIRASILGINLNIPIALSLLLNACGNQVPRGFQCS

SEQ ID NO: 33527 - protein, 202 aa, Corynebacterium efficiens YS-314
MTTAPRIGRATRTTSESDITVEINLDGTGTVDIDTGLPFFDHMLTAFGVHGSFDLTVHAKGDIEIDAHHTVEDTAIVLGQALLDAIGDKKGIRRFASCQLPMDEALVEAVVDISGRPYFVINGEPDHMISAVIGGHYATVINEHFFETLALNSRITLHVICHYGRDPHHITEAEYKAVARALRAAVEMDPRQTGIPSTKGAL

SEQ ID NO: 33528 - protein, 861 aa, Medicago truncatula
MFSGVTGILNRGHKIKGTVVLMRKNVLDINSLTSVGGVIGQGFDILGSTLDNLTAFLGRSVSLQLISATKPDANGKGKLGKATFLEGIITSLPTLGAGQSAFKIHFEWDDDMGIPGAFYIKNFMQTEFFLVSLTLEDIPNHGSIYFVCNSWIYNAKHHKLDRIFFANKAYLPSETPAPLVHYREEELNNLRGDGTGERKEWERIYDYDVYNDLGNPEKGDNHARPVLGGSDTYPYPRRGRTGRKPNPKDPKSESRSDFVYLPRDEAFGHLKSSDFLTYGLKAVSQNVVPALESVIFDLNFTPNEFDSFDEVHGLYEGGIKLPTDVLSKISPLPVLKEIFRTDGEQFLKYPPPKVLQVSRSAWMTDEEFAREMLAGVNPNVICCLQEFPPRSKLDSQVYGDHTSKITKEHLEPNLEGLTVEEAIQNKKLFLLDHHDSIMPYLRRINSTPTKAYATRTILFLSSDKTLKPLAIELSLPHPDGDEHGAVSHVYQPALEGVESTIWLLAKAYVVVNDSCYHQLVSHWLNTHAVVEPFVIATNRHLSYLHPIYKLLYPHYRDTMNINSLARQSLVNDGGIIEKTFLWGRYSMEMSSKVYKNWTLPGQALPADLIKRGMAIEEPSSPCGVKLVVEDYPYAHDGLEIWAAIKTWVQDYVSLYYTTDDILRQDSELQAWWKELVEVGHGDKKNEPWWPKMQAREELVEVCTTVIWIASALHAAVNFGQYSYGGLILNRPTLSRRFMPEKGSAEYNELVKSPQKAYLKTITPKFQTLIDLSVIEILSRHASDEVYLGERDNPNWTSDTRALEAFKKFGNKLAEIEKNLAQRNNDEKLRHRLGPVQMPYTLLHPSSEEGLTFRGIPNSISI

SEQ ID NO: 33529 - protein, 863 aa, Medicago truncatula
MFPNVTGILNRGHKIKGTVVLMRKNVLDFNTIVSIGGGNIHGVIDTGLNLIGSTVDGLTAFLGRSVSLQLISATKSDANGKGKVGKDTFLEGILASLPTLGAGENAFNIHFEWNDEMGIPGAFYIKNYMQVEFYLKSLTLEDVPNHGTIRFVCNSWVYNAKLYKSPRIFFANKSYLPSETPSPLVKYREEELQNLRGDGTGERKLHERIYDYDVYNDLGNPDHGESFARPVLGGSSTHPYPRRGRTGRYPTRKDPNSEKPATEIYVPRDENFGHLKSSDFLTYGIKSVSQNVLPAFESAFDLNFTPREFDSFQDVRDLFEGGIKLPLDVISTISPLPVIKELFRTDGENVLKFPTPHVVKVSKSAWMTDEEFAREMLAGVNPCMIRGLKEFPPKSNLDPTVYGDQTSKITADALELDGSTVDEALAGGRLFILDYHDTFIPFLRRINETSAKAYATRTILFLKEDGNLKPVAIELSLPHPDGDKSGVVSQVILPANEGVESTIWLLAKAYVVVNDSCYHQLMSHWLNTHAVVEPFVIATNRQLSVIHPIYKLLSPHYRDTMNINALARESLINANGIIERTFLPSKYAVEMSSAVYKNWVFPDQALPADLIKRNMAVEDPSSPYGLRLLIEDYPYAVDGLEIWTTIKTWVQDYVSVYYATDNDIKNDSELQHWWKEVVEKGHGDLKDKPWWPKLQTLEELVEACTIIIWTASALHAAVNFGQYPYGGFILNRPTISRRLLPEEGTAQYDEMVKSPQKAYLRTITPKFQTLIDLSVIEILSRHASDEVYLGQRENPHWTSDSKALQAFQKFGNKLAEIEAKLAKKNNDPSLNNRLGPVQLPYTLLHPTSEEGLTFRGIPNSISI

SEQ ID NO: 33530 - protein, 124 aa, Schizosaccharomyces pombe 972h-
MASNPPQPQGPALTAHILNTMSGIPAAGVQVALFKLNESPTPSQQFIATTETNANGRVTSWNVDLSTVESGIYTFRFETGAYFDSLGVTSFYPYVEMAVRINKGQHYHIPLLLAPYGYTTYRGS

SEQ ID NO: 33531 - protein, 422 aa, Arabidopsis thaliana
MRRTRCSWCFMSRESSTSGHKQVCTTRNGWTAFVKRVSMASGAIRRFQERVLGPNRTGLPSTTSDVWLLGVCYKISADENSGETDTGTVLAALQLDFSSKILMTYRKGFEPFRDTTYTSDVNWGCMIRSSQMLFAQALLFHRLGRAWTKKSELPEQEYLETLEPFGDSEPSAFSIHNLIIAGASYGLAAGSWVGPYAICRAWESLACKKRKQTDSKNQTLPMAVHIVSGSEDGERGGAPILCIEDATKSCLEFSKGQSEWTPIILLVPLVLGLDSVNPRYIPSLVATFTFPQSVGILGGKPGASTYIVGVQEDKGFYLDPHEVQQVVTVNKETPDVDTSSYHCNVLRYVPLESLDPSLALGFYCRDKDDFDDFCLRALKLAEESNGAPLFTVTQTHTAINQSNYGFADDDSEDEREDDWQML

SEQ ID NO: 33532 - protein, 422 aa, Arabidopsis thaliana
MALSKNSNSNSFNKKKVSYISVPSQIINSLSSSSLQSLLVSPKKSSRSTNRFSFSYRNPRIWFFTLFLVSLFGMLKLGFNVDPISLPFSRYPCSTTQQPLSFDGEQNAASHLGLAQEPILSTGSSNSNAIIQLNGGKNETLLTEGDFWKQPDGLGFKPCLGFTSQYRKDSNSILKNRWKYLLVVVSGGMNQQRNQIVDAVVIARILGASLVVPVLQVNVIWGDESEFADIFDLEHFKDVLADDVHIVSSLPSTHVMTRPVEEKRTPLHASPQWIRAHYLKRINRERVLLLRGLDSRLSKDLPSDLQKLRCKVAFQALRFSPRILELGNKLASRMRNQGQYLSLHLRMEKDVWVRTGCLPGLTPEYDEIVNSERERHPELLTGRSNMTYHERKLAGLCPLTALEVTRYYTNSMNKSFCLCFFK

SEQ ID NO: 33533 - protein, 726 aa, Aspergillus oryzae
MATPSAVRLLAIRPVIVGFAKLLMLALGGLPLVSAAPATYIAYSEESPKAPNDPDLWLYLGVAAILVLSGGAFAGLTIALMGQDEVYLQVIKTSGEGSERKNAESVLKLLKRGKHWVLVTLLLSNVITNETLPIVLDRSLGGGWPAVLGSTVLIVIFGEVVPQSICVRYGLPIGAWMAPCVLALMYIMAPVAWPIAKLLDRLLGEDHGTIYKKAGLKTLVTLHKTLGEAGEQLNSDEVTIISAVLDLKDKPVGSIMTPMDDVFTMSADTVLDEDTMDLILSQGYSRIPIHAPDNPTNFVGMLLVKMLITYDPEDCRRVREFALATLPETRPETSCLDIVNFFQEGKSHMVLVSEYPGEDRGALGVVTLEDVIEELIGEEIVDESDVFIDVHKAIRRMTPAPIKSRVPKGKIVEEPPSLPPQKTGTLVDVDGEPQVSKPPANVRRRSSVEPPLPRFQLRMPQSDRNSDSTDGLVTKRGTTDEIREHLKHLGPSNLASRPRQTRYQNVKIKRASVSPTRSAQTDMDSGHSMSGSQALHPNSTALPGGIGEGLVQPGLDARDGAYAVRVGYGTMSGPKPADAGTQTVGKDVSIPEAVHEEQDEPPRPPGSAAISVNSESSNSQKFKPTSYQHQGPARSGSITEHVVDVNGIRKVVLHTTSTSSSDHEGRTSPKSKFPVRQDGEVVDLNGKRSDGTQGDGTKKRRRRRKRGQASKHADNHVDEESPLLPQ

SEQ ID NO: 33534 - protein, 414 aa, Debaryomyces hansenii CBS767
MRFIRSFIPGIRCSNSLIFKRRASIDYLVSSLNRAEETNKEEHPSQKCNINILKPSEIPPKDSTKLVISPNELTDHFRYKEYPKPTRRQISETQALFNNSSFKLEWTLDKYDEIPYMRYKRLKEEKTEKLSKVEPYRKTEYHLTQLNSKKTFGIQPEHLKPMPEVLLLGNTNVGKSSLINSLLVNREENKSANLSTEHAFVSKRAGYTKTLNCFNIGNKLRIMDSPGYGEFGELSQGEVITDYITKGQSLRRVFVLIDSVKGFQEEDLHIIDFLISEGISFDLIFTKVDQVIQKFMPKKLINSKHANKPKSVEERVNNATLIKQCNKKVIDYFGSMIEESNMSNLVTLPKLFFNNVQTNKFVPGRQGYKEIRYEILLSCGLVKEDTVGSGAAIQEETMMKQNALRRKTKVQRLM

SEQ ID NO: 33535 - protein, 215 aa, Debaryomyces hansenii CBS767
MNRGRGGFRGGRGGRTGPSQFQQGPPDTVLEMGAFMQSCEGDIVCRSINVKIPYFNAPIYLENKTQVGKVDEILGPVNEVFFTIKPSEGVQADSFKDGDKFYIGPDKLLPLERFLPKPKEFGTKPKKKSAGGAGRGGFGGRGGARGGRGGFGGRGGSRGGFGDRGGRGGSRGGFGGRGGSRGGFGDRGGFGGRGGSRGGFGDRGGRGGGFRGGRF

SEQ ID NO: 33536 - protein, 373 aa, Mycobacterium avium subsp. paratuberculosis K-10
MTKPLTDTAPVDPGAQRGSMPLTNRIQGAVTSVGVKVIPWIPTAVRRGLVRGRSVIIDGNTLDPTLQLMLSGLRAVGIDGLVVDDDPELSRAQMHESTVGFPGPQIHVDVAELALPGPAGDIPARHYRPAGGETQAPLLVFYHGGGWSIGDLDTHDSLCRLTCRDAGIHVLSIDYRLAPEHPAPAAIDDAYAAFTWAHEHAGELGAIPGRVAVGGDSAGGNLAAVVSQLARDAGGPAPVLQWLIYPRTDFTARTRSLSLFSRGFLLTKRDIDWFESQYLRNSRLDRTDPRVSPALAESLAGLAPALIAVAGFDPLRDEGQSYAEALRAAGTPVDLRYLGSLTHGFANLFQLGGDSMVATSELISALRAHLSRV

SEQ ID NO: 33537 - protein, 366 aa, Zea mays
  misc_feature (150)..(150): Xaa can be any naturally occurring amino acid
  misc_feature (187)..(187): Xaa can be any naturally occurring amino acid
  misc_feature (204)..(204): Xaa can be any naturally occurring amino acid
  misc_feature (225)..(225): Xaa can be any naturally occurring amino acid
MPLRPLPVCTASINQQARSISHLTPPLPLQNLSIPRLAIHPSRIYTTGKSLLQKSLGQPGPPFSRHFHNTTSLQTAKTMTDTNVEAAKRAAAQQAVADHFDPAATHVGIGSGTTIVYVVEAIKQRSTNPNILFVPTGFQSRQLVVNAGLXLPSPLTVSPTTARPDVAFDGAREVDAELNCIKGGGAXCLFQEKLVAERARKFVXCVADYRKRQNRLLTNWPTIPXIRSRPLSQLKVAGALRMLGSTGPKLRTTLLEKSGPLKTDQDFYIIDAPFPPLLTSADVAAGKGKGDGTDGTWEVNTLSRAIKGLTGVLEVGIFSGLNGIDAQALREQDQSMKTVRGGQKPVAVYFGMQDGSIKVRTIEGET

SEQ ID NO: 33538 - protein, 469 aa, Pseudomonas fluorescens Pf-5
MSQIEDTTVPAQSTADAAQPQLKAARPLAANIKIKDGFPVMPGKIPLLGHVHKIGKDALGELRQAEAACGPMFWTYFGSQLPVLQIVDEAGLAILQNKYTDNSFLREQMPVITGEAMNAFDGPRHRNARKASTDAFTPKGLTRAKVGQFIMETIDQRLKHWSRENQLAIFPQTKDIALEVVFRILGIATHELELWRHQYEEFFLGMIPLKINLPGFPAWRCRKARGWLEQRVAQIVATTRANNDHDSLVGAMILGRDEQGNGLSEVELVHNILGLGFAGSETTAAVMAWSALMLSQHPDVWQQLCEQVAGLESLPVTHEELVRQVPLAEGIFRETMRLYPPAPFEMRKVHTEFELLGQRIPAGVMAGVSLLHVSRNPERYPDPDSWRPERWLGLDRALNQVETCQFGGGPHACLGRHVAALEITLFIAMLARELGPKGNVPRLVGKMPPPAYLPFLRPSNKAFLDFSGA

SEQ ID NO: 33539 - protein, 721 aa, Oceanobacillus iheyensis HTE831
MTDSIIAWYDDVHRLIIEHPSSNFLNKPNTPVRITERSTNTHYYNANINHRDEKEIIVELDNPLPIGRDLVLVWNELEIPIYTRKITRTKWFEDNFFTNRKLGAFCNNKSTSFSIWSPVATAVHLQIKNNFYLLDRNQDGSWSISLDGDFHRTTYIYQITINDFTQEVIDPYAKSVTANSTEGVIIDLNRTNALNHQRPNKITKFQDAIIYELHLRDLSTHENSGINNKGNYLGLTESNTVTNLGYSTGRCYINELGITHVQLLPVNDFARVDDLHPNNSYNWGYDPLFFQAPEGSYSSNPTNPLSRINELKSCIDSCHEDNLSVILDVVYNHVFQIDHSSFEKMVPGYFFRYHDNGELSNGTGVGNDFASEKLMARKFILDTIDYFLNEYNVDGFRFDLMGAIDVTTMQEIQKRCQKEKEFILLLGEGWDLPTALPANQKSTPNQAHELTGIAFFNDFFRDTLKGNLFAADSKGYVNGEGMHVEHLPHLVTGCVLSKYGIPFAENPGQIVNYVECHDNHTLWDRLSITNSHFTVDERKKTHQLATAITILSQGIPFLHAGQEWYRTKHGDENSYQSGDNINQLNWSQRETEEESIAFVRTLIELRKRYPVFRLPSVEDINNYVHILPTIHPVFGYTLLDNDADITIYINPTNTCYDLQLPSSANWKVAVSNEFIKRNEQVVIGEQTTLHPYEILVLVKQRSHQKAKNHAIKSYVSQEKGQ

SEQ ID NO: 33540 - protein, 385 aa, Oceanobacillus iheyensis HTE831
MSECIGMLLAGGEGKRLGMLTKQGAKPAVPFGGKYRIIDFTLSNCTNSGIQTVGILTQYAPLELNKHIGNGKPWDMNHQHGGVSILPPYTGTKGGDWYSGTADAIYQNMNFIHQYEPEYVLIISGDHIYQMDYQQMLEQHKRTNADVTISVIEVPWAEAGRFGILHANDEQIIYEFEEKPKNPSSNLASMGIYIFNWKTLKKYLIEDANKPNSSRDFGKDIIPSMLNNQHRLYAFKFNGYWKDVGTIQSYWEANMDVLKDNNGYFSLHDRNWRIYTHDSNLPPHFIGTNGKAVNSYINSGSIIYGHIKNSIVFRNVSVQQGSYINQSIIHPNVKIGKDCVLDRVIVMENTTIPEGTIFRSDKEIEPFIINNEILNSMLAPAGGDV

SEQ ID NO: 33541 - protein, 368 aa, Oceanobacillus iheyensis HTE831
MERMMGLVNLEHEHHLLNELAYFRNPASIPFGGRYRLIDFTLSNMVNSSIQEVAIFVRNKYRSLLDHIGTGENWELDRRNGGLFILPPDWNDPTDRSRGDLKFFHNNRDYFNRSNSKYVLISGSQFISNTDYKEALEQHIKEQADVTLITVREEELSNEHESNLRVECDYIHRVQALTNDKNNPEIFTGVYIINKDLLIELVDNCIAYHKDHFFHAAIMERLGDLRVFRFRQEGYHAFINSVESFYKHNMKLLQEDSYQQLFLNNHFVRTKISNNAPVKYGEKAEVVNTLVANGCKVNGCIEGSILFRGVQLHEGATVKNSIIMQRCTIGSGVHLENVILDKDVVVTTGQRIIGSKEKPYVVAKRQVI

SEQ ID NO: 33542 - protein, 316 aa, Frankia sp. EAN1pec
MTFALDPQLAAVIGPFLAAVPEVEPPPAGDWKARRVSVEAALAQMIAALPAPEDVATTDYEINSHDGAIIALRWYTARESMPGTAVLYFHGGGMILGSVGLYDPWVARYVSATGVPMLSVEYRLAPEHPHPTPVEDCYAALRWLADHAVELGVDPARIAVMGDSGGGGLAAAVALLARDRGGPALARQILIYPMLDDRNTTPDPAIAPFAGWNYDDNITGWGALLGMARGGPDVPPYAAPARADDLTGLPPAYVEVGELDIFRDESIEYARRLAMAGVSIELHVHPGAPHGFDALGPETDIGQRATADRVRVLTGL

SEQ ID NO: 33543 - protein, 422 aa, Streptococcus thermophilus
MTVTIENIHAREIFDSRGNPTVEVDVRLTDGTLGRAAVPSGASTGDREAVELRDGGARLQGKGVSKAVANVNGEIYEALKGQSPFNQAKLDHLMIELDGTENKSCLGANAILGVSMAIFRAAANSEKIPLYRYFGGVDLELPQPFFNVINGGVHADSGIDVQEFLITPVKRDSFRDGLKKIANIYHTLKKILSDKGLKTPVGDEGGFAPKLGTTENAIAILYQPIDSAGYFPGEKIAIAIDSSSIEFYDDKKKFYRFEGKNLTSKELLTYYDNLVEKYPALISIEDGFSEHDWEGFAAQTKARGQKIQLVGDDIFVTNPTIFKEGIKKNVANAILIKLNQIGTVTETIETISLARKAGYKTMISHRSGETVDSYIADFSVAMHAGQIKSGSMARSERVEKYNQLLRIEEDLGKDVALAQFPG

SEQ ID NO: 33544 - protein, 351 aa, Synechococcus sp. CC9311
MARQYHPDINKEAGAEDRFKEIGRAYEVLSDPQTRGRYDQFGEAGLGGGGGMPDMGDMGGFADIFETFFSGFGGAAGGAGRQRRRGPQQGDDLRYDLTIDFDQAVFGQEREIRIPHLETCTTCGGSGAKSGSGPTTCTTCGGVGQVRRATRTPFGNFEQVAECPSCNGSGQVIADPCSSCGGQGVTQVRKKLRINIPAGVDTGTRLRVSGEGNAGLRGGPSGDLYVFLTVKSHPSLRRDGLTVLSEVKVSYLQAILGDTIEVETVDGPESLDIPAGTQPNSVLSLENKGIPKLGNPVARGHQRISVTVTLPTRLNDEERGLLEDLAGHHSARGEQHHHHKSGLFARLFGQR

SEQ ID NO: 33545 - protein, 425 aa, uncultured archaeon GZfos36D8
MKEEKDYFVFGGMDVVELAERYGTPLYVTDENKLRNNFKSYKNAFETTNIDTDIYYAVKANGNLALLKILASEGAGADVFSAGELELTKLAGIPAEKILFNGNSKSDDDLKEAVESGVRVSVDSVDELRALSAVANELGREVEIAIRVNPDVSPDVHAKIATGLKESKFGIPFHDVIPVCEEAEKLPNVLLAGLHCHIGSQILDITVFGEATEKMMALVERVYERGMQLKFVDLGGGLGIGYRQEEKATAPTPEDLAEMILPLFENKIRDLGISLKLVLEPGRSIVGASTILLSRVNAVKRANKNFVAIDAGFNLLIRPVMYDAYHEVVVANKVNERASELYTVVGNVCESGDIMAKDRMLPKVERGDLVAILDTGAYGFSMSSQYNGRPRCAEVLVCNGKADLIRSRESIEDLIRNQEIPARLI

SEQ ID NO: 33546 - protein, 884 aa, Corynebacterium efficiens YS-314
MTSSSEHSYSVWPGDAYPLGSKYDGAGTNFALFSDVAESVELCLVDENDNETRIKLEEKDNNVWHCYLPGILPGQRYGYRVHGPWDPDNGKRCDASKFLVDPYARAFVGEYDGHPSLFSYDIMDPENPHGRNTEDSLPHSMKSVVVSPFFDWGNDQPPRTPYHETVIYEAHVKGMTMTHPDIPENLRGTYAGLAHPKIIEYLVDLGITAIELMPVHQFMQDDRLRELGLRNYWGYNTFGFFAPQNDYSSASTPGAAVAEFKAMVRSFHEAGIEVILDVVYNHTAEGNHMGPTISFRGIDNEAYYRLVDGDERHYMDYTGTGNSLNVRDPHSLQLIMDSLRYWVTEMHVDGFRFDLASTLARELHDVDRLATFFDLVQQDPVVSQVKLIAEPWDIGEGGYQVGNFPPLWTEWNGKYRDTVRDFWRGEPATLGEFASRLTGSSDLYAHNGRRPTASINFVTAHDGFTLNDLVSYNEKHNMANGEDNRDGESHNRSWNCGVEGPTDDPEILQLRAQQRRNFLTTLLLSQGTPMISHGDEMARTQNGNNNVYCQDNELAWINWDQAIEHKDLLSFTRRLLRIRAEHPVFRRRRFLAGGPLGSDVRKRDIAWLVPDGQLMTQDDWDFAFGKSLMVFLNGDAIVEPDYRGQKIEDDSFILMFNAHHEAIDFTLPPEHFGMKWKLLVDTTEAIGYPLEELTIEAGGTLTVPARSSMLLRQIEAPDYTKLDERIAREAREVEEARKRESTDAEAALRASVGAALKAEEEAVQHFTERTKASVGTEGEESEAADTIPGELPEENTGEDTAEESGDADKVSPEVAVEADAEDDSEDDAESDTSTDLGADDKVVHASRADKPAEETETLDEDEELMRKRQAAAQEDDYDSAEDEY

SEQ ID NO: 33547 - protein, 549 aa, Shigella flexneri 2a str. 2457T
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHISEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 33548 - protein, 303 aa, Aspergillus oryzae
MASAPHASFQQLEKLGEGTYATVFKGRNNQTGEMVALKEIHLDTEEGTPSTAIREISLMKELQHENILSLYDVVHTENKLMLVFEYMDKDLKRYMDTYGNRGQLEPGIIKSFVYQLLRGVAHCHENRILHRDLKPQNLLINTKGQLKLADFGLARAFGIPVNTFSNEVVTLWYRAPDVLLGSRSYNTSIDIWSIGCILAEMYTGRPLFPGTTNEDQLLKIFRVMGTPSEISWPGISKFPEYKPDFPVYATQDLRQVVSRIDHLGVDLLRRMLQMRPEMRISAASALKHAWFNDIPRPIPSNAQ

SEQ ID NO: 33549 - protein, 228 aa, Francisella tularensis subsp. holarctica
MSDISELIKGNRAWAEEIKKTNPGFFETLSKGQSPEYLWIGCSDSRVPANQICGLIPGEVFVHRNVANVVSLTDLNCLSVLQFAIEVLKIKKIIVCGHYACGGVETVVKDKSYGLIDNWLTSIHEVKEQNKQFIEESLSCYKDNQEEYMKKKVDMMCELNALHQALNLCKTTVVKNAWAKGLTFTIHAAIYGIGDGKLYEIGGGVGSRAEMDTTYAQAIKDIKSRYCR

SEQ ID NO: 33550 - protein, 431 aa, Bacillus cereus ATCC 10987
MSTIIDVYAREVLDSRGNPTVEVEVYTESGAFGRAIVPSGASTGEHEAVELRDGDKSRYLGKGVVNAVNNVNEIIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGSKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 33551 - protein, 509 aa, Bacillus cereus ATCC 10987
  misc_feature (489)..(489): Xaa can be any naturally occurring amino acid
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSDGEPMTAHTTNPVPFIVTKNDVELREGGILGDIAPXMLTLLGVEQPKEMTGKTIIK

SEQ ID NO: 33552 - protein, 251 aa, Bacillus cereus ATCC 10987
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLEAVK

SEQ ID NO: 33553 - protein, 137 aa, Triticum aestivum
LNVCFAPTIQDMVLLHHEVEVEYPDGRPTEKHQATLLEFGKTENGRPTTAMALTVGVPAAIGALVLLHSNHNTSHTDILHLDAGLGGAGEALWSRRARPGSFHDARRCHGRVVHAAASTVSWHLPPPPPKFPSRLFP

SEQ ID NO: 33554 - protein, 394 aa, Bacillus cereus ATCC 10987
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELDVLGKALSNPDRPFTAIIGGAKVKDKIGVIRHLLDKVDNLIIGGGLAYTFVKALGHEIGLSLCEDDKIELAKEFMQLAKEKGVNFYMPVDVVITEEFSETATTKIVNIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 33555 - protein, 384 aa, Mycobacterium tuberculosis CDC1551
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPLPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 33556 - protein, 334 aa, Bacillus cereus ATCC 10987
MTKIGINGFGRIGRNVFRAALNNPEVEVVAINDLTDAKTLAHLLKYDTVHGTLNAEVSANESSIVVNGKEIKVIAERDPAQLPWSDYGVEIVVESTGRFTKKADAEKHLGGSVKKVIISAPASDEDITVVMGVNHEQYDAASHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 33557 - protein, 254 aa, Brassica napus
  misc_feature (114)..(114): Xaa can be any naturally occurring amino acid
MTEVVLHIYDVTNSGSEKTNNTILQINRFFKDGIRLGGIFHSAIQVYGDEEWSYGFCEQGTGVFSCPSSKNPMYTYREKIVLGKTECTIFMVNQILRELSREWPGHSYDLLSKXLHHFCDVLCDRLGVPKLPGWVNRFAHAGDTALEVAGNTAMRVKQAKTELVSASKVAYRFLSNITSNVTNGSPQRPPGTLSSSENGNLRLQGSWFKGLLNTAKPSTSTEMESKDEDANHGVPNHQRKQSRDSVPIHPTAFG

SEQ ID NO: 33558 - protein, 130 aa, Candida albicans SC5314
MTRTSVLADALNAINNAEKTGKRQVLIRPSSKVIIKFLTVMQKHGYIGEFEYIDDHRSGKIVVQLNGRLNKCGVIQPRFNVKINDIERWTDNLLPARQFGYVILTTSAGIMDHEEARRKHVSGKILGFVY

SEQ ID NO: 33559 - protein, 390 aa, Prosthecochloris aestuarii DSM 271
MRIGVLTGGGDAPGINACLKTIVTQCDEYGFEVFGIKRGWEGLLSLNPDVPDERSLHIVPLTRHLVRKIDRTGGTFLHSSRVNPGNLSRKEVPLFLQCALKRMGRGLINAAHFDATFHVLRVLEHLGLDTLIVIGGDDTISYAWHLQQQGVAVVAIPKTMDNDVFGTDYCIGFGTAVTRSVQYIHQLRTSSGSHERITIVELFGRHTGEACLVSSYLAGVDRTLIPEAPFDPERLADLLIFDKAANTSNYAMVAVSEGARMVGGKFIEYCRHHIDDHVLQRDGIGQLIRDTMTMLTGEEIIWQPLGYLMRSGIPDALDIMVGCNFAQLAVELIRKNVSGVMVALSKGVYDHVPLAVVASGTHQVDIAELYDPEEYRPKMRCVLGKPMFFY

SEQ ID NO: 33560 - protein, 391 aa, Staphylococcus aureus subsp. aureus MW2
MVTQNKKILIITGSFGNGHMQVTQSIVNQLNDMNLDHLSVIEHDLFMEAHPILTSICKKWYINSFKYFRNMYKGFYYSRPDKLDKCFYKYYGLNKLINLLIKEKPDLILLTFPTPVMSVLTEQFNINIPVATVMTDYRLHKNWITPYSTRYYVATKETKQDFIDVGIDPSTVKVTGIPIDNKFETPINQKQWLIDNNLDPDKQTILMSAGAFGVSKGFDTMITDILAKSANAQVVMICGKSKELKRSLTAKFKSNENVLILGYTKHMNEWMASSQLMITKPGGITITEGFARCIPMIFLNPAPGQELENALYFEEKGFGKIADTPEEAIKIVASLTNGNEQLTNMISTMEQDKIKYATQTICRDLLDLIGHSSQPQEIYGKVPLYARFFVK

SEQ ID NO: 33561 - protein, 248 aa, Triticum aestivum
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMCDDHSSVAGNDY

SEQ ID NO: 33562 - protein, 377 aa, Streptomyces coelicolor A3(2)
MKAVVYKGPFSVAVEDVEKPDIRHPNDVIVRVTSTAICGSDLHMYEGRTAAEPGIVFGHENMGIVDQVGQGVTGLKKGDRVVMPFNVACGFCTNCAAGYTGYCTTVNPGFAGGAYGYVSMGPWQGGQAEYLRVPYADFNCLKLPEGDAHETDFILLADIFPTGYHGCELADVRPGESVAVYGAGPVGLMAAYSALLRGAKKVFVVDRVPERLQKAEEIGAVPVDFSAGDPVEQIKEQTEGAGTDKGVDAVGYQATAGGTGKEEPATVLNSLVNTVRPTGALGVPGLYVPADPGGPDEQAKQGMLLVAIGKLFEKGLRVGTGQCNVKRYNRQLRDMIIEGRAEPSFVVSHELPLDQAPSGYDKFDKRIEGYTKVVLHP

SEQ ID NO: 33563 - protein, 248 aa, Triticum aestivum
MPGSIAFGRFDDSFSLASFKAYIAEFISTLIFVFAGVGSAIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYVYMCDDHSSVAGNDY

SEQ ID NO: 33564 - protein, 248 aa, Triticum aestivum
MPASIAFGRFDDSFSLASFKAYIAEFISTLIFVFAGVGSAIAYSKVSGGAPLDPSGLIAVAICHGFGLFVAVAVGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCDDHTAVAGNDY

SEQ ID NO: 33565 - protein, 456 aa, Synechococcus sp. RS9916
MRKTRQRIVRDRPSQSPAAAVGVLPRRLAWEVLEAVAAGAYADVALERALRGQQLSGPDRGLVTELAYGAIRQRRWLDGWLDRLGKVPARKQPPRLRWLLHVGLYQLLCMERIPAAAAVNTSVELAKRHGLNRLAPVVNGLLRGALRAQEAGEQLTLPDDPALRLALQQSLPDWFCQQLQQWCGPEQAERVAQACNQVPSLDLRVNRLRSTPEAVKAALEDAGLTVVAIPECPDGLQVLSHGGDLRQWPGYDDGHWCVQDRAAQWVAPLLAPQPGDRVLDACAAPGGKATHLAELMGDQGEVWAIDRSAGRLQRVAANAARLGTNCLQAMAADAADLLTLKPEWKGSFQRILLDAPCSGLGTLARHADARWRVSAKSVAELVPLQARLLEGMLPLLSPGGSLVYATCTIHPAENTERIEAFLQAHPQLSLQHQEQRWPDPEGGDGFYAAVIKTPTS

SEQ ID NO: 33566 - protein, 119 aa, Secale cereale
MGGCVGKGRSIVEEKLDFKGGNVHVITTKEDWDQKIEEANKDGKIVVANFSASWCGPCRVIAPVYAEMSKTYPQLMFLTIDVDDLMDFSSTWDIRATPTFFFLKNGQQIDKLVGANKPE

SEQ ID NO: 33567 - protein, 387 aa, Oceanobacillus iheyensis HTE831
MKQSNRLKQLPPQFFASLVQKVNQAISEGRDVINLGQGNPDQPTPAHIIKALQSAVEDPITHKYSPFRGTDDFRKAAATFYKREYQVDLDPDTEIAVLFGSKIGLVELPLALMNPNEWMMLPNPGYPDYLSSIPLADIQYDTMPLLEENNFLPNYEQLTLSQKERTKLLYLNYPNNPTGATANNAFFNETVALGKNHDIGIVHDFAYGAIGFNEEKPISFLQTKGAKEVGIELYTLSKTYNMAGWRIGFAAGNKEMIEAINILQDHLFVSVFPAIQRAASEALLSDQSSVQDLVTLYQKRRDALITECKRIGWDINAPQGSFFAWLPVPNGFTSETFADYLLNEVDVAVAAGNGFGTFGEGYIRVGLLVDEQRIVEAIKRIEGLKLF

SEQ ID NO: 33568 - protein, 118 aa, Campylobacter jejuni subsp. jejuni NCTC 11168
MKNKYIEQFEAKQIEGKNVPDFRAGDTLKLAIRIKEGDKTRIQNFEGICIARRGNGVSETFIVRKIGANNVGVERIFPIYSESLESITVLRRGRVRRARLFYLRDRRGKAARIKELKK

SEQ ID NO: 33569 - protein, 239 aa, Zea mays
MEGSTATEGHVVGIPVSTRAYGIEEPDFSVEETTPDRGEFPSSFQYYSHDAASSTTTAADRPTSNQQATRKGDKIVRGIKEHVTLGPKLSDTVKGKLSLGAKILRAGGSVEKLFRQWFSADKDEKLLRASQCHLWTTAGPIAGVLFVSTARVAFRSDRSLSLAVSTPRGDCSFRAPYKVAVPLRKVGAVRPSENRHRPEQRYVRLATTDGFEFWFMGFVSYNKSLQHLERAVACARQAR

SEQ ID NO: 33570 - protein, 137 aa, Campylobacter jejuni subsp. jejuni NCTC 11168
MFSIKKTLLILASVPMFLSATEYQLSTHVLDITSGQPAPKVKVELYKLEANQQWKKVSEEFTEENGRIGDLLPYEKAENRAFGIYKLKFFTKDYYTSHKINTFYPFVEVSFELSKDQKHYHVPITLSPFGYSTYRGS

SEQ ID NO: 33571 - protein, 329 aa, Schizosaccharomyces pombe
MDVVLQYADKYVFDTFYGKIAESFDSSSSFANTAVNSTTLGLAEKVNFAITSGLLDRNNVWRQFTSLFLITWIMGTLSYFLSASFAYYVYFDREEARRHPKFLKNQEHLELMVALKNLPGMAILTAPWFLAEIRGYGYVYDKLDEYGYFYLFFSIALFLLFSDFLIYWIHRALHHRWLYAPLHKLHHKWIVPTPYSSHAFHYLDGYSQSLPYHMFPFFFPLNKYVYLLLFGSVNYWTVLIHDGKYFSNNAVVNGAAHHAAHHMYFNYNYGQFFTLFDRLCSSYRQPDQELFDAELRNEKLQEQRIRFMETVQYTVEGKDDRTYASKKDN

SEQ ID NO: 33572 - protein, 326 aa, Hordeum vulgare
MDGKGYTTPPTAPAPQAEAGAPHFYPPTEHGTAPQPGSQVSYPPMPKAMDGQDAAAPQPGAPPHPSSPLTQQAMELEGKYAAPQPGTGATPSPLTQQAVDGKDAAPTPPAESARWGTRQMGPPAAPGAHPENQQAAQWTATRGDQELPPYVIMGAPEPAPAASARRTDKEARDSPMEHILDFFNTWSRKAEELSSNIWLNLKTAPSMSDAAMGKLSLGAKAITGGGFEKLYKQTFGSGPDEHVKKTFACYLSTATGPVAGTLYLTNTNVAFCSDRPLSFAAPSGQTAWSYYKVMIPLAKLAAVEPVTAKESPPERYIHIVAAPAYE

SEQ ID NO: 33573 - protein, 146 aa, Arabidopsis thaliana
MTTPAKKRLMWDFKRLQKDPPVGISGAPQDNNIMHWNALIFGPEDTPWDGGTFKLTLHFTEDYPNKPPIVRFVSRMFHPNIYADGSICLDILQNQWSPIYDVAAVLTSIQSLLCDPNPDSPANAEAARLFSENKREYNRKVIEIVE

SEQ ID NO: 33574 - protein, 571 aa, Oryza sativa (japonica cultivar-group)
MAAAAPAGAQNRCVFGTGPLPPASLSPSSAWFDPELSSGEGAHVGNIPYDATEEQLVQICEEVGPVVSFRLVIDKETGKPKGYGFCEYKDEETALSARRNLQGYEINGRQLRVDFAENGRNADRNREKVEDPQFLTVEETHFSTSNSYVKMRACIALVPMNDNSSVFSNHHVSVVEDLEWHPVLVGIISFITPKFMYTQKQLAGTPVVGDTGLHQPVGLPSAIHAASVMAGILGGSQTANVQNGLPVQYGLGNDPLTHYLARMSKHQLYEIMSELKSLTSQNKDVANKLLQGIPQLSKALFQMQMAKSQQPSSSLAQSSSHISEPFPQPDAMISSVPRPSASLPNPNVLQDPSAQLHNFPQYPHSSQPAGTIFPHGSQSGVGIHPPIVSQLLGASSSVPPLPLATSGSLISQVQPPFMPHHPRPPAMPAGMQQLPLTHPHVPQVPAIPDIAQKEMRFPEQANRSTEFAHHPKLRKLEDGTSTPGIVNNNPAVYPAPSQGMLPGGPSGSYNSAAVSFQQPENEVPQLTPDVESALLQQVLQLTPEQLSSLPVEQQQQLLQPVSDFWKNILLD

SEQ ID NO: 33575 - protein, 275 aa, Oryza sativa (japonica cultivar-group)
MASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRFRAAFEEHGGRPESNPFGARAVRLYLGDIRDTQSKARGIAYEKKRRQGGRGFQHQAEAAAAAAGGTGGGAARRRRRRRGAAGHGDDDDDDHGAALLVPGALPPRPLLPGTGRRAARRRRRRGVDGRRCRCSQRRRRGGPGAGHGGGGGGRRGARRRLHDATVGVQLAPPSISINP

SEQ ID NO: 33576 - protein, 296 aa, Schizosaccharomyces pombe 972h-
MSETTYVKQCAYGKTLVRFMKKDICPKTKTHTVYEMDVQSLLTGELEESYTKADNSIVVPTDTQKNTIYVFAKNNDVSVPEVFAAKLAKHFVDKYKHIHGAALDITITPWTRMEVQGKPHSHSFIRNPGETRKTHVVFSEGKGFDVVSSLKDVLVLKSTGSGFTNFHKCEFTTLPEVTDRIFSTSIDCNYTFKHFDTFEELAGFDFNSIYEKVKEITLETFALDDSESVQATMYKMADTIINTYPAINEVYYALPNKHYFEINLAPFNIDNLGSNCSLYQPQAYPSGYITCTVARK

SEQ ID NO: 33577 - protein, 370 aa, Schizosaccharomyces pombe 972h-
MGQTLSEPVLDKHSSSGGDRWLHFGVSHMQGWRISMEDAHCALLNFTDSNSSNPPTSFFGVFDGHGGDRVAKYCRQHLPDIIKSQPSFWKGNYDEALKSGFLAADNALMQDRDMQEDPSGCTATTALIVDHQVIYCANAGDSRTVLGRKGTAEPLSFDHKPNNDVEKARITAAGGFIDFGRVNGSLALSRAIGDFEYKKDSSLPPEKQIVTAFPDVVIHNIDPDDEFLILACDGIWDCKSSQQVVEFVRRGIVARQSLEVICENLMDRCIASNSESCGIGCDNMTICIVAFLHGRGLEDWYNWITQRVNSGEGPCAPPSYAELRGPNTIADARNLQLEYDHIASHEYGSGDTYDSDSDDETIAYDRYYLH

SEQ ID NO: 33578 - protein, 757 aa, Burkholderia mallei ATCC 23344
MREFDYLLVGGGIASVTAARTLRGEDASASIAILCGEPVLPYQRPPLSQEWLMGAVQPASITLHDAAFYAAQRIDIALGVRAEQLDRAKRIVRTSSGATFRYGKLLIATGASAKAPALPGFGLDGVHVLHTFAQAQALKDAAAHARRATVLGGGFLGVEIAATLQALGLQVTLVERAPGVMPSLRAPALGGHFEALCRARGIDVLTRCEVRRVLGAQCVEAVETSDGGTRPCDLFVAAVGVTPNCGWLDGSGLALGDGVEVDAFLQTADPDVFAAGDVAHFDDPIFGVRRRIEHWDNAVRQGRIAARNMLGHRLPYRDVSIFYGSVFGLSYNLLGYPVGATETIERGAFDEASYMQLYLADDVLRAAFTIDRPAVEIAALNDAIRLHVNVAAHKMKLSDPNYPLDKLPVQTILILQGGGALGAFECGAVKALEQHGVRPDVISAVSIGAFNGAIVASHPKGATKALEAFWRELSIALPLPYESQWREAWLSSYVLSFGVPNFLKPQWSQLGFDADRLRAKWTSFFDATAIEQLIARYVDFDSLGMSPTRLLIGAVDVETGEPRIFDSYVDRLSPAHVLASGSLPPGMPWTVVDGRPYWDGGVVSNSPLDLVIARCGQIGGRVFIVDLFSGSKALPTNLVEVMLRREEIAYMDRVRNDLRFEEYASDFRDLVDGILAHVDAPSANEIRQQPLYIRLMGNRAAIDIARITLNREGRLSFIEDYDFSSDAIAQLQQQGYDAALVALANGRSRRRRGRRRA

SEQ ID NO: 33579 - protein, 446 aa, Saccharomyces cerevisiae
MGKNVLLLGSGFVAQPVIDTLAANDDINVTVACRTLANAQALAKPSGSKAISLDVTDDSALDKVLADNDVVISLIPYTFHPNVVKSAIRTKTDVVTSSYISPALRELEPEIVKAGITVMNEIGLDPGIDHLYAVKTIDEVHRAGGKLKSFLSYCGGLPAPEDSDNPLGYKFSWSSRGVLLALRNSAKYWKDGKIETVSSEDLMATAKPYFIYPGYAFVCYPNRDSTLFKDLYHIPEAETVIRGTLRYQGFPEFVKALVDMGMLKDDANEIFSKPIAWNEALKQYLGAKSTSKEDLIASIDSKATWKDDEDRERILSGFAWLGLFSDAKITPRGNALDTLCARLEELMQYEDNERDMVVLQHKFGIEWADGTTETRTSTLVDYGKVGGYSSMATTVGYPVAIATKFVLDGTIKGPGLLAPYSPEINDPIMKELKDKYGIYLKEKTVA

SEQ ID NO: 33580 - protein, 537 aa, Aspergillus oryzae
MDAKMATEIFNTTSAQPESPQSWAYKTSQLQGALPDFLAEWSAWQYVVTFLVGLVLYDQVLYLKRKGALPGPTFKIPLMGPFIQAIHPTFDGYLRQWASGPLSCVSIFHRFVVLASDRDLAHKVFKSPAYAEPCLVPVARDIIGHKAWVFLQGRDHAEYRRGLVPLFTSRAIATYLPVQERVLDDYYNQFVAATKANQGKPMAFMTLFREINCALSCRTFFGDYISDDQVKKIADDFYLATDALDLVNIPLAMYVPFTKTWLGKRTADAVHRVFAECAARCKANMAKGATPTCIVDHWVLHMMESNRYRERVAAGETNLEKPKNMIREFTNEEISDTLFTFLFASQDASSSATTWLFQILAQRPDVLDKLREENLAARGGDRNKPFDLPMLESLTYTNAVIKELLRYKPPVILVPYLATKDFPVTPDYTVPKGSMIIPSCYPALHDPEAYPNPDVFDPERWISGDAESKTKNWLVFGAGPHDCLARKYVPLSLAGMIGKASLELDWEHHPTPRSEEIRVFATLFPMDGCNLVFKRRP

SEQ ID NO: 33581 - protein, 349 aa, Anabaena variabilis ATCC 29413
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPVGRYTLLYDPIDGSSNTDTNLSLGSIFSIRQQEGDDSDGQAKDLLTNGRKQIAAGYILYGPSTMLVYTMGKGVHSFTLDPSLGEFILSEENIRIPDHGAVYSVNEGNFWQWEESMREYIRYVHRTEGYTARYSGAMVSDIHRILVQGGVFLYPGTVQNPEGKLRLLYESAPLAFLIQQAGGRATTGLVDILDVVPKKLHQRTPLIIGSKEDVAKVESFIQNGH

SEQ ID NO: 33582 - protein, 294 aa, Glycine max
MEQYEKVEKIGEGTYGVVYKGRDRSTNETIALKKIRLEQEDEGVPSTAIREISLLKEMQHRNIVRLQDVVHDEKSLYLVFEYLDLDLKKHMDSSPEFAKDPRQLKMFLYQILCGIAYCHSRRVLHRDLKPQNLLIDRSNNALKLADFGLARAFGIPVRTFTHEVVTLWYRAPEILLGSHHYSTPVDIWSVGCIFAEMVNQRPLFPGDSEIDELFKIFRIMGTPNEDTWPGVTSLPDFKSAFPKWQPKDLKIVVPNLKPAGLDLLSSMLYLDPSKRITARSALEHEYFKDIKFVP

SEQ ID NO: 33583 - protein, 196 aa, Oryza sativa (indica cultivar-group)
MILEQFDESAAEKADAAMVVAPPSNFGMVDTGVYRSGFPDPASFGFLRGLGLRSVVYLCPEPYMETNAEFLKAEGIRLFQFGIEGNKDPNVSIPVDAIMGALRVILDVRNHPVLIHCKRGKHRTGCLVGCFRKLQNWCLSSVFEEYHRYAAGKSRLSDLKFIESFDVNCMTDCLLRLIYHYHGCLQKSKRLAYSER

SEQ ID NO: 33584 - protein, 336 aa, Shewanella sp. ANA-3
MSKRTITVIPGDGIGPSIIDSALKILDKAGCDFEYEFADAGLTALEKQGELLPQRTLELIEKNRITLKGPLTTPVGEGFTSINVTLRKKFGLYANVRPVLSFKGTQARYENIDIITVRENTEGMYSGHGQKVSEDGTTAEATSIVTRQGAEQIATFAYELARKENRKKVTIVHKANIMKSTSGLFLKVAREVSQRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKADLIRKAVSAVIEEGDRTTRDLGGTHGTTDFTQAVLDRLS

SEQ ID NO: 33585 - protein, 118 aa, Idiomarina baltica OS145
MAKVSQNIIKALEEEQMKKDLPAFAPGDTVSVNVKVVEGNRERLQAFEGVVIRVRNRGLHSAFTVRKVSSGEGVERTFQTHSPLVDSITVKRRGAVRRAKLYYLRERSGKSARIREKL

SEQ ID NO: 33586 - protein, 601 aa, Frankia sp. EAN1pec
MSETVTETLESPAEAITARDAEDIFAGWLADFAAALRSGSTSDLAALFLPEATWRDFMAFPWDFHHTVGREETVARLTELAKAWNAADFRPSREQPPVVTDGAINAFFDFTTTDRIDRGYVLLVPSAGHFVVSILQTQVIGLQAHPERVRHHRRDGKVYGIVPDRTRWSSDREKEIAFEDGEPAVLVLGAGHNGLAIAARLGALDVPTLVIDREARVGDTWRKRYASLALHSTVFGDHLPYLSLPPSWPAHTPKDKFADWLESYANLLDLNVWTSTTFLDGHFDEDAQRWTIRVRRGDGSVRELHPRHFVVAGGLFGSPKIPAIKGLETFPGMTAHSDEFQYGADFQGRRALVIGAGVSGHEIAHDLYEHGADVTMLQRSATYVVNYTSYHRYWSTLFTEDMPYTPDFADQMTYALPNERVDELNKKLVKLAAAADQDLLDGLTSRGFKLEWGPDGTGIIGAHMSGKDAYQINIGASELIADGLVHLKQGVEVAEIRERTVVFTDGSTLDVDLIVFATGYHQFWGHIKPTLGSAADRIDKAYGRAADGEYANTWRRSAQPGLWFGTGFIRMARFYTRFTALLIKAIEVGVEPMNPDRADGN

SEQ ID NO: 33587 - protein, 326 aa, Thermus thermophilus HB8
MRAVWVLGIDTSCDDTGVGLVRDGKVVVNLVASQVRLHEAFGGVVPELASREHLKALPLLVERALAEAGLRPKDLDLVAATRGPGLIGALLVGYTFAKGMAFALDRPFYAVHHLEGHIAAAWPEGLPPPFLALVASGGHTHLYEVLDLGRYRLLGATRDDAAGEAFDKVARLLGLGFPGGPEVERLAEEAEEAIPFPVPLRGQEGYDFSFSGLKTKALHLVEKGLPKAALAKGFQEAAIAHLAEVVLKAAKDTGHRVLLVAGGVAANRALQERFKEAGLEVHFPPRGLSQDNGAMIALAAWRRHQRGFPPSPLSLGATAYWPLEEA

SEQ ID NO: 33588 - protein, 342 aa, Glycine max
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDCGVSIGTIFGIYMVKNEAEVSLEDALQPGNQMLAAGYCMYGSSCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 33589 - protein, 257 aa, Oceanobacillus iheyensis HTE831
MKNVVHVKNINIGEGKPKVCVPITGATKKEISEELDLLQTIKVDLVEWRGDLFQEIENEISVKNMLQKINQEIPHLPLLFTFRTKGEGGGREVTLEKYKEINRFVIESKLVDLVDVELFRGKNLVKELVSFAHLHDQKVIISNHDFNQTPPRDEIIARLKLAADNGADIGKIAVMPRNDEDVLNLLSATSLVKELNHIPIVTMSMGADGLISRLSGEVFGSAITFASGKTASAPGQIEAEKLQTVLTIIHDSINKKK

SEQ ID NO: 33590 - protein, 429 aa, Bacillus licheniformis ATCC 14580
MKLIAVAGLIAFTGFFVAVEFAIVKVRRTKIDQLIIQKKKGALAAKEVTSHLDEYLSACQLGITVTALGLGWLGEPTMQTLLHPLFSKIGLNESITHILSFLAAFLSVTYLNVVVGELAPKTIAIQKAETVTLLFAQPMIWFYRIMFPFIWLLNHSARMITSLFGLKPTGEHELAYSEEELRTLLSESYRSGEINQNELKYVNNIFKFDERTAKEIMVPRNEMTVLSLDDSLKKAKQLIKETKHTRFPVMEEDKDHITGMINIKELLLAELAGEFSLETKSLKPYIHPVIHVIETIPVYQLFVKMQKEHTHMAILVDEYGGTSGLVTVEDIVEEIVGDIRDEFDTEEVSAVQKLEDDHYILNAKVLVSDVNDLLGIHLSDEEIDTIGGWMLTQNIESKPGTTIESEGYRFKVKEMDGHRIVAVEVEKTA

SEQ ID NO: 33591 - protein, 579 aa, Corynebacterium efficiens YS-314
MVSLVSMLTSLKYRVWAPRPEDVRLHLNGETLPMTRTDGDWWVADREPAVGDRYGFELFDGTEWSKTVPDPRSQYQPDGVHGLSEVISPDFAWSDDAWTGRILPGSVIYELHVGTFSPSGDFDGVIERLDYLKDLGVTAVELMPVQPFGGNRNWGYDGVLWHAVHSGYGGPVGLKKLVDACHNAGIAVYLDVVYNHFGPDGNYNGMFAPYTAGGSTGWGEVVNINGPESDEVRRYILDAVTRWFEEFHIDGLRLDAVHSLDDNGAFPLLEQMTVASEAIAAATGIPRSLIAESDLNDPRLVTSREAGGYGLHAQWVDDIHHALHTLVSGERNGYYSDFGDTATLASTLEKVFHHTGQVSTFRGRRHGREIRRDVTPASRFVTYTTTHDQTGNRAVGDRPSMNLTPAQQMLKAAVIYCSPYTPMLFMGEEYGATTPFAFFCSHTDDELNRLTSEGRKREFARLGWDPETIPTPSEESTFTDSKLDWSFTPEQENILEGYRTLLRLRRELGMSQPDLLSMEISNGPGWISMANGDGILVANFSDSDVEVPFGGELIYSFTSPEVREDSTVLDAYGFAVLRR

SEQ ID NO: 33592 - protein, 918 aa, Neurospora crassa
MNTIPARHVGDVAARDPLPLPHISSSVASGMKRSFATMAMLYNDTGNSNDVGAHARRPPRTLSNSRSTSAHRVPLGSWSAPNSPPRRALPHHPITASFDPDASIVIAGIRGAGKSTLAIMASTAMKRKIVDLESEFHHLTGLSSSSYKKTHGPVDYGRRQIAILQNILNLHRTRAILVCSWLERDVQAMLQDFSVSNPVIYVLRDAKAIEAHLKGYDKSKVGTLLDATSTVLRRCTRFEFFNVSEENLDTHSASTSPPAVPDQRHTAPYLTLKRAERHFLKFLSLILPKGTIPFVESAFPLASVPVEQRRFTYALALPVSALLDKGVDIQELDVGVDAIEIIVDDLATSESGPTSPLGLAPHRASEISRVVGEIRRDTVIPIILHVVFPERALYEEALLALYMTYLNHALRLAPDYLTVDLGLDSGLLGQLTTVQGTTKVIGNKQLAEVNSPRWGDPSWLQAYEKAQNTGCDLVRLTRPASNPRDNTDIRQFHVAVEAVGGPRLPFIAYNTGRLGRTSMCFNEILTPVTPVPTKEDAIGLRNPAHRYLQPPLTALEATQALYSAFVHDPMKLYVFGANVGYSLSPAMHNAALKACGIPHHYKPLSTANIGTLREVISDPQFAGASVGLPFKVEIISLTHSLSRHAKAIGAVNTLIPVRHLTADGGIPDEVSMFNNISQAGAVRALYGENTDWIGIRACLRRGLSPANAVRSTSTGLVIGAGGMARAAVYAMLQLGVKKILIFNRTFANAEKLVLHFENLLVRDALPLLSTGPRSHDNTCFHIIRSRDDPLPENFKNPTMIVSCIPTHTVDNTPDPEFTVPLHWLDNPTGGIVLELDYKCLTSPLLEQTRREAHRGWVAMDGLDLLPEQGFAQFELFTGRRAPRRLMRREVLRAYPDDQAKSHTARLRPRLNGIATQIS

SEQ ID NO: 33593 - protein, 501 aa, Sinapis alba
DEEITCQENLPFTCGNTDALNSSSFSSDFIFGVASSAYQIEGTIGRGLNIWDGFTHRYPNKSGPDHGNGDTTCDSFSYWQKDIDVLDELNATGYRFSIAWSRIIPRGKRSRGVNEKGIDYYHGLISGLIKKGITPFVTLFHWDLPQTLQDEYEGFLDPQIIDDFKDYADLCFEEFGDSVKYWLTINQLYSVPTRGYGSALDAPGRCSPTVDPSCYAGNSSTEPYIVAHHQLLAHAKVVDLYRKNYTHQGGKIGPTMITRWFLPYNDTDRHSIAATERMKEFFLGWFMGPLTNGTYPQIMIDTVGERLPSFSPEESNLVKGSYDFLGLNYYFTQYAQPSPNPVNSTNHTAMMDAGAKLTYINASGHYIGPLFEKDKADSTDNIYYYPKGIYSVMDYFKNKYYNPLIYVTENGISTPGDENRNQSMLDYTRIDYLCSHLCFLNKVIKEKDVNVKGYLAWALGDNYEFNKGFTVRFGLSYIDWNNVTDRDLKKSGQWYQSFISP

SEQ ID NO: 33594 - protein, 472 aa, Oryza sativa
MAFFRGLTAVSRIRSRMAQEATTLGGVRWLQMQSPSDLDLKSQLQELIPEQQDRLKKLKSEHGKVQLGNITVDMVLGGMRGMIGMLWETSLLDPDEGIRFRGLSIPECQKVLPTAVKDGEPLPEGLLWLLLTGKVPTKEQVDALSKELASRSSVPGHVYEAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKAAA

SEQ ID NO: 33595 - protein, 519 aa, Arabidopsis thaliana
MVFISLFEISIAFFCFLLFRHFLINKKTHRLCPTNWPFFGMIPGLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 33596 - protein, 660 aa, Schizosaccharomyces pombe 972h-
MSSSNEQICLDEDWIQKFGDREIEFVDEAQKSEVDETEKSIKRFPLSVLQRKGLALINLRIGVVKTGFGGKTIIDFEKDPAFSNGEELPANSFSPGDVVSIRQDFQSSKKKRPNETDISVEGVVTRVHERHISVALKSEEDIPSSVTRLSVVKLVNRVTYERMRHTMLEFKRSIPEYRNSLFYTLIGRKKADVSIDQKLIGDIKYFNKELNASQKKAVKFSIAVKELSLIHGPPGTGKTHTLVEIIQQLVLRNKRILVCGASNLAVDNIVDRLSSSGIPMVRLGHPARLLPSILDHSLDVLSRTGDNGDVIRGISEDIDVCLSKITKTKNGRERREIYKNIRELRKDYRKYEAKTVANIVSASKVVFCTLHGAGSRQLKGQRFDAVIIDEASQALEPQCWIPLLGMNKVILAGDHMQLSPNVQSKRPYISMFERLVKSQGDLVKCFLNIQYRMHELISKFPSDTFYDSKLVPAEEVKKRLLMDLENVEETELTDSPIYFYDTLGNYQEDDRSEDMQNFYQDSKSNHWEAQIVSYHISGLLEAGLEAKDIAVVTPYNAQVALIRQLLKEKGIEVEMGSVDKVQGREKEAIIFSLVRSNDVREVGFLAEKRRLNVAITRPKRHLCVIGDSNTVKWASEFFHQWVDFLEENAIVMDIDATMFE

SEQ ID NO: 33597 - protein, 336 aa, Mycobacterium avium subsp. paratuberculosis K-10
MKLAVIGGDGIGPEVTAEALKVLDAVLPGVDKTEYDLGARRYHATGELLPDSVIDELRAHDAILLGAIGDPSVPSGVLERGLLLRLRFELDHHINLRPGRLYPGVSSPLAGNPDIDFVVVREGTEGPYTGTGGAIRVGTPNEVATEVSQNTAFGVRRVVVDAFERARRRRKHLTLVHKTNVLTFAGKLWSRIVAEVGRDYPDVEVAYQHIDAATIFMVTDPGRFDVIVTDNLFGDIITDLSAAVCGGIGLAASGNIDGTRTNPSMFEPVHGSAPDIAGQGIADPTAAIMSVALLLAHLGEDAAATRVDRAVERYLATRGNERPATTEVGERIAAAL

SEQ ID NO: 33598 - protein, 222 aa, Oryza sativa (japonica cultivar-group)
MVSLRRRRLLGLCSGKDSLPVDFPKPSDNENSVEVAHPNIKPFSVHPLPLTKNSDVLLESSNGSDSLKEEKNHYYPGKEIKRRKRHRRKQYVDQEPCIMRGVYFKNMKWQAAIKVDKKQIHLGTVGTQEEAARLYDRAAFMCGREPNFELSEEEKKELQNYTWKDFLDMTRDTITSKKQRKVGLIRRNKTDSLVGQSDGDTEMINGGGSSHSEDGDAETSAS

SEQ ID NO: 33599 - protein, 634 aa, Ralstonia metallidurans CH34
MTQHDFRAEQPIASATDAFATPADAASPLDKLDAMLNADAAPAVEASENGFAKLGLDAAILRALAEANYNTPTPVQAQAIPAFLAGRDLLVSSQTGSGKTAAFMLPAIQRISEKPATHRPTEPAKRMKGKRPRPSPAQPSLLVLTPTRELALQVTEAAAKYGRHLRRIVCASILGGMPYPKQLAMLARMPDILVATPGRLLDHIEAGRIDLSALEMLVFDEADRMLDMGFADDIDAIVAATPASRQTLMFSATLDARIAQLASRQLRDPQRIEIAAARADHSNIEQRLHFTDDMSHKERLLDHLLRDASLKQAIVFTATKRDADSLAERLSDTGFSAGALHGDMTQGARNRTLTALRRGNLRVLVATDVAARGIDVPDITHVVNFDLPKQAEDYVHRIGRTGRAGRSGVAINLVNHGDMFQWRRIERFTNNRIDASVIEGFEPRRSPKPRSNFGGKPGGRDGFRGNGGTGGGYRGNNGSGGYRGNREGSGDRNFGERRFSSDNRGFGDRAPRPFGDDNRGGFGDRGERGFGDRSNGNSNGGYRGQGQGQGQGQAQQRSFGGERSFGNRDFAQRDGNRDATQRDGNRSFGGNRDGQRDGNRSFGDRSFGDRKFGDRGGDRGGFGGQRNSRSRYER

SEQ ID NO: 33600 - protein, 173 aa, Burkholderia xenovorans LB400
MKALDAASRARSAVAVVALSAGLSGCYYYAPYGYVPYDDVPTAVTQPYPFTMPDAAASGTASDATASTNTYIATAAPVFVEPAYYPVPYPYYGWPWWGPSVSLSFGYWGGCCYGGGHHGHWGHGGWGGHGYWGHGQGGGWTGHGYRWRGGGGGWGGGGGGHYWGGGARHGSLH

SEQ ID NO: 33601 - protein, 390 aa, Frankia sp. EAN1pec
MDPVRGPRLDGRARRLGYQHRVSRRADRRPGHWLLQRHQGGHPAHDTSARLRTRPGRPGERSRTRRHQDRAGPRGVGGPRACAHRPAPAAAARHSAGRRQRGCVLRERRVVVDHRPDPGARRRRAHPAHRAGPVNPPVPTPREVFDLTGHTALVTGASSGLGARFARVLAAAGATVWITARRLDRLEKLASDVVGLRPVACDVSVESQRLALVDAVVAESGRLDVLVNNAGTDSGALPMDETPAQFADVLATNLVAPFHLAQLAARAAGEHGLSVINVGSVLGLVSAAPMGGASYAAAKAGLAGLTRELAGHWGGRGVRVNTLAPGWFPSEMSAALLDSADGARWIARNTMLRRAGEADELDGALLFLASSASSYCTGQVLVVDGGWTAR

SEQ ID NO: 33602 - protein, 633 aa, Salinibacter ruber DSM 13855
MLTLIRQGRIAKWFSGYGQEAVAAGTAWALDDRDYILPMHRNLGVWTTRDVDRERLFCQLMGKKGDFTNGRDRTFHFGLPAKNLVGMISHMAAMLPVACGLGQAVRFREADRVACAFCGDGGTREGDFHEALNLASVWDLPVLFLVENNGYGLSTPTDEAVAPDDIADAAAGYDMPGMIVDGNDVFAVIEAVREARAHARTEGPVLLEMKTFRVRGHEEASGTAYVPDELIEEWKEKDPLDRFAARVREEGLLGADRMESIRAELESAVDELAEWALDRPAVTSTPEAERDAVFAPSPDPDPPSPDADTEETRFIDAIQDGLRAAMRDDDEVIVMGQDIAEYGGAFKVTDGFVDEFGSKRVRNTPIIEDGALGAGMGLSIEGLPAVVEMQYADFISCGFNQTVNNLATTHYRWGQPVNVTIRAPFGGGIGAGPFHSQSREAWFTHTPGLKVVVPATPRDAKGLLRTAVADPNPVLFFEHKKLYRSVRGAVPTEAYTLPFGEARVAREGTDATIVTYGVGVHWALAEAEHQAEANGVELEVVDLRTLVPWDRDTVRQSLDKTNRLLVLHEASRTAGFGAEVAAELGEIGFELLDAPITRVAAEDLPVPNAKPLEDEIFSATARLRPKVEDLLAF

SEQ ID NO: 33603 - protein, 642 aa, Neurospora crassa
MKRFSQRVLSRTKDKDSKSKKNKDAKDGTASPNSQGSREATQSPVLTPSSSTSTLVNDSRNKPLPPNNAAHGDHGNSMLGPQGGNSNPGAADRFSSIGGQQQGANGGSTPVRHGTLPPTVIISPSAPHVPPPGAAETMPHDLAPPKAGQKSLMFDRLHQTPKDVLEGLRTPKRQNSSRFDISAHRELEKLPGFHEVAPNHRQDLFMKKIEQCNVIFDFNDASADMKSKEIKRLALHELLDYVANNRQVITEPMYPRVVEMFAKNLFRPIPPPMNPQGEAFDPEEDEPVLEVAWPHIQVVYEFFLRFIESQDFNTNIAKAYIDHSFVLQLLELFDSEDPRERDFLKTTLHRIYGKFLNLRSFIRRSINNVFFQFTYETERFNGIAELLEILGSIINGFALPLKEEHKLFLTRVLLPLHKVVLGLLRYWPKVNSTKEVMFLNEVEDIFEVMDPAEFAKVQEPLFHQLAKSVASPHFQVAERALYFWNNEYFCNLVSDNVEIILPIMFAPLYENSKGHWNRTIHGMVYNAMKLFMEINPQLFDDCSHEYTENQSNAPAREAHRQSKWARLEELAKQRKVESGTSNGTSSIPARTTVHPLPRLEEVDGTEDNQKRLDSLKLQDGDRRERRPGMHERQSSVGSSRSR

SEQ ID NO: 33604 - protein, 576 aa, Schizosaccharomyces pombe 972h-
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSFPFLDLCAMLVCKLFSA

SEQ ID NO: 33605 - protein, 660 aa, Sinorhizobium meliloti 1021
MISREKHDRMANAIRFLSMDAVEKANSGHPGLPMGAADIATVLFTRYLSFDPKNPAWPNRDRFVLSAGHGSMLLYSLLYLTGYDDITIDEIKNFRQLGSRTAGHPEYGHAAGIETTTGPLGQGIANSVGMAIAERKLREEFGSELMEHYTYVLAGDGCLMEGISQEAIALAGHLKLNKLIVFWDDNNISIDGPISIADSTDQHARFRASKWHTIAVDGHDPEAIAAAIEEAHKSDKPTMIACKTVIGFGAPNKAGTHKVHGSPLGAEEIAATRKALGWEAEAFTVPSDVLDAWRIAGLRSAKARKEWEERLEAAEAEKKAQFVRRFSGELEGSLASAIGAYKQKLAETKPSPATRKASEDALEVINGVLAETIGGSADLTGSNNTKTSQTHSITPDDFSGRYIHYGVREHGMAAAMNGMALHGGLIPYSGGFLIFSDYCRPSIRLAALMGIRVIHVLTHDSIGLGEDGPTHQPVEHMAALRAIPNLLMFRPADATETAECWQLALENRKRPSGLALTRQNLMAVRTEYEEQNLCARGAYDLISASDAQVTIFATGSEVEIAVKACQTLTAKGIATRVVSVPCFELFAEQSEDYQQAIIGTSPVKIAVEAGIRQGWDHFIGNDGIFIGMSSFGASGPYKDLYKHFGITPEVVVASAEAKLS

SEQ ID NO: 33606 - protein, 336 aa, Sinorhizobium meliloti 1021
MTVKVAINGFGRIGRNVLRAIVESGRTDIEVVAINDLGPVETNAHLLRFDSIHGRFPADVKVDGDAIVINNGKPIKVTAIRNPAELPHKELGVDIAMECTGIFTARDKAAAHLEAGAKRVIVSAPADGADLTVVYGVNHDKLTKDHLVISNASCTTNCLVPVAKVLHDAVGIDHGMMTTIHSYTNDQPSLDQMHKDLYRARAAALSMIPTSTGAAKAVGLVLPELKGKLDGISVRVPTPNVSVVDLKFVAKRETTKEEINAAIKAAADGPLKGVLGYTLAPNVSIDFNHDPRSSVFHMDQTKVMEGKFVSILSWYDNEWGFSNRMSDTAVALSKLI

SEQ ID NO: 33607 - protein, 129 aa, Picrophilus torridus DSM 9790
MNHDPLNDVINTIKNASRIGKSEVIIGPASVMIGRILKVMQDYNYIKSFEVIEEERGGKFRVELSDTINNCGVIKPRLSVKNSNIERYESRYLPAQDFGIIILTTTKGIMSHIEARKLGIGGKLLAYVY

SEQ ID NO: 33608 - protein, 399 aa, Sinorhizobium meliloti 1021
MTFKTLDDLTDIAGKRVLVRVDLNVPVKDGQVTDTTRIERVAPTIRELSEKGAKVVLLAHFGRPKGEPVADMSLKAIASAVEEILDQRVYFAADCIGDKAANAIAELNDGEVLLLENTRFHKGEEKNDSDFVTALAANGDIYVNDAFSAAHRAHASTEGLAHHLPAYAGRTMQAELEALEKGLGNPKRPVVAIVGGAKVSTKIDLLQNLVKKVDALVIGGGMANTFLAAQGVDVGKSLCEHDLAETAKAILAAASEAGCAIVLPVDGVVAREFKAGADNEVVDIKAIPADAMVLDVGPKSIEAINEWISRAETLVWNGPLGAFEIAPFDRATVAAAKHAAARTRAGSLVSVAGGGDTVAALNHAEVADDFTYVSTAGGAFLEWMEGKPLPGVDVLRQRN

SEQ ID NO: 33609 - protein, 343 aa, Mycobacterium avium subsp. paratuberculosis K-10
MRIGVLTGGGDCPGLNAVIRAVVRTCDSRYGSSVVGFQDGWRGLLENRRIQLHNDDRNDRLLAKGGTMLGTARVHPDKLRAGLNQIKQTLDDNGIDVLIPIGGEGTLTAAHWLSEENVPVVGVPKTIDNDIDCTDVTFGHDTALTVATDAIDRLHSTAESHQRVMLVEVMGRHAGWIALNAGLASGAHMTLIPEQPFDVEEVCRLVKRRFQRGDSHFICVVAEGAKPIPGSISLREGGIDEFGHERFTGVAAQLGAEVEKRINKEVRVTVLGHVQRGGTPTAYDRVLATRFGVNAADAAHAGEYGQMVSLRGQDIGRVPLADAVRQLKLVPESRYDDAAAFFG

SEQ ID NO: 33610 - protein, 542 aa, Triticum aestivum
MDPAAAAARRQADKWMSVAEKLLMAKDLEGCKEFSSQAIAADPRTPGAEDLYAAADVLLASQRRRLPNGKPDPYAVLGLDPAMPASRLPDVVHSKFRRLSLLLNRSHPDRPCSVYVAEAARLVADAWAFLSNAGLKSALDAELDAAAAPRPPMQQPAVERRPHPSPPPQQSPVWAAPQPRPHPQRIPVRPAPQPTPPLQPSSLRAATQTPPPPQSSSLRAATQTPPPPQPSSLRAATQTPPPPQPSRLQPATQPQPSPQPSPLQAATKPPPSPQPSPLQAATKPPSSPQPSPLQPATQPPPPPQPSPLQAASQPPARAATPPVESGTLPASTFWTLCKGCSHIHQYDRLYEARKLKCSSCHQPFVAEAMAEPPPIVPGTDMYYCTWGFFPIGFPGCPGYVDLVNSQPQGSGQLNVPWLGANGRVAAENGTPITIGAAREEPVASEPSPEPLMRTRVEVPLVLEPAPEPLMRMRVGVPAMPEPVMPTRVEVPAAPEPVMPTRVEVPAAPEPVQPTRVKSVKVGAKKRGRPKGSKNKKNLRVVT

SEQ ID NO: 33611 - protein, 505 aa, Arabidopsis thaliana
MDFGRSRDIISGLPDSLLCHILSFLNTKEAASTSVLAKKWRYLFASVPNLDFDDSVHLRLGKRNPAVSGEDYLKMINERSDQLSTSFMDFVDQVLRLQDNSPLHKFSLKIRDCVDIVRIICWILKVLERGVSDLELDMHLKWKSSLPSKIFLSETLVRLKLSVERGPFIDVEDVHLPKLKTLHIVSVKFEKHGIGLNKLLSGCHILEELNLEYISWCLWDFVSVSLTTLKRLTFCGEVMQDENPISVSFNTPNLVYLMFTDAIADEYSTVNFDSLVEAHINLQMSEDQVEQTRFSDSEGNMEGCMVANATELIMGICNVKILYLSVYTLEVLTYCCEAIPLFNNLTHLTIESNSEVGWESVSGLLKNSPNLETLVFKGLVHRFTDKCGDMCLCKPWEEDEEEEEDEETPTCLSSCPVKVLKILEFGKIYDDEIEKRIDQVKHFLEKIPDIEQLILHYNTPVDEDVIKVYQQLRRHPKVASSKCKLQLISDNLSLSSKDCALFGID

SEQ ID NO: 33612 - protein, 429 aa, Sulfolobus tokodaii str. 7
MRKLLRDEVLEVLKSGRVDYVRVVFADILGNSRGRSLRRIEFEKSLNKGIEYSEALLYLDYKDTPIKQRYGDIFAVPDISTFVLIPYLERTARVLSFLTTQDNSPHPLCTRSLLTRSIDKLAELGYNIKVAFEPTFYLINFKDGKPVPADEARAFSSEGLMEQQNFLRDLIKYLESVNIQVQYINKHYAPGQYEITFSMGEALEEADSLITAREIIRDTARLYHLYSTFMPKPFKEYPSSSMDIYIKLVDTQNKSVGVDTSDPRGLGLSKILYSFLAGILEHISSILAIAAPTINSYKRYREVVTPNVAGIGNERHFIIRIPSTYRDLGVFEFRLADPLANPYLLLSSMIFAGIDGIEKGLDIDVNYEVSTLPTNLKEALYKLDSDTKLKYYLGKELVDTFIELKKKEIEDYEKEITEWEINSYLKSGW

SEQ ID NO: 33613 - protein, 556 aa, Ralstonia metallidurans CH34
MLLTSQAPILASVRDDRARAVMVESKSLIFRAIHPLSGLSSRRVSDCDGFAPCTDTSTMTMTTTQDQAPAAEQTFESFGLDPRILRALTEQGYTKPTPIQAQAIPVVLLGKDVMGAAQTGTGKTAGFALPIIQRLLPLANASASPARHPVRALMLTPTRELADQVYDNVARYAKHTDLRSTVVFGGVDMNPQTDALRRGVEILVATPGRLLDHVQQKSVNLSQVQMLVLDEADRMLDMGFLPDLQRIINLLPAQRQTLLFSATFSPEIKKLASSYLKQPVTIEVARSNSTNENVRQVVYQVQDGHKQAAVVHLLKQRANEQQSRQCIVFVNSKIGCSRLARHLEREGINAAAIHGDKTQTERMQTLDGFKNGTIDALVATDVAARGLDIPAMPCVINFDLPFSAEDYVHRIGRTGRAGASGDALSIFVPGNDDRLLADIEKLIKRSIPRGSLDGFDPTGERARQEDSDRRRARTEVRRVRDNGEGEEQQRRRRTEPNGRQAFRPSDDPFFSRPYEPSGSYTPAPKTEEQLAAALTRGRQAPKRPVAALLGGVPRKS

SEQ ID NO: 33614 - protein, 201 aa, Streptomyces avermitilis MA-4680
MKELLDHARSFKRQVDFESGEYRKLAEGQYPEALFITCSDSRVIPALITGARPGEIFELRNAGNIVPPHGQHGASGEAATIEYALEVLGVQNVVVCGHSHCGAMGALKSGDDLSMLPGVDAWLELARPDLAPMLGTACDDPSLPDVAQCNIVNQLSTLRSYPVVRQRLETGLLRLHGWYYEVDTGQVYELDDDGRFRVHAG

SEQ ID NO: 33615 - protein, 474 aa, Oryza sativa
MNLAGFLATPATATATRHEMPLNPSSSASFLLSSLRRSLVASLRKASPAAAAALSPMASASTVAAENGAAKAAAEKQQQQPVQSTLGPGVTVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 33616 - protein, 296 aa, uncultured archaeon GZfos37B2
MVLMDLKGVMPALMTPFTPDRKIDGTGFKDNIRYMIEHGVSSIVPCGTTGESATITLEEHKQLIDIAVDCSTVPVIAGTGSNNTSEAIELTRHATDAGTDASLLITPYYNRPNQNGIIAHFDAIASAVDIPIILYNIKSRTGINLEPELIAKLAEIPNIIGVKEASGNLGQVSRIIELTRDSDFIVISGDDALTLPIMSLGGVGVISVIANIVPAQTVAFVNAILANDRDEARRLHYQLAPLVRAMFIETNPIPVKTAAGMIGRAAGPLRLPLAPMSAQNEQKLRSALVSAGLLKG

SEQ ID NO: 33617 - protein, 868 aa, Streptomyces avermitilis MA-4680
MSTTALVGTGHRPTIVLVGHGMVGQRFLEALAERGLTATHRVVVLCEEPRPAYDRVQLTSYFSGTTPDELSMTDAEFITEHGIDLRLGDPAETVDREARTVTARSGLVIAYDTLVLATGSYPFVPPVPGKDAEGCFVYRTIEDLLAIEAYAKSRATTGAVVGGGLLGLEAAGALKGLGLTSHIVEFAPRLMPVQVDAGGGAALLRTIEDMGLTVHTGTGTQEIVTGDDGAVTGMKLSDGSELATDLVVFSAGVRPRDQLARDCGLPVGERGGIAVDAQCRTEDPHVFAIGECALAADGRVYGLVAPGYEMAETAAATIASADSSFTGADLSTKLKLLGVDVASFGDAHGATAGCLDVVYADSRSGTYKKLVIGRDGELLGGILVGDADAYGTLRALTGSVPPVSPEQLVLPAGGGGGVALGPSALPDSAVICSCHNVTKGAIRGAVTEHSCTTLPEVKKCTKAGTGCGSCVKVLGQLVNDELTASGVEVDHGLCGCFTQTREELYEIVLALRITSYRSLLDRYGREGARGGDGCEVCKPTVGSIIASLAPTIGANGYVLDGEQSALQDTNDHFLANLQKNGSYSIVPRIPGGEITPEKLIVIGEVARDFGLYTKITGGQRIDLFGARVEQLPLIWTRLVDAGFESGHAYGKSLRTVKSCVGQSWCRYGVQDSVRMAIDLELRYRGLRSPHKLKSAVSGCARECAEAQSKDFGIIATANGWNLYVGGNGGATPRHADLLAQDLSDAELVRLIDRFLMFYIRTADRLERTSVWLERIPGGLDHIRDVVVHDSLGICEELESLMTAHVANYRDEWTETINDPEKLARFVSFVNAPDTPDPVVGFVPERDQIKPDLPLLTIGHRPLEGSAQR

SEQ ID NO: 33618 - protein, 237 aa, Frankia sp. EAN1pec
MGHESGALDPVRSGAGGNARPDFAHAVVFDLDGVVVDSFAVMREAFRIAYSEVVGAGPAPFGEYHRHQGRYFRDIMRIMGLPAEMEEPFVRESHRLRAEVLVYDGVVDLLDTLRHRGYGLAVATGKTGSRARDLLAHLGLLRFFHHVVGSDEVARPKPAPDIVLRALDLLGARPERALMIGDAVTDLRSAHDAGVRAAAALWGSPDEAELLAGGPDLVLRRPADLLTVLPAQPASVG

SEQ ID NO: 33619 - protein, 888 aa, Sphingobium yanoikuyae
MKTVYTFGPGIAHDDSRARDKAVVGGKGANLGEMARIGLPVPPGFTITTEECLHFLRDRHSQSARLDGEVRSALTHIERTVGKRFGDRHDPLLVSVRSGARVSMPGMMDTILNLGLNDQTVRGLAASSGDERFAWDSYRRFVQMYASVVLGIDHARFEDALEKAKEDRGVSQDVDLSATDLRDLIGEFFGIVEAERGAPFPQDVDEQLASAIAAVFESWESDRAKVYRRLNGIPGEWGTAVNVQAMVFGNLGETSATGVAFTRNPATGDKAYYGEWLVNAQGEDVVAGIRTPQYLTLAARTAAGAKLPSMEEALPAVFTELARLFELLELHYQDMQDIEFTVERGKLYILQTRSGKRTAKAALKIAVDMVEEGLIAEEAAIRRIDPASLDQLLHPTLDPDAPRTLLGSGLPASPGAASGAVVFDADTAAVRAELGENVILVRQETSPDDIHGMHVARGILTAKGGMTSHAAVVARGMGRPCVSGASSLSIDYQARSAEIGGVHIAEGDLITIDGSTGEIFQGALPTVMPELDREFATVMAWADRHRRMNVRTNAETPADCEVARQFGAEGIGLCRTEHMFFDGERINFMRQMILAANVAERLVALDRLLPEQRSDFARIFEIMQGLPVTVRLLDPPLHEFLPHSESEFTELSAAVGIGVDQLRRRAEELAESNPMLGHRGCRLGVVYPEIYEMQARAIFEAACAVSRETGQPVVPEIMIPLVGTARELDMLKRIVIGVSEAVFAEQGLTVEFTVGTMIELPRAALVADEIAKVGEFFSFGTNDLTQTTLGISRDDAGRFLGSYIDKGIFATDPFVSIDVEGVGKLIAMAARLGREARPDIKLGICGEHGGDPASIAFCDRVGLDYVSASPFRVPIARLAAAQSALAAT

SEQ ID NO: 33620 - protein, 664 aa, Gibberella zeae PH-1
MDPLNSTSSGPGQDGLPKAPSQFAILDFIFPGFSTFSSIIHAYLGIDLNVYIPLLLIVSGIMFVWNYITEYSWSIIGQHLMSAVRIRTDDEIYNIVMAWVAKQRFSQGSRRFMVNTNINSRSWFLYCWNDDEDEDESESRKPLQYTPSVGSHFFWYKGHILLFERHENRDRSPFISSSSEELSISCFGRNPRIIKELLLDAQEQYIKKDEQQTVIYRGSLGSNGGDPTWQRCLSRASRPISTVILDEKTKSELIEDVTDYLNPNTRRWYSNRGIPYRRGYLLYGPPGTGKSSLSLALAGFFRMRIYMVSLSSILATEENLASLFAELPRRCVVLLEDIDSAGLTHTREEKKGDNSTEIDTVVPVPAAPAQPGAPPTTAPMPPGRLSLSGLLNILDGVASQEGRILIMTTNHLEKLDKALIRPGRVDKIVQFGLADDEMSASIFRAIYAPYEGEDVDVGAAKVKYLDIEEAQKHAALAEKTRLGTLERISALATKFAAKIPSLEFSPAEIQGLLLKNKRNPEAAIDAIDDWVVETRKERKQKEIEAAEKRRKEEADAIKAEAKKKRKEERKKAKKAKAKAKRKSNGESSGSDSDSDSDSDSEAETKSDNKKEDTDKKDDKPADKPKETEAEVDEKKDSKVEEESTGESKPKGTSDSGYDTPNPIS

SEQ ID NO: 33621 - protein, 143 aa, Sphingobium yanoikuyae
MNRYTIANIPGDGTGREVLPAGVQVLSAVAQRCGFALEFRDFDWSCETYLATGKMMPDDGLTRLADHDAIFLGAVGYPGVPDHVSLWGLLLPIRREFDQYVNLRPVRLLPGIRSPLREKSTGDIDFWVVRENSEGEYSQIGGR

SEQ ID NO: 33622 - protein, 448 aa, Salinibacter ruber DSM 13855
MPESSANQEELERTLGLVPALAIGTGTMVGAGIFVFPGLAAGRAGPAAMLSFAIGAVIALLVALPTSELATAMPESGGGYFFVSRALGTLLGCMVGVGQWLGLIFASAFYLIGFGHYLSDLARELGVTLPLPVVGLAFGMGILLTGVSVTGTENTGDLQNWIVGSLLAILAGFLGHGGLDALGVFGRQQTPEAFFPYGTMPVLTTAALVFTSYLGFVQIATVAGEIKAPSRNLPRSMIGSVLLVGTLYVLTIFISTSLLGSESLAEMGETAAVNVGRSIAGTFGAAALLGGGLLATLSSANASILSASRSIYALSRDELVPSQVERINRRYRTPHVALLLTGGIIVALILFGRVEVLAEVASLLHLFMYGLICVALLVLRQSPPSGYQPSFRCPGYPVVPVLGALTSFGLVAFMNPLSIAIGGGILLATAGWYLLYARAVTISEISSS

SEQ ID NO: 33623 - protein, 121 aa, Yersinia pestis KIM
MRKQEMTTIDKIQRQITENPILLYMKGSPKLPNCGFSAQAVQALSACGERFAYVDILQNPDIRAELPKYANWPTFPQLWVDGELVGGCDILMEMYQRGELQTLLKETADKYRSQEDQPAAE

SEQ ID NO: 33624 - protein, 451 aa, Burkholderia mallei ATCC 23344
MTDLARQLDVQQFIDERRFSPYQWLILILCFLIVAADGFDTAAIGFVAPALAQQWHVTKAALGPVMSAALVGLALGALAAGPLADRIGRKRVLVGSVVLFGLFSIGCAFTQSVTELAVLRLLTGLGLGAAMPNATTLMAEYAPHAKRSFLVNTMFCGFTLGSSAGGLVAAALIPEHGWRSVFIVGGIVPLALGALLIALPESIRFMVLRGAPHERIAAVLRRIAPDAAFDGVRFVLPDDRGEQRRSGAAVVLSPRYRAGTAMLWLTYFMGLLVYYLMTSWLPTLIRDTGFTVRDAALVTALFPLGGGIGAIACGWLMDRIEPHRVIAFAYALTALFVWMIGLQAGHLALLATVVFVAGVCMNGAQSSLPALAAAFYPTSGRATGVAWMLGVGRFGGILGAFSGGLLLQAQLGFGTIFSMLAVPALIAAGALMVKRSAASRETQPDAPTRAA

SEQ ID NO: 33625 - protein, 341 aa, Sinorhizobium meliloti 1021
MSERLEDIAVAMVANGRGLLAADESTATIKKRFDSIGLESTETSRRDYREMLLRSDDAMREYISGVILYEETLFQKAADGTPLADVIRNAGSIPGIKVDTGAKPMAHFPNETITEGLDGLAARLARYHEAGARFAKWRGVIAISDALPTWGAIRANAHALARYAALCQEAKIVPIVEPEVLMDGAPGDHSIERSEEVTEWVLRTVFEELGELRVRLEGMILKPSMVIDGKKARKASVDEVAERTIKVLKRTVPAAVPGIAFLSGGQSTEEATAHLSAMNAAHDLPWKLTFSYGRALQQEALNAWGGKSENVAAGQRAFAHRAKMCSLAAKGSWTKDFEKAA

SEQ ID NO: 33626 - protein, 332 aa, Schizosaccharomyces pombe 972h-
MNSNFSYPALGVDGISSQISPIRDVWSTNLQQEMNLIMSLIERYPVVSMDTEFPGVVARPLGVFKSSDDYHYQTLRANVDSLKIIQIGLALSDEEGNAPVEACTWQFNFTFNLQDDMYAPESIELLTKSGIDFKKHQEVGIEPADFAELLIGSGLVLQEEVTWITFHSGYDFAYLLKAMTQIPLPAEYEEFYKILCIYFPKNYDIKYIMKSVLNNSKGLQDIADDLQIHRIGPQHQAGSDALLTARIFFEIRSRYFDGSIDSRMLNQLYGLGSTGSVLWHNNSSTPQIQFRDLPGAHPSPTPSNAGIPTTLTNTSSAPNFANSTFRFPPRVV

SEQ ID NO: 33627 - protein, 622 aa, Burkholderia mallei ATCC 23344
MCGITGWIDFARDLRNEAPIVDTMTDTLARRGPDARGVWLDTHAALGHRRLSIIDPERGAQPMLTPERGPRGLPRAVISYAGETYNFRELRAELGALGHRFDTHCDTEVVLRAYLEWGAAFVDRLNGMYSIAIWDTARDELLLVRDRLGVKPLFYYPTADGVIFGSEPKAILAHPDVRARTSSEGLCDALLFLRTPGQVPFSGMREVKPGHVLRVRRGGLAEQRYWALEARPHTDDLPTTIATIRALLDDIVSRQMISDVPLCALLSGGVDSSTIAALAQKRRRANGGGALSTFCVDFTGHTRNFRADPIRPTADAPFALEVARHIGSDHHTIELDQAGLLDPQVREAVLRAWDLPFNFADLDVSLHRLFAEVRKHATVALSGEAADEIFGGYLWFSDPAARRAHTFPWLKLGAHRGLDPRALFHRSFIDALRLGEYEAQLYRAALAEVPRLDGENAEDRRTRELHYLTLTRWLPVLLDKKDRMGMASGLEGRVPFCDHRLVEYVFNIPWAMKTFSGQEKALLRAAAADLLPESVLNRKKAAYPSIQAPGYDRGLIERLNRAIAAGRAPLEPFIDAGALRGLTEKTAAGSLSEFERILLESSSRLNDWLDLYRVELDGVPAG

SEQ ID NO: 33628 - protein, 416 aa, Oryza sativa (japonica cultivar-group)
MAQQLSAPFRAAAAAGSRASAAAADPAKVSPSLPFLLCSLSLTFFPTPPPEFSRARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 33629 - protein, 371 aa, Aspergillus oryzae
MTLDVFKEDDKPFSVPIAEDSFDTYHLDPPPYSVETTKRELKQLYHDMTMIRRMELAADGLYKDRKIRGFCHLSTGQEAVAVGIEHALTKQDKLITAYRSHGFTLMRGGTVKSIIGELLGRRDGISYGKGGSMHMFCESFFGGNGIVGASVPVGAGIAFAQQYNDANNVTIDLYGDGAANQGQVHEAFNMAKLWNLPVIFGCENNKYGMGTSVERASAMTEYYKRGQYIPGLRINGMDVLAVLSAVRYGKNFIQAGNGPLVYEYMTYRYAGHSMSDPGIAYRSREELKDQRANDPISNFKERLIEWGVFSEEDAKAIDKNVRSKVNDEVAEAEKMPEPDTKLDILFEDIYVRGSEPQQRRGRTIDETYYRG

SEQ ID NO: 33630 - protein, 188 aa, Sulfolobus tokodaii str. 7
MKIAVIYFGGQYNHLIVKDLKYLGLNAVLITPEKPVEILKDYDCIIFGGGPYSVITELNKMGNAVDYVLRTSQPKLGICLGHQLLAKVLGGEVTKATKPEYGLVKVNINDEDTILRGLSPSINAWESHTDEVISPPQGFRILANSENAKVQAMVNKDNTIFGVQFHPEVKHTEKGIEVFKNFIEACKK

SEQ ID NO: 33631 - protein, 323 aa, Idiomarina baltica OS145
MDLKSINDLAQKDMQGVNALIGEQLSSDVALINQLGMYIVNSGGKRLRPLLAVLSCRALGYEGRAHLSLATIIEFIHTATLLHDDVVDESELRRGRKTANAVFGNEASVLVGDFLYTRAFQMMVQLDSMTILSILADATNVIAEGEVLQLMNCNDPDTTEARYFDVIYGKTAKLFEAATQLAGVLTEQDSTVTEQLADYGRYLGTAFQLVDDLMDYTSDSQTMGKNAGDDLAEGKPTLPLLYAMWHGDEAARKLIREAIEQGDGREHLETVLAAMHATGALEYTRQKALEVAQQARESLAVLPESDYKQALIALTHLAVDRVA

SEQ ID NO: 33632 - protein, 576 aa, Thermotoga maritima MSB8
MKRLRVTLAQLNPTLGDFEGNLKKAIEALRVAEDRGSDLLVFPELFLPGYPPEDLMLRLSFLRENRKYLQKFAQHTRNLGVTVLMGFIDSDEDAYNAAAVVKDGEILGVYRKISLPNYGVFDERRYFKPGEELLVVKIGNIKVGVTICEDIWNPVEPSASLSLGEGVHLIANLSASPYHVGKPVLRKDYLSMKAYDYHVAMAYCNMVGGQDELVFDGGSMVVDASGEVINYGKLFEEEIITVDLDLDENLRVSLVDPRRRYMKTQNYPVKTVEAGNLREKSGHFEPVVNPLPVREEEMFRALITGLRDYVRKNGFEKVVIGLSGGMDSSLVAVIATEALGKENVKGVLMPSMYTSKESIEDAQTLAKNLGIETFIIPITDVFHSYLETLKGVFAGREPDITEENLQARIRGNYLMALSNKFGWLVLTTGNKSEMATGYATLYGDMAGGFAVIKDVYKTDVYRIGRWYNSWRGKEIIPENIFVKPPTAELRPGQTDQEKLPPYEVLDEILRLYIEEGLDPEEIASKGFDRKTVLDVTEMIRKNEYKRKQAAIGVKISTRAFGKDWRMPITNRFKEPL

SEQ ID NO: 33633 - protein, 394 aa, Synechococcus sp. RS9916
MGTYGRFPLTLTRGKGCWVEDEQGHRYLDAVAGIATCTLGHSDRAMRHALSRQLRRLQHVSNLYEIPEQIELASWLVHHSCADSVFFCNSGAEANEAAIKLARKHGHTLRGIDRPVIMTAQASFHGRTLAAVSATGQPRYHQGFEPMVEGFENFIYNDLASFESLLSRLEMHGPKVAAVLIEPLQGEGGVNPGDPAVFRAIREHCDARNILLIFDEVQVGMGRCGTLWGYERLGVEPDAFTLAKGLGGGHAIGALLVKQHADHFVPGDHASTFGGNPFACRAGLTVARELQRRDLISNVQQRGDQLQQGLNALVERFPQLLQGTRGWGLLQGLVMQEGCGHAAIDVVKAAIAQRLLLVPAGPQVVRMVPPLVISKREINTLLSRLDATLKSLST

SEQ ID NO: 33634 - protein, 145 aa, Oryza sativa (indica cultivar-group)
MACVAALEAALLPCLPARELQAVDRSLQSSHQIDVERHARDFMEAAKKLQSYFISLQREDRPSTEEMLRKNLDEKLNCLRELLILGKAAAAKSSLKHALGWDIAIMEEELKTKSELIDKHKKLIEGWQKELKDQLGKHVTELERV

SEQ ID NO: 33635 - protein, 83 aa, Triticum aestivum
ADLYETEDEISRLLSEGKVPIGVGENTKISNCIIDMNARVGRNVSITNTEGVQEADRPELGYYIRSGIVVILKNATIKDGTVI

SEQ ID NO: 33636 - protein, 421 aa, Streptomyces avermitilis MA-4680
MVDADQTFVIVGGGLAGAKAAETLRAEGFTGRVILICDERDHPYERPPLSKGYLLGKEERDSVFVHEPAWYARNDIELHLGQTVDAVDRAAKTVRFGDDGTLVHYDKLLLATGAEPRRLDIPGTDLAGVHHLRRLAHAERLKGVLAALGRDNGHLVIAGAGWIGLEVAAAAREYGAEVTVVEHGPTPLHGVLGPELGQVFAELHREHGVRFHFGVRLTEIVGQDGMVLAARTDDGEEHPAHDVLAAIGAAPRTGLAEAAGLTLADRAHGGGIAVDGRLRTSDPDIYAAGDVAAFHHPLFDTRLRVEHWANALNGGPAAARAMLGRDLTYDRMPYFFSDQYDLGMEYSGWAPPGTYDQVVIRGDAGKRQFIAFWVKEGRVLAGMNVNVWDVTEPIQALIRSGTPVDTEALANPHVPLETLTP

SEQ ID NO: 33637 - protein, 601 aa, Catharanthus roseus
MDSRRRSPTVTAKAAAGELPLAPHEGQNQQPSIPRSSDVLPLPLYLANGVFFTLFFSVMYFLLTRWREKIRNATPLHVVTLSELAALASLIASVIYLVGFFGLDFVQSLIYKPNNEGWEIEEEILMVEDSRNGTNCTTLGCAVPPPSVPKIAPVVPQQPSKMVIIEKPAPLITPQNSEEDEDIIKAVVAGKIPSYSLESKLGDCKRAAGIRREALQRITGKSLEGLPLEGFDYASILGQCCEMPVGYVQLPVGIAGPLLLDGREYMLPMATTEGCLVASTNRGCKAILASGGANSVLLRDGMTRAPVVRFGTAKRAAELKFYMEDAQNFETISVVFNKSSRFAKLQSIQCAIAGKNLYIRFSCSTGDAMGMNMVSKGVQNVLEFLQTDYPDMDVLGISGNFCADKKPAAVNWIEGRGKSVVCEAIIKEEIVKTVLKTEVAALIELNMVKNLAGSAIAGALGGFNAHASNIVSAIFIATGQDPAQNVESSQCITMMEAVNDGKDLHISVTMPAIEVGAVGGGTQLASQSACLNLLGVKGASKDSPGANSRLLATIVAGSVLAGELSLMSAISAGQLVRSHMKYNRSSKDITNVASSQLESDS

SEQ ID NO: 33638 - protein, 555 aa, Staphylococcus epidermidis ATCC 12228
MAQLSDLEIANLSKLKPISEIARKVGITEDALEPYGHYKAKIDINQIQEQEKKGKVVLVTAMSPTPAGEGKSTVTVGLADAFNKLNHNVTVALREPALGPTFGIKGGATGGGYAQVLPMEDINLHFNGDFHAITTANNALSAFIDNHLHQGNELGIDQRRIEWKRVLDMNDRALRHVNVGLGGTTHGVPREDGFNITVASEIMAILCLSRNIKDLKEKISRITIGYTRHHKPITVSDLKVEGALTLILKDAIKPNLVQTIEGTPALVHGGPFANIAHGCNSILATETARNLSDIVVTEAGFGSDLGAEKFMNIKAREAGFDPSAVVVVATIRALKMHGGVAKDQLQHENIEAVEAGLVNLERHVNNIKKYGVEPIVALNAFIHDTPSETACVKQWAKDNQVRIALTEVWEKGGEGGIELANQVFDVMQEPQNFKHLYELKQPLEAKIETIVKEIYGGSKVNFSSKAQKQLKQFKENGWDEYPICMAKTQYSFSDDQTLLGAPNDFEITIRELEAKTGAGFIVALTGAIMTMPGLPKKPAALNMDVTDDGKAIGLF

SEQ ID NO: 33639 - protein, 416 aa, Arabidopsis thaliana; identical to SEQ ID NO: 1417

SEQ ID NO: 33640 - protein, 147 aa, Triticum aestivum
  misc_feature (89)..(89): Xaa can be any naturally occurring amino acid
MAVTLMLVAALLCAAAAAAAAQQANNVRATYHYYRPAQNNWDLGAPAVSAYCATWDASKPLSWRSKYGWTAFCGPAGAHGQAACGKCLXRVTNPATGAQVTARIVDQCANGGLDLDWDTVFTKIDTNGVGYQQGHLNANYQFVDCRD

SEQ ID NO: 33641 - protein, 197 aa, Francisella tularensis subsp. holarctica
MNYSKAKYIMGAAKVSQLPEDTGVEVAFAGRSNAGKSSALNTLTDQKGLARVSKTPGRTQLINLFDLGNNNRLVDLPGYGYAKVSESIKRQWQSEMENYLTSRKCLNGIVLLVDSRHELKEFDSLMIEMAISFDLNLHILLTKADKLNNKERAQANRMIESFLKTFVSTDKISYQLFSSLTKMGLDKFKEKLDTWYQ

SEQ ID NO: 33642 - protein, 341 aa, Crocosphaera watsonii WH 8501
MPLTQETLLGKSVDELTTWIKQQGQPGYRGKQLHQWLYQKGVRSLTEISVFPKAFREDFKDYPIGRSNINHCTIAPDKTRKYLLSLADGLIIETVGIPTAKRLTVCVSSQVGCPMNCDFCATGKGEYDRNLSSAEIVDQILTVQEDFQERVSHVVFMGMGEPLLNTKEVVKAVKILNQDVGIGQRSLTISTVGIPKKILELAHHQLQVTFAVSLHAANQKLREQLIPSAKFYPLPKLLADCRKYVEITGRRVSFEYILLGGVNDLPEQAIELAKCLKGFQSHVNLIPYNPIEEVDYQRSNAESINIFKTILEEKNIAVSVRYSRGLEANAACGQLRAMSGV

SEQ ID NO: 33643 - protein, 555 aa, Oryza sativa (japonica cultivar-group)
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIISTEVAPFGGVKQSGLGREGSKYGMDEYLELKYICMGNLN

SEQ ID NO: 33644 - protein, 371 aa, Nicotiana tabacum
MPSRISDSFRAHSQKHLDLNSIKELPESHAWTSSNDYPSENSCNFESIPVIDLDNYINNNNINVLEHIGQACKKWGAFQIINHNISERLLQDIELAGKSLFSLPMQQKLKAARSPEGVTGYGVARISSFFSKLMWSEGFTIVGSPLEHARQIWPHDYQKFCDVIEEYEREMEKLAGRLMWLMLGSLGITKEEVKWAVCPKGESKGGSAALQLNSYPACPDPDRAMGLAAHTDSTILTILHQNNTSGLQVFKEGSGWVTVPPFPGALVVNVGDLLHILSNGLYPSVLHRAVVNRTRHRLSVAYLYGPPSRVKVSPLAKLVDQRHPPLYRAVTWSEYLGTKARHFDKALSSVRLCAPLSGFTDAKDHNGVQVG

SEQ ID NO: 33645 - protein, 1057 aa, Pediococcus pentosaceus ATCC 25745
MPKREDINKILVLGSGPIIIGQAAEFDYSGTQACLSLKELGYQTVLINSNPATIMTDTDIADKVYIEPLTLQFVSQILRKELPDAILPTLGGQQGLNMAMELSEAGILDELGIELLGTKLDAIDQAEDRERFRALMNDLNEPVPDSGIATTVEEAVSFADQSGYPVIVRPAFTMGGTGGGIAQDEAELRKITANGLTLSPVTQVLIEQSIAGLKEIEFEVMRDSVDNAIVVCNMENFDPVGIHTGDSIVYAPVQTLTDREVQMLRDASLSIIRALKIEGGCNVQLALDPAQDRYYVIEVNPRVSRSSALASKATGYPIAKVAAKIAVGLTLDEILNPVTGTTLAEFEPALDYVVCKIPRWPFDKFVRADRRLGTQMKATGEVMAVGRNVEEATQKAIRSLDIDINYIGDEELADLNEADLVDGIIHARDDRIFYLYEAIKRGYSVDKLADLTKINVYYLDKLLHIYEIEQELIATPFNADVLELAKKNGFSDEVIGKMWKTNEKEVRAYREQMGLSPVYKMIDTCAGEFESQTPYYYSTYELENESIVSNRKSIVVLGSGPIRIGQGVEFDYATVHSIQAIRQMGYEAIVVNNNPETVSTDFSMSDKLYFEPLTVEDVMNVIDLEKPEGVIVQFGGQTAINLAEPLAERGIKIFGTTVENVNRAEDRDEFNKLIQANGIRQPQGRTATTTSGAIEAAESIGYPVLVRPSYVLGGRAMEIVHAKEELENYMKNAVKVSHNHPVLVDQYLVGKECEVDVISDGENVVIPGIMEHIERSGVHSGDSMTVYPAQTLSQKVQDEIVKVSIKLAQSLECIGLMNIQFVVHNDEAYVIEVNPRASRTVPIMSKVTDLPMARLATRAILGESLVNQGLKPGLHPAGEIIHVKAPVFSFTKLDNVDSLLGPEMKSTGEVMGSDRTMAKALYKAFEGAKMHMPDHGKVLITVKDEDKGEAIDFARRFWELGYQLVATKGTAQTLAAHGLKVETVGKMTEENNIVDRIHDHRIQMVINTISDSTTSAADGIKIRSTALTYGVPLFTALDTVDAILQVLESQAFTTLHL

SEQ ID NO: 33646 - protein, 216 aa, Thermotoga maritima MSB8
MEAVIFDMDGVLMDTEPLYFEAYRRVAESYGKPYTEDLHRRIMGVPEREGLPILMEALEIKDSLENFKKRVHEEKKRVFSELLKENPGVREALEFVKSKRIKLALATSTPQREALERLRRLDLEKYFDVMVFGDQVKNGKPDPEIYLLVLERLNVVPEKVVVFEDSKSGVEAAKSAGIERIYGVVHSLNDGKALLEAGAVALVKPEEILNVLKEVL

SEQ ID NO: 33647 - protein, 377 aa, Thermotoga maritima MSB8
MVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 33648 - protein, 420 aa, Shewanella sp. ANA-3
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFEQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 33649 - protein, 752 aa, Shewanella sp. ANA-3
MTNPVPVNADGSTAYNLSAGQPFPLGATVDDGGVNFALFSAHATGVELCLFNARGEVEIQRIALTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLLDAAKAHTIRPLASKREPLPLEQCIIYEMHLKGFTALHPEIDAPLRGTFAGLASNAAIDYLVNLGVNCVELLPVQAFFSEPFLLEKQLSNYWGYNSIGFFAPEPSYLSGEDIGEFRNMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHAMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCAKRFIHEQLVANAFDWSSESSSTQAASPVSTPSGARLDWFSRQGEPMSKSLWSESMGRSLCVVLSGNLTATQPQTQGDSLQALLLMVNADEHPLAFTLPIFDGLGPWQCLLHTQTDPQFLTPTEPLDAQSSPTRYLLQDRSLMLFHADFIRN

SEQ ID NO: 33650 - protein, 185 aa, Arabidopsis thaliana
  misc_feature (86)..(86): Xaa can be any naturally occurring amino acid
  misc_feature (105)..(105): Xaa can be any naturally occurring amino acid
MAEEIKNVPEQEVPKVATEESSAEVTDRGLFDFLGKKKDETKPEETPIASEFEQKVHISEPEPEVKHESLLEKLHRSDSSSSSSSXEEGSDGEKRKKKKEKKRPXAEVEVKEEEKKGFMEKLKKKLPGHKKPEDGSAVAAAPVVVPPPVEEAHPVEKKGILEKIKEKLPGYHPKTPVEEEKKDKE

SEQ ID NO: 33651 - protein, 283 aa, Photorhabdus luminescens subsp. laumondii TTO1
MRVRRRLSRLGRLRKVKRLRHQRFRSRIFYRDNRLALNMKKPYIVVLTGAGISAESGIRTFRSSDGLWEEHRVEDVATPEGFQKDPELVQAFYNARRHQLQQSEIKPNVAHYALAALEHELGDNFLLITQNIDDLHERAGSYRTVHMHGELFKIRCCQSGQVFEWTDDLTTDERCHCCQFPSPLRPHVVWFGEMPLEMEQIYSALAQADIFIAIGTSGHVYPAAGFVHEAKLAGAHTVELNLEPSQVESLFDEKHYGPASKIVDEYARRLIDSIKEFKADLTQ

SEQ ID NO: 33652 - protein, 456 aa, Synechococcus elongatus PCC 7942
MRSDWIAPRRGQANVTQMHYARQGVITEEMDFVARRENLPADLIRDEVARGRMIIPANINHTNLEPMAIGIASKCKVNANIGASPNASNIDEEVEKLKLAVKYGADTVMDLSTGGGNLDEIRTAIINASPVPIGTVPVYQALESVHGRIEKLSADDFLHVIEKHCEQGVDYQTIHAGLLIEHLPKVKSRITGIVSRGGGIIAQWMLYHHKQNPLYTHFRDIIEIFKRYDCSFSLGDSLRPGCLHDASDDAQLSELKTLGQLTRVAWEHDVQVMVEGPGHVPMDQIEFNVRKQMEECSEAPFYVLGPLVTDIAPGYDHITSAIGAAMAGWYGTAMLCYVTPKEHLGLPNAEDVRNGLIAYKIAAHAADIARHRPGARDRDDELSRARYAFDWNKQFDLSLDPERAREYHDETLPADIYKTAEFCSMCGPKHCPMQTKITEEDLTELEKFLEKDSALA

SEQ ID NO: 33653 - protein, 524 aa, Synechococcus sp. RS9916
MSWPCIDADHCLVSTAEMVALEQEWLDSGLPVPALMEKVGLAMTAWCLARPELLTNGVLVLVGPGHNGGDGLVVARELSQAGIAVRIWCPLPLRQPLTQEHHRHLRWLNSPELQCSPDPSDPALWIEALFGLGQTRALPQELAELLKERQRHQPGRLISLDLPAGLDGDSGRPLDGTAAVAQATLTVGLVKRGLVQDAALDHVGQVHRIDAGVPQRLLDRFQAQPVLQVHDADLRSLPHPKHPRAAMKYQRGRVLVVAGSERYRGAALLALEGAQASGAGSVQAAVPESLASGLWQPLPELVLAAALPSDPSGGLIWGDWLNNADLQRLDAVLLGPGLGSNQTPWEHQAEGLKAFPGLLVLDADGLNQLAASGTGWHWISQREGPTWITPHAGEFKRLFPTIPLDYPLEAARSAARCSGATVLLKGAHSVVATPTGMVHQLISGDPATARTGLGDVLAGFAAGWGARAIAAQLSNQELPTMLTGAALLHGEAARRCQGSTTARSVATQLAELLREQECCNNTEA

SEQ ID NO: 33654 - protein, 618 aa, Thermus thermophilus HB8
MEKVFYVTTPIYYVNAEPHLGHAYTTVVADFLARWHRLDGYRTFFLTGTDEHGETVYRAAQAAGEDPKAFVDRVSGRFKRAWDLLGIAYDDFIRTTEERHKKVVQLVLKKVYEAGDIYYGEYEGLYCVSCERFYTEKELVEGLCPIHGRPVERRKEGNYFFRMEKYRPWLQEYIQENPDLIRPEGYRNEVLAMLAEPIGDLSISRPKSRVPWGIPLPWDENHVTYVWFDALLNYVSALDYPEGEAYRTFWPHAWHLIGKDILKPHAVFWPTMLKAAGIPMYRHLNVGGFLLGPDGRKMSKTLGNVVDPFALLEKYGRDALRYYLLREIPYGQDTPVSEEALRTRYEADLADDLGNLVQRTRAMLFRFAEGRIPEPVAGEELAEGTGLAGRLRPLVRELKFHVALEEAMAYVKALNRYINEKKPWELFKKEPEEARAVLYRVVEGLRIASILLTPAMPDKMAELRRALGLKEEVRLEEAERWGLAEPRPIPEEAPVLFPKKEAKVEAKPKEEAWIGIEDFAKVELRVAEVLAAEKHPNADRLLVLRLSLGNEERTVVSGIAKWYRPEELVGKKVVLVANLKPAKLRGIESQGMILAAQEGEALALVTVEGEVPPGAVVK

SEQ ID NO: 33655 - protein, 227 aa, Thermus thermophilus HB8
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERVAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 33656 - protein, 291 aa, Matthiola incana
QVPVVDLSCPDEELVARTVVKASEDWGVFQVVNHGIPTELIQRLQKVGREFFELPEAEKRSCAREAGSVEGYGRRIELDIKKRKGIVDQIYLSTWPPSSVNYRYWPKSPPDYREVNEEYARHVKTLSEKIMEWLSEGLGLGREAIKEVNGCWYVMNINHYPPYPHSDSFNGLEPHTDINGLTLIITNEIPGLQVFKDDHWIEVEYIPSAIIVNIGDQIMMLSNGKYKNVLHKTTVDKEKTRMSWPVLVSPTYDMVVGPLPELTSEDDPPKFKPIAYKDYVHNKITFLKNKS

SEQ ID NO: 33657 - protein, 353 aa, Aspergillus oryzae
MNSITTTVPLRAASLPKSYLHLTLRGCTGSVATAGLRCSSPLLASRINHQNTKRFISSTPQTQTKEFFPPPNAPHIKEVETAWAHPVYTEEQMRRVTVAHRETKDWADWVALGTVRLLRWGMDFVTGYRHPPPGKEHEAKFQMTEQKWLTRFVFLESVAGVPGMVGGMLRHLRSLRRMKRDNGWIETLLEEAYNERMHLLTFLKLAEPGWFMRLMVLGAQGVFFNGFFLSYLMSPRICHRFVGYLEEEAVLTYTRAIQDIEHGKLPKWTKLEAPEIAVQYWKMPEGQRTMKDLLMYVRADEAKHREVNHTLGNLNQAADPNPYSVKYKDPSKAHPGKGIANLKATGWEREEVI

SEQ ID NO: 33658 - protein, 486 aa, Rhodobacter sphaeroides 2.4.1
MIEKRDFYINGGWTAPAEARDCEVIDPSTEEACAVISLGDQADTDAAVAAAKAAFEGWAATPPAERLRLVKGILAQYEARKEEMAQAISLEMGAPIDLARNSQAPCLPWHLTNFLKAFEEIEWVRPLGPHAPNDRIALEPIGVVGLITPWNWPMNQVTLKVIPALLAGCTCVLKPSEEAPLSSLLFAEFVHDAGLPAGVFNLVNGDGAGVGTQLSSHPDVEMISFTGSTRAGRAISKAAAESLKRVTLELGGKGANLIFADADERAVERGVKHCFNNSGQSCNAPTRMLVERPLYDRAVEIAAEVAAKTRVASAHEEGPHIGPVVNKRQFEQIQSYIQKGIDEGARLVAGGLGRPDGLNRGFFVRPTVFADVTPGMTIEREEIFGPVLSILPFETEEEAVRIANDTPYGLTNYVQSEDGARRNRLARRLRSGMVEMNGKSRGAGAPFGGVKASGRAREGGVWGIEEFLEVKAISGWDPEAEALAAE

SEQ ID NO: 33659 - protein, 364 aa, Rhodobacter sphaeroides 2.4.1
MSRPLTFLGIESSCDDTAAAVVRAEGTRAEILSSVVDGQTALHAAFGGVVPEIAARAHAERLDLCVERALEEAGLGLRDLDGIAVTAGPGLIGGVLSGVMLAKGLAAGTGLPLVGVNHLAGHALTPRLTDGLAFPYLMLLVSGGHCQFLIARGAEEFSRLGGSIDDAPGEAFDKTAKLLGLPQPGGPSVEAEAAAGDPRRFAFPRPMLDRPGCDMSFSGLKTALLRARDGLVAEKGGLTRADRADLCAGFQAAVVEVLAEKTRRALAVYAAEGAAEPALAVAGGVAANGPIRAALTRVAEAAGVRFLAPPLRLCTDNAAMIAWAGIERFRAGGRDGMELSARPRWPLDRSAPALIGSGRKGAKA

SEQ ID NO: 33660 - protein, 177 aa, Photobacterium sp. SKA34
MKVIQILQEVTGAFAATIKHVWAPRDTVCYPEVKPDLPERWRGRIVLTRDPDGDERCVACYLCSSVCPANAITIQGAEREDERRYAKTFELDFSRCIFCGMCEEACPTLSIQCTTDFEMGKYSRDKLLYEKEDLLIDGTGKHPDFNYYKQAGVAITGKAIGDGENEKPPIDVYSLLP

SEQ ID NO: 33661 - protein, 160 aa, Nostoc sp. PCC 7120
MIIIIMGVSGSGKTTIGQMLAESLHWEFHDADSFHSPDNIEKMRRGIPLDDNDRIPWLQSLQTAIINWLQDNRNVVLACSALKASYRQFLVLDSDIKLVYLQGTFELIQTRLQKRENHFMNRELLTSQFASLEEPDNVILVDISQSPQVIVQAIRTMIKV

SEQ ID NO: 33662 - protein, 829 aa, Solanum lycopersicum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRSLAKQYFLDSQSLNLLFDDSSAGAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 33663 - protein, 387 aa, Bacillus sp. BSD-8
MSTHFDVIVVGAGSMGMAAGYYLAKQGVKTLLVDSFDPPHTNGSHHGDTRIIRHAYGEGREYVPFALRAQELWYELEKETHHKIFTQTGVLVFGAKGESDFVAETMEAAKIHSLEHELFEGKQLTERWAGVEVPENYEAIFEPNSGVLFSENCIQAYRELAEAHGAKVLTYAPVEDFEVSEDLVKIQTAKGLYTANKLIVSMGAWNSKLLSKLGVEIPLQPYRQVVAYFECNEEKYSNNVHYPAFMVEVANGIYYGFPSFGGSGLKIGYHTYGQEIDPDTINREFGAYPEDEANLRKFLEKYMPEANGEFKKGAVCMYTKTPDEHFVIDLHPKYSNVVIGAGFSGHGFKFSSAVGETLAQLAVTGKTEHDISIFSLNRDALKKEAAK

SEQ ID NO: 33664 - protein, 116 aa, Zea mays
MSQLSPAGHMAATLLLILLASAAAAAVSADQQVSACQNDIDALWRSCKQFVQKEGPKMPPSEDCCKTIKALDAHASCICDYVGSPDARNKLDLDKVFFVTKQCGVTVPKGCGSKQD

SEQ ID NO: 33665 - protein, 452 aa, Glycine max
MATHAALASTRIPSNTRFPSKASHSFPTQCALKRLEVTEFSGLRSTSCVTYANSARESSFFDLVASQLTPKQTNGSTPVRGETVAKLKVAINGFGRIGRNFLRCWHGRKDSPLEVVVVNDSGGVKNASHLLKYDSMLGTFKADVKILDNETITVDGKPIKVVSSRDPLKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 33666 - protein, 475 aa, Anabaena variabilis ATCC 29413
MSASSNSSKIKFGTDGWRGIIADDFTFPNVRKVTRAIASYLETAYTKDRPVLIAYDTRFLADQFAQTAAQVLADLGWNVKITDRDCPTPVIAYNARHLNSAGALMFTASHNPAPYCGIKYIPDYAGPATPEITDTIVANIESASDELPSGKPSGSISTFDPKPDYLQFIYTLLDVEKIKSAQLKVKYDALYSTSRGYLDEVLIESGTQLESFHTWRDVLFGGGMPEPKGEQLVELVEAVRRDHADLGLATDGDSDRFGIVDELGNVLTPNTVLLVLARHLIKNKGKTGAIVRTVATTHLLDNFAAKYGLTIYETAVGFKYIGEKMRETAVLIGGEESGGLSIIGHIPEKDGVLADMLIAEAIAYEGKPLSQLVKEAIAEADGPLYNNRLDLHLTEAHKVAVIDSFTKNPPSEVAGIKVKEVGRKDGIKLYLEEGSWVLLRPSGTEPLVRVYLETNSPEKLSKLEQELESTIAKLG

SEQ ID NO: 33667 - protein, 230 aa, Burkholderia vietnamiensis G4
MTQDELKRLVGQAAADYVIQNVPEGAVIGVGTGSTANCFIDALAAVKSRYRGAVSSSVATTERLKSHGIKVFDLNEIDALQVYVDGADEIDASGAMIKGGGGALTREKIVASVADTFVCIADGSKRVPVLGAFPLPIEVVPMARTAIGRRVAALGGVPVLRVTKDGAPYITDNGNEIIDVKGLQIAEPRAFEAKVNAWPGVVTVGLFAERGANLCLLGTENGVETIIYPA

SEQ ID NO: 33668 - protein, 383 aa, Oryza sativa
MQLLGAPPPVLPSGSAAPTNTPATAAAEEEEEESLLEGHKAAREWAQVHGQHEGRTWAVGSGAAATLGQSNGRDAPARAEDGSFGLVLLLFVPHLLLHARLWLLPPTFASQPQQFSQVTSAAESRRVELDLDATTSFFGVYDGHGGAEVAMYCAKRFHTMLLEDVDYINNLPNAITSDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEDPDEVASARDEHQHNPEGGDEKLDINNDND

SEQ ID NO: 33669 - protein, 565 aa, Photobacterium sp. SKA34
MNNNDRQLLIERFDAKAPNHEIIGCESFEVKKEHLIDTLHFLKNEASSRFEMLFDLSAIDECERGGGLSVFYYLLSVKNKQFISIRTHIANDTIEVPTVVGLWPNANWYEREVYDMFGIKFTDHPDLRRILTFDFWKGHPLRKSYPCRATLMDEPFDLEGPDFDDVMKSYDIQGKQDDGSMVLNIGPNHPGTDGVIRLKVKMKGEFIEDLDQEIGFHHRGAEKIAERHTFHNYIPYTDRIDYLGGVAGELPYLLGLEAMTGIEVPERAKTMRIMLCELFRISSHLVWFGSITHNLGGMAPAFYAFTEREKIFDVIELICGGRMHPAFFRIGGVSQDLPDGWQDKVEHACQGIEQLVPDLEKLMTHSMIFKIRTQNIAVYSQSMALDWGLTGPNLRATGINFDMRKDFPYMGYEDYDFDVPVGQDGDAYTRTVLRVQEVVESLKIIRQAAARMPEGPILADNAPSFGFPRKQNALRDIETLIHSFVDTGRGFNFPVAETFYATETAKGVTSYHTISNGTGCPYRVRIRTPSFTHFQSVKAVSKGDLLSNIICLIGSIDYVLADIDR

SEQ ID NO: 33670 - protein, 241 aa, Ralstonia metallidurans CH34
MIGVHHLEGHLLSPLLTSAPPPFPFVALLVSGGHTQLMEVKGIGDYKLLGETLDDAAGEAFDKTAKLLGLGYPGGPEVSRLAEFGNPGAFELPRPMLHSGNLDFSFAGLKTAVLTQTRKLSNACEQDRANLARAFVDAIVDVLAAKSFAALKQTGDKRLVVAGGVGANRQLRERLNEMGKRRKVEVFYPDLAFCTDNGAMIAFAGAMRLKAAPELARHGYDYGVTPRWDLADIRLPEARTS

SEQ ID NO: 33671 - protein, 363 aa, Synechococcus sp. RS9916
MGQDIAMETQQMAAGGGLTGAHAERLSSLVTASRASIDRDTGLALYRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKEHHLLGGYAFIGEGIPVALGAAFTSRYKRDALGEAGSDAVTAAFFGDGTCNIGQFYECLNMAQLWKLPIIFVVENNKWAIGMDHNRATSEPEIWRKAGSFGMAGEEVDGMDVLAVRAATERAVARARAGEGPTLLECLTYRFRGHSLADPDELRAEEEKQFWAQRDPIKALERDLVSAGLATADDLRTIEKEIDAEVQDSVDFALSAPEPDGSELTRYIWAED

SEQ ID NO: 33672 - protein, 130 aa, Glycine max
  misc_feature (89)..(89): Xaa can be any naturally occurring amino acid
  misc_feature (123)..(123): Xaa can be any naturally occurring amino acid
  misc_feature (127)..(127): Xaa can be any naturally occurring amino acid
MVRVSVLGDCLNNICNAERTGKRQVLIRPSSKVIVRFLTVMQKHGYIDEFEEIDDHRSGKIVIQLNGRINKCGVISPRFNVQLTQIENXVNLLMPARSFGYIILTTSAGIMDHEEARRKHVAXKILXFVY

SEQ ID NO: 33673 - protein, 434 aa, Photorhabdus luminescens subsp. laumondii TTO1
MTTPKKRIVIIGGGAGGLELATSLGHKLGRKKKAEIVLVDRNQSHLWKPLLHEVATGSLDDGVDALSYLAHARNHYFSFQLGALTDIHRDSKKITLNEIRDEYNEVLVPERELSYDILVMALGSTSNDFNTQGVKEHCIFLDNPQQAHRFHNEMLNLFLKYSANCGQQDKVNIAIVGGGATGVELSAELHNAVKQLNSYGFEGLNSEALNVTLVEAGERILPALPARISAAAHQELTKLGVHVLTKTMVTSADEHGLNTKEGELIKADLMVWAAGIKAPDFMKDIAGLETNRINQLVVKPTLQTTLDDHIFAIGDCASCSKKEGGFVPPRAQAAHQMASRCYSNIIALLHDKPLKEYTYKDHGSLVSLSKFSTVGSLMGNLMRGSMMIEGRIARAVYISLYRMHQVALHGYIKTGLMMLVGGINRVIRPRLKLH

SEQ ID NO: 33674 - protein, 449 aa, Manihot esculenta
MGHLVSAVETAKLLLSRCHSLSITVLIFNNSVVTSKVHNYVDSQIASSSNRLRFIYLPRDETGISSFSSLIEKQKPHVKESVMKITEFGSSVESPRLVGFIVDMFCTAMIDVANEFGVPSYIFYTSGAAFLNFMLHVQKIHDEENFNPTEFNASDGELQVPGLVNSFPSKAMPTAILSKQWFPPLLENTRRYGEAKGVIINTFFELESHAIESFKDPPIYPVGPILDVRSNGRNTNQEIMQWLDDQPPSSVVFLCFGSNGSFSKDQVKEIACALEDSGHRFLWSLADHRAPGFLESPSDYEDLQEVLPEGFLERTSGIEKVIGWAPQVAVLAHPATGGLVSHSGWNSILESIWFGVPVATWPMYAEQQFNAFQMVIELGLAVEIKMDYRNDSGEIVKCDQIERGIRCLMKHDSDRRKKVKEMSEKSRGALMEGGSSYCWLDNLIKDMIK

SEQ ID NO: 33675 - protein, 346 aa, Manihot esculenta
FCTPMMDLADEFGIPSYIFFASGGGFLGFMLYVQKIHDEENFNPIEFKDSDTELIVPSLVNPFPTRILPSSILNKERFGQLLAIAKKFRQAKGIIVNTFLELESRAIESFKVPPLYHVGPILDVKSDGRNTHPEIMQWLDDQPEGSVVFLCFGSMGSFSEDQLKEIAYALENSGHRFLWSIRRPPPPDKIASPTDYEDPRDVLPEGFLERTVAVGKVIGWAPQVAVLAHPAIGGFVSHCGWNSVLESLWFGVPIATWPMYAEQQFNAFEMVVELGLGVEIDMGYRKESGIIVNSDKIERAIRKLMENSDEKRKKVKEMREKSKMALIDGGSSFISLGDFIKDAMEG

SEQ ID NO: 33676 - protein, 394 aa, Manihot esculenta
DDFKDLGFIDKQKAHVKEAVSKLTARSDSSLAGFVLDMFCTSMIDVAKELGVPYYIFFTSGAAFLGFLFYVQLIHDEQDADLTQFKDSDAELSVPSLANSLPARVLPASMLVKDRFYAFIRIIRGLREAKGIMVNTFMELESHALNSLKDDQSKIPPIYPVGPILKLSNQENDVGPEGSEIIEWLDDQPPSSVVFLCFGSMGGFDMDQAKEIACALEQSRHRFLWSLRRPPPKGKIETSTDYENLQEILPVGFSERTAGMGKVVGWAPQVAILEHPAIGGFVSHCGWNSILESIWFSVPIATWPLYAEQQFNAFTMVTELGLAVEIKMDYKKESEIILSADDIERGIKCVMEHHSEIRKRVKEMSDKSRKALMDDESSSFWLDRLIEDVINNLS

SEQ ID NO: 33677 - protein, 118 aa, Photorhabdus luminescens subsp. laumondii TTO1
MIEETIFSKIIRREIPSDIVYQDDLVTAFRDISPQAPTHILIIPNVLIPTMNDVKPEHEAALGRMMTVAAKIAEQEGIAEDGYRLIMNCNRHAGQEVYHIHMHLVGGRYLGPLLMKSI

SEQ ID NO: 33678 - protein, 342 aa, Gibberella zeae PH-1
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWDDKTINYFNSLKQAQENGKPYSARYIGSMVADAYRTLLYGGIFAYPADKKSPKGKLRILYECAPMALIFENAGGQAVDSKMNRLLEVVPEHIHDKAGIFMGSYDEVEKVKKFHQ

SEQ ID NO: 33679 - protein, 198 aa, Oryza sativa
  misc_feature (135)..(135): Xaa can be any naturally occurring amino acid
  misc_feature (163)..(163): Xaa can be any naturally occurring amino acid
MRPPRGGGGGRFGGGGGGRFGGGGGRGGRFGGGGRGGRGGGGGFRDEGPPAEVVEVSTFMHACEGDAVTKLTNEKVPYFNAPIYLQNKTQIGKVDEIFGPINESLFSIKMLEGIIATSYSEGDKFYIDPMKLLPXLSRFLPQPKGQSQGGGRGGGRGGGRGRXSRGRGGGGFRGRGAPRGRGGPPRGGGRGFRGRGRF

SEQ ID NO: 33680 - protein, 540 aa, Burkholderia thailandensis E264
MTLNSLPVWPALQAHYEEIRDAHLRDWFAPANDRAPTRAERFTFEGGGLAADFSKNLITDATLALLVRLAREAGVEARRDAMFAGETVNPTEGRAALHTALRANSPDAPFHAQVAAERAKMARFADAVRAGAWTGYTGKRIRHVVNIGIGGSDLGPKMVVHALHHVATPDIATHFVSNVDGADLARVLERIDPQETLAIIVSKTFTTLETMTNARSLREWFVANGCPEDALAKHFVGVSANPAEVVKFGIAEANVFEMWDWVGGRYSLWSAVGLSIMIAIGPERFAELLAGAHDMDEHFRTAPLERNLPVLQGLVGIWYRNFFGAQSYLVAPYSEALHYLPSYLQQLEMESNGKSAQIDGAFVDYPTSAVTWGEPGTNGQHAFFQMLHQGPTLVPIDFIAVLTPEHPLASHHPKLLANCFAQSEALMLGRTLDEARKIAGPAHPELAPHLTFPGNRPTTTLLVDALTPRTLGALIALYEHKVLVQAAVWNINPFDQWGVELGKILGKVVEADLTAPQVDPAKHDSSTSALIARARKALGE

SEQ ID NO: 33681 - protein, 279 aa, Arabidopsis thaliana
MEYSRDSAEMMMETKRNVYSLEDNKIKRHKSSDLSFSSKERKDKLAERISALQQLVSPYGKTDTASVLLEGMQYIQFLQEQVKVLSAPYLQATPSTTEEEVEEYSLRSKGLCLVPLEYTSEVAQTNEKATMDHIAAAEEQIVSERLRRKLEEVNVAAQTQLSPIQDHINFTLQQAYFKCAYECFDRRRKQEEISNCVEHCSVPVVKSQQYFENEMAQFQERLNRSLVVCQDKFEASKLQKIRPEAVNEMESCVHKSIEENLNTLPHIVQRMKTAFNITN

SEQ ID NO: 33682 - protein, 212 aa, Oryza sativa (japonica cultivar-group)
MGFVTAAADAVVALLSLTMAVAAPLFDAQVVLPRGLYPAPLVGIHRWFAAEFGHYLVADPPPFFRGLVWLDLAFLWPVCVANLYGILARRPWSAATSIMAGVYVLTYMFCVVSAHAQHRLLLLHLMPQLLGRKGSRSDEYREIPKEVPIMVTSWIRYEDGCHAQCQGWWCNMGAGHPTGAAAISYGVGTQLPIGDLKDSWTIHEGKQSNLSF

SEQ ID NO: 33683 - protein, 274 aa, Arabidopsis thaliana
MPTLYKKAGCQFQLTTMGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 33684 - protein, 806 aa, Solanum lycopersicum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 33685 - protein, 556 aa, Aspergillus oryzae
MASEEQVQTKDTLDGKSDIQGFSHHAEDILNDREPYGPPGLAGLVANPFVLMCAACSTLGGLLFGYDQGVVSVILVMDQFLERFPEVSPDSSGSGFWKGLMTAMIELGALLGALNQGWIADKISRRYSIIVAVIIFTIGSALQTGAVDYAMLTVARLIGGVGIGMLSMVAPLYISEISPPECRGTLLVLEEFCIVLGIVIAYWITYGTRFMAGEWSWRLPFLLQMVPGFVLIGGVAILPFSPRWLASKDRYEEALQSLSKLRRLPTTDKRVRQEFLDIQAEVRFHQEMNAEKHPNLQGGGLKDAFLLEMASWADCFKPGCWKRTHIGVGLMFFQQFVGINALIYYSPTLFETMGLDYDMQLLMSGILNVTQLVGVITTIWTMDSLGRRSLLLSGALLMTISHVIIAVLVGLYSDNWPAYRPQGWASVALLLVYMIAFGASWGPVGWAMPSEVFPSSLRAKGVALSTCSNWLNNFIIGLITPPLVQNTGFGAYTFFAVFCLLAFVWTFFFVPETKGRTLEQMDHVFKDNSSEAEEARRHAIEVELLRAEAERYAMEA

SEQ ID NO: 33686 - protein, 382 aa, Anaplasma phagocytophilum HZ
MGSNDYYDLLGVSRGASEEEIKKSYRKKVFEYHPDRNPGNKEAEEKFKKISEAYDVLTDSDKRAAYDRYGHSAFANGMGGNQGFTGGFDGGFSTDFSDIFNDFFGGGFGKTSRQSSRENMRGSDLRYDIEVTLEDAFKGVKVPISYVTHVQCSHCSGSGGEGTAKSVKCGTCNGAGRIRTRKGFLTIEELCHTCSGEGEVVKNKCKRCAGSGRVRNEVGILVTVPRGIENGNKVRVNGKGEAGYRGARSGDLYVYVVVKDHKFFTRRGMDLYCNVPIKMTLAALGGEIEMPSIDGTWTKLKIPEGTQSNDKLRMRGKGMPDIQGGERRGDMYVQVTVETPVKLTKKQEELLKQFEDESNANSSPKFSGFFQKIKGIWKDISS

SEQ ID NO: 33687 - protein, 796 aa, Oryza sativa (indica cultivar-group)
MEEEQSPRLAAGEPERKLEDGVTDADAEDPGCTGNGAMSSLEQPLLKRSNTLTASHLAMVGAKVSHIESLDYEIIENDLFKHDWRRRSNVEVLQYIFLKWAMAFLVGLLTGVIASLINLAIENISGLKMLHMFLMVKNLPSPYCRYWAGFLYFAGVNFGLTFIAAMLCVVFAPTAAGPGIPEIKAYLNGVDTPNMFGAPQLIVKHLRGVVGAGSREGRATGAHRRVPGELAEPGGSGRHRLRWRWLRYFDNDRDRRDLITCGASSGVCAAFRAPVGGVLFALEEVATWWRSALLWRTFFSTATVVVVLRGFIEVCRNGRCGLFGEGGLILFDVGDVAVRYHAGDLLPVTIVGVLGGVLGALYNHVLHKVLRVYNLINEKGRAAKLALALAVCALTSALLYVTPFAVPCTPCDPAFGGACPTLGKSGNFKRFNCPEGHYNDLATLLHATNVDATRNIFSTGTAGEFRLDSLLIFFAVYCVLGLFTFGIAVPSGLFLPIILMGSAYGRVTALVLSRFARIDHGLYAVLGAAALMSGSMRMTVSLVVIFLELTNNLLLLPITMFVLLIAKTVGDAFNPSIYEIILDLKGLPFLEAKPEPWMKDLTVGELAAAKPRAVALQVVERVSTVVEALRATRHNGFPVLDRPRPGVSELHGLVLRSHLVAALRKRWFLPERRRTEEWEAREMFSSAELADKCGGVDELEISPEEMGMYVDLHPLTNTTPYTVVETMSVAKAVVLFRSVALRHMLIMPKFQGPENTDISNCGDLDKAGPDSTQHPRCISTPCKQEENTLRGTIFES

SEQ ID NO: 33688 - protein, 376 aa, Oryza sativa
MAEEDIQPIVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPMNPKANREKMTQIMFETFNCPAMYVAIQAVLSLYASGRTTGIVLDSGDGVSHTVPIYEGFTLPHAILRLDLAGRDLTDNLMKILTERGYSFTTTAEREIVRDIKEKLAYVALDYEQELDTARSSSSIEKSYELPDGQVITIGAERFRCPEVLFQPSFIGMEAPGIHEATYNSIMKCDVDIRKDLYGNVVLSGGSTMFPGIGDRMSKEITALAPGSMKIKVVAPPERKYSVWIGGSILASLSTFQQMWISKAEYDESGPGIVHMKCF

SEQ ID NO: 33689 - protein, 467 aa, Ralstonia metallidurans CH34
MSHAYDKEDSTQREAATVSTQPRTVARSEKQAHRIIVVGGGAGGLELVTRLGDKLGKSGTAQVTLVDRSPTHIWKPLLHEVAAGSMDPNTHQLEYVAQARWHYFEFQQGELTGIDRERKLVKVAACLDQDGAELLPARELPYDTLVLAIGCVTHFFGVPGAAENAIALDTVDQAERFRRKLIAACVRAQNGRGRVGEDGRPRVDVAIIGAGATGVELSAELRNTAHVLNAYGLHQLDPRRDVRIHIVEAGPRILPALTERVSAETTKLLRKLDVDVFTSERVTEVTKDAVLTASGKHVDADLTVWAAGITAPGVLRTLGLPVSKMGQIVVGPTLQCETDPDIFAFGDCAAAPWPEKQTTVPPRAQAAHQQATFLYDAIRARLAGKPLPKFGFKDFGSLVSLGHFSAVGSLMGGLIGGSMFIEGLFARFMYTSLYRMHVLALHGAIGMGLDTITHWLRSKTSPRVKLH

SEQ ID NO: 33690 - protein, 485 aa, Thlaspi japonicum
MAMASLYRRSLPSPPAIDFSSAEGKLIFNEALQKGTMEGFFRLISYFQTQSEPAFCGLASLSVVLNALSIDPGRKWKGPWRWFDESMLDCCEPLEVVKDKGISFGKVVCLAHCSGAKVEAFRTNQSTIDNFRNFVVKCSTSDNCHMISTYHREIFKQTGTGHFSPIGGYNAERDMALILDVARFKYPPHWVPLKLLWEAMDSIDESTGKRRGFMLISRPHREPGLLYTLSCKDESWINIAQYLKEDVPRLVSSQNVDSVEKILSVVFKSLPSNFNQFIRWVAEVRITEDGNQNLSPEEKSRLKLKQVVLKEVQETELFKHISKYLSSVGYEDSLAYAAAKACCQGAEILSGTSSKEFCCRETCVKCVKGPGEAEGTVVTGVVVHGGSEQKVDLLVPSTQTDCECGSEENYPSGNDVFTVLVLALPAQTWSGIKDPALMQEMKQLISMASLPTMLQEEVLHLRRQLQLLKRCQENKEEEDLAAPAF

SEQ ID NO: 33691 - protein, 485 aa, Thlaspi caerulescens
MAMASVYRRSLPSPPAIDFSSAEGKLIFNEALQKGTMEGFFRLISYFQTQSEPAFCGLASLSVVLNALSIDPGRKWKGPWRWFDESMLDCCVPLEVVKDKGISFGKVVCLAHCSGAKVEAFHTNQSTIDNFRNFVVKCSISDNCHMISTYHREIFKQTGTGHFSPIGGYNAERDMALILDVARFKYPPHWVPLKLLWEAMDSIDESTGKRRGFMLISRPHREPGLLYTLSCKDESWINIAQYLKEDVPRLVSSQNVDSVEKILSVVFKSLPSNFNQLIRWVAEVRITEDGNQNLSPEEKSRLKLKQVVLKEVQETELFKHISKYLSSVGYEDSLAYAAAKACCQGAEILSGTSSKEFCCRETCVKCVKGPGEAEGTVVTGVVVHDGSEQKVDLLVPSTQTDCECGSEENYPSGNDVFTVLVLALPAQTWSGIKDQALMQEMKQLISMASLPTMLQEEVLHLRRQLQLLKRCQENKEEEDLVAPAF

SEQ ID NO: 33692 - protein, 402 aa, Synechococcus elongatus PCC 7942
MSKRTLASLTAADLEGKRVLVRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHASTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEEALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 33693 - protein, 149 aa, Bacillus subtilis subsp. subtilis str. 168
MMEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 33694 - protein, 348 aa, Bacillus subtilis subsp. subtilis str. 168
MLNIIRLLAESLPRISDGNENTDVWVNDMKFKMAYSFLNDDIDVIERELEQTVRSDYPLLSEAGLHLLQAGGKRIRPVFVLLSGMFGDYDINKIKYVAVTLEMIHMASLVHDDVIDDAELRRGKPTIKAKWDNRIAMYTGDYMLAGSLEMMTRINEPKAHRILSQTIVEVCLGEIEQIKDKYNMEQNLRTYLRRIKRKTALLIAVSCQLGAIASGADEKIHKALYWFGYYVGMSYQIIDDILDFTSTEEELGKPVGGDLLQGNVTLPVLYALKNPALKNQLKLINSETTQEQLEPIIEEIKKTDAIEASMAVSEMYLQKAFQKLNTLPRGRARSSLAAIAKYIGKRKF

SEQ ID NO: 33695 - protein, 851 aa, Gibberella zeae PH-1
MASQTQKSEALSRGDSLPRSQEAYEVEGSFERDLDVTQDDLLEAREMAATLSLEDVHKTMSKVYKLHKRDPNFPLSVIQKIEHFLNQDDILKHPERHKALIQEIKIEAALITHNSPYAEVRAVVDNHDDPSMPCSTIRAWVIGIIFSCAVSFINSFFEIRQPMIGVGLAVPQLLAYPFGKFLEKTLPDIGFTLFGVRHSLNPGKFTKKEHMLITIMSSISMGAPYTNYIIWIQYLPQYFNQPYAMNMGYQILLGLSSKFIGYGLAGICRRFLVYPSYCLWPTTLVCIALNTALHDEGDVPVLGPFKKIWDISRFRLFSLAFGAMFAYFWLPNYLFAGLSWFSWMTWVSPNNRDLANVTGGHTGLGLNPLPTFDWNIVTLGCDPLMVPFFTTFNLFCGALLTCFVILGVYYGNGYHTAYLPINSNRVFDHFGGLYNVSAIIDERGIFDAKKYEAYSPAFLSAAHISSYMFLFSLYTAAFTYGVLYHHRTIAIGFKGLVNSFRPSKKDEVEDGQVSDAHNRLMKTYREVPEWWYLVCLAIAFIVGIVGVSQWPTHTTPAVVPFGVILSLIFVVPVGIISATTGIGVSLNVLSEFLGGAFVEGNAIAMCFFKAFGYSTCAQAVYFSADLKLAHYLKIPPRFTFWAQMVPTLVSTLISVGVLQYQIRLEGVCTQDAPYRFMCPGLNNFFAAAVLWGTIGPKKLFGPGGQYVEALVGFPVGVVVVLLFWWLGKRYPNIKFIRSIHPVVFLAGGMLWAPYNLSYIWPAVPIGWLSWIYIKKRYLAFWAKYNYILSAAFSVGIAISALVIFFALQYHDINLDWWGNKVPYEGCDGTQSCFLKTLAENEYFGPRIGDFS

SEQ ID NO: 33696 - protein, 320 aa, Streptomyces avermitilis MA-4680
MSPRQITVLGECVADAFTEPANASNELALRVLPGGGPANTAVALARLGTPARFLARLSGDVFGRLFRAHLEESGVDLSYAVAAAEPSTLAVAELDATGQAAFSFHAQNTADWQWTPGELAGVDLSETACVHTGSLALVREPGGAAVEEFLAAAAPRATISIDPNVRPLLVRPEVYRARLAHWCALADILRLSEDDLELLLPGTPPEQACDIWHAAGVRLVVITLGAGGALASLDGERLRVPAVATRVVDTVGAGDSFTAGLLHHLGARGLLGGRLTDLGLDEVAEACRFGARVAALTCSVAGPNPPWRDQLAQLTTAGGA

SEQ ID NO: 33697 - protein, 511 aa, Triticum aestivum
  misc_feature (56)..(56): Xaa can be any naturally occurring amino acid
  misc_feature (364)..(364): Xaa can be any naturally occurring amino acid
MASFARQEHQFLAELGLAPRNPGSFACGAWGGSGPVVTTTNPSNNEVIAEVVEAAXMDDYEKGMSACFDAAKTWMAVPAPKRGEIVRQIGDALRAKLHHLGRLLSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTTSKESFLKGIQTIKSQXGGKSLLGGSAIESEGNFVQPTIVEISPDAPVVREELFGPVLYAMKFLTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 33698 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEVARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 33699 - protein, 361 aa, Picrophilus torridus DSM 9790
MSLKAVVMAGGKGTRLRPITYSIPKPLVPIAGKPCVSYLMDSFYDAGIKDAIVTTGYKFESLINGIIEAKKPDQNVLFSVEREPAGTAGSVKLISNFIDDTIVVGSGDILYDFDIKSIIDFHKKKNASVTIVLTRVDDPSQFGIVDLKDDVITRFLEKPAAGEAFSNIVNAGIYVIEPEVLKYIDKIPFDFAKELFPRLMRHGTPIYGYLGNGTWLDTGRPNDLIKGNQIMVNKYGFKYDSKNITGKNIIKTTSDLSDDIIDSSYIGTNLQIGKNTVIKGSAIYNGVVLGNNVHIEDSIIMDASRIMDNTVIKKSVIMRNCVIGEDSEIIESVISPDLDLHGKSRVYNVSLASKIITDEQV

SEQ ID NO: 33700 - protein, 555 aa, Methylobacillus flagellatus KT
MTNPTNCPIWHDLSAHYQEVLPLQMRDMFTKDGRRFEKFSLEAEGLLLDYSKHRITDETLPLLFKLARDSKVEEWRDRMFAGEKINFTENRAVLHTALRNRSNTPVYVDGKDVMPDVNRVLAQMRKFSTSIRSGEWKGYSGKRITDVVNIGIGGSDLGPVMVCGALKPYAQAGLNAHFVSNIDGTHLAQTLERCDPETTLFIVASKTFTTQETMTNARSARSWFLQAAKDEAHVAKHFVAISTNADEVGKFGIDAANMFEFWDWVGGRYSLWSAIGLSIAIYIGMDHFEELLQGGYEIDRHFKNAPLEQNIPVIMALLGIWYNNFFGADSLAILPYDQGLARFPAYLQQADMESNGKFVARDGRIVQCTTGPIIWGEAGTNGQHAFYQLIHQGNRLIPCDFMMPLQSHYSMGKNGNEHHLILLANCFAQTSALMQGKTLDEAKAELVAQGLTGEALETLLPHKVFEGNRPSTTILFDKLTPKTLGKLIAIYEHKIFVQGIIWNINSFDQWGVEYGKQIAKKILPQLSEDQASTEYDSSTNGLMNYFKSRTQSSGT

SEQ ID NO: 33701 - protein, 138 aa, Rickettsia rickettsii
MNIIDRFEQENISKRTANKKIPDFEAGDTVKVTVKIVDRSIEKDGKEKLTERFQAYEGVVIAKRNRGITSSFLVRKISHGEGVERRFMTYSPIVHSIDVVKYGVVRRAKLYYLRNRSGKSARIKERHIPIAKTKAAKA

SEQ ID NO: 33702 - protein, 946 aa, Ustilago maydis 521
MARGDGQELGITVPVEDPKKTEQEKAKEKQREEAARKGLPPFSEKKANGKEKPEDELSEDDLQLKNELEMLVERLKEDDSSLYRPALESLRTLIRTSTSSMTSVPKPLKFLRPHYPELKTLYESWSQASADKSLFAEILSVLAMTYSDNGQRETLHFRLKANQVASDGKSEDPGLWGHEYMRHLAAELGEEYNARSQDEKNTDELLELALQVVPFSLTHNAEADAVDLLLELEAIDKLPQFVDKDTYARVCLYMVSCVNLLVPPDDAMFLRTAHEIYRKHDRFAEAMTLALRLGDKHLVRSDFEAPKNPTMRKQLAFMLARQHIPIEWLQDEDSPITDNELLDILYNSHLSRHFVDFGKELNVFEPKSLEDIYKTHLENSRTGLGGTVDSARGNLASTFVNAFVNAGFGNDKLMVDAPEGNSWIYKNKDSGMLSATASLGMSLLWNTETGLDQIDKYSYSSEEAIKAGAFLAYGIVHSGLRSELDEAMALLSEHIESQSIPLKISAIVGLGLAYAGFCREDIAALLLPNIQDETTPMEVAAMSALSLGFVFAGSCHGEITPTILQSMMERDPAQLDDKWARFMILGLALLFLGKQDESDATIETLKAIEHPISKQAQVLVDMCSYAGTGNVLKVQNMLHYCTERSAPETSDETEGDNTNAETENAESSQDKDDQEDKETNDLFQAFAVIGIALVTMGEEVGAEMATRHLSHLMHYGEATTRRAVPLALALLHPSNPSMPVLDTLSKYSHDSDLDVAINAILAMGLVGAGSNNARLAQMLRQLAGYYYKEPDCLFMVRVSQGLVHMGKGTIGINPYHTDRQLMSRNAVAGILALLTSMTDARGFVLDQSHWMLYFLSSAMYPRFLITLDENLEALPTSVRVGKAVDVVGQAGKPRTISGFQTHTTPVRVGTFERAELGTEEYLSYAHVLEGFSILLKNPGYVKEEDL

SEQ ID NO: 33703 - protein, 512 aa, Mycobacterium avium subsp. paratuberculosis K-10
MTDVVTHTETAPTPAAKAAKPVHTRAVIIGTGFSGLGMAIALQKQGVGFVILEKADDIGGTWRDNSYPGCACDIPSHLYSFSFEPKPDWKNPFSYQPEIWDYLKGVTEKYGLRRYIEFNSLVDRAHWDDDEHRWHVFTTDGREYVAQFLISGAGALHIPSLPDIEGRDEFAGPAFHSAEWDHTVDLTGKRVAVIGTGASAIQIVPEIVGQVAELQLYQRTPPWVVPRSNPEIPPAVRAAMENVPGLRALVRLAIYWGQEALAFGMTKRPNLLKVIEAYAKYNIRRSVKDKELRRKLTPHYRIGCKRILNSSTYYGAVADPKTELVTDHIARITPDGIVTADGTHRPVDVIVYATGFHVTDSYTYVQIKGLHGEDLVDRWNREGIGAHRGITVADVPNLFFLLGPNTGLGHNSVVFMIESQIRYVADAIATCDKLGAQALAPTRAAQDRFNDELQRRLGPSVWNSGGCSSWYLDEHGKNTVLWGGYTWEYWRATRAVKPQEYQFYGIGSRPGV

SEQ ID NO: 33704 - protein, 401 aa, Guillardia theta
MQEDMEYNIRFVGSYILDKTLGVGATGKVKLAKHSRTKEKVGVKIIKKDLFYDKPSLRLKIQREISVMKLMFHPHVIKIYDVLEDSKYLFLIIEYASKGELFNYLVEKRKLENREALKFFHEIISGLEYCHKHRICHRDLKLENILLDMKLQIKIADFGMASLSIPNIMLKTFCGSPHYASPEVVSNEPYNGIKADIWSCGIILYALVVGKLPYDEENDNMRKLFNKIRFEPPRIPRIIHPDCRDLIRALLTINPQKRITIDKIKKHPWYKSSPLPESCRISIQNLSFASVQNPISNPDPEIISFLLPLQLVKDKKTLCGILSTKKPSFLRVLYRQLEWRKMKMDSVRSNLINEANFKRKKLFKQGKLGNITGLKYWKNLKCKFLSINIKSFVRTGIYIYF

SEQ ID NO: 33705 - protein, 568 aa, Lachancea kluyveri
MDNIISRGEIEDRIARGQAIVIYEGLVLNLEKWIKFHPGGDKAIHHMIGRDATDEMKAYHCDETVEIFRKWRIGRIDQEWENFLPPIQGGVFRFLNQQHDSTDLGLSNKWIAPNTSDQFKFIKNEKHMCGEPDVKIYPKIPQGVIPSLNLKEAYEKKVVTDPATVADNYDNELVRQDLETLPDLDPKTQEWLSKEYNKMHNEIIEAGLYQCNYFRYVKELTRIGLLFALSYYLLYHRDQKFWSAFSMGCAWQQLVFIAHDAGHISITHHYQLDNIFGMIIASWVGGLSLGWWKRNHNVHHLITNDPIHDPDIQHLPFFAVSTRLFDNIYSTYYEKFLWFDAFAKKVVPWQNYLYYPMLAFGRFNLYRLSWMHVLLGLGPRRGKAGWFRYFELCGLIFFNYWFFYLLVGCKLQTGWDRFQYIMVSHITTMLVHVQITLSHFAMSTSDLGVGEGFPMRQLRTSMDVDCPRWLDFLHGGLQFQVVHHLFPRLPRHNLRAAQPYVIEFCEKVGIKYSIYGFSKGNGVVLTKLQEIAVQAKTMLECASAMKKEATGEREADEKTYRTKSIKNA

SEQ ID NO: 33706 - protein, 361 aa, Burkholderia vietnamiensis G4
MSDSTYRIAVIPGDGIGREVMPEGLRALAAVTARFGIRFEFEQIDWASCDYYAQHGKMMPDDWKAQLSDVDAILFGAVGWPATVPDHISLWGSLLKFRREFDQYINLRPARLFDGVPSPLAGRKAGDIDFMIVRENTEGEYSSVGGTMFEGTEREVVMQQSIFTRHGTERVLKFAFELAQRRAKRLTVATKSNGIAISMPWWDARAAEMAERYPDIAVDKQHIDILCARFVLQPDRFDVVVASNLFGDILSDLGPACTGTIGIAPSANLNPDRTFPSLFEPVHGSAPDIAGQYIANPIAMIWSAAMMLDFLGNGAGREREAHDAIVAAIEDVLRNGPRTRDLGGQAATQEVGEAIAARIAG

SEQ ID NO: 33707 - protein, 573 aa, Kluyveromyces lactis
MSRVLSRRDIADRIAKGQTIVIYEDSVLNLDKWIKFHPGGDKSIYHMIGRDATDEMNAYHDDQTITKFKIWKIGRIDYPWENMLPPIQGGRFSKIDERDDIGDYDINLTSKWRSVDESNQYTKIPKNDRLASEAEVKIYPKIPQGVVPSLDLKEAYEKKIVVDPAIVSENYDNERVYEDLTNFPSLDVKNQEWIASEYRKLHGEITAAGLYQCNYVRYLREFLRIGTLFGISFYLLSLKWFAISAICLGFAWQQLVFIAHDAGHISITHNYQVDNIIGMTVASWIGGLSLGWWKRNHDVHHLVTNDPVHDPDIQHLPFFAVSTRLFHNVYSTYYDKFLWFDKFAQKVVPIQHYLYYPILCFGRFNLYRLSWMHVLLGQGPRRGKAAWFRYYELAELSFFNYWFFYLIIYKQMPTNAERFKYVMISHIATMIVHVQITLSHFAMSTSDLGVTESFPMRQLRTSMDVDCPRWLDFFHGGLQFQVIHHLFPRLPRHNLKDAQSLVIKFCDKVGIKYSIYGFAAGNDVVISHLQQIAQQAHTMLECAKTMKKEATDTEFHTNKHVLAANVNEKRKQE

SEQ ID NO: 33708 - protein, 132 aa, Triticum aestivum
  misc_feature (52)..(52): Xaa can be any naturally occurring amino acid
  misc_feature (96)..(96): Xaa can be any naturally occurring amino acid
  misc_feature (99)..(99): Xaa can be any naturally occurring amino acid
  misc_feature (125)..(125): Xaa can be any naturally occurring amino acid
MQTTSLSSAPSSRAPSAPPSTPPPPHVAFPSLRRRDLLLLSASPLPLSLSPXAASARGLFRMPPPGLANRYFLVRAGESVYEGQGLLRTNPVAKTXVDXSGLSPAGLRQAARAALELRRLGACEXDCWIWPS

SEQ ID NO: 33709 - protein, 112 aa, Photobacterium sp. SKA34
METIDKIKQQIAENPILLYMKGSPKLPSCGFSSQASQALMGCGEKFAYVDILQNPDIRAELPIYAQWPTFPQLWVDGELIGGCDIILEMFQKGELQPLLKEVAERRDAASAE

SEQ ID NO: 33710 - protein, 180 aa, Escherichia coli O157:H7 EDL933
MTLKELLVGFGTQVRSIWMIGLHAFAKRETRMYPEEPVYLPPRYRGRIVLTRDPDGEERCVACNLCAVACPVGCISLQKAETKDGRWYPEFFRINFSRCIFCGLCEEACPTTAIQLTPDFEMGEYKRQDLVYEKEDLLISGPGKYPEYNFYRMAGMAIDGKDKGEAENEAKPIDVKSLLP

SEQ ID NO: 33711 - protein, 155 aa, Zea mays
MQEKIRSMPKDFRPATPKGPDPKWRYMWRVGPRPTNTRFKELNSEPVIPEGLPEWEEMMDSWGSKMISAIEVVAEMAAIGFGLSKDAFTSLMKEGPHLLAPTGSDLQRHGSEGTVFAGYHTIHHTTYRHNYGHYTVWMDWMFGTLREPDDILKKA

SEQ ID NO: 33712 - protein, 668 aa, Oryza sativa (japonica cultivar-group)
MWKMVDALLRCSALVALVLHFVVNGCSAVNTEGSALLKFQSRVEEDPHGAMAGWSERDGDPCSWNGVRCVDGRVVILDSDWKCSLPIRSRIIVAKCSRNLKDLSLRGTLGPELGSLSHLRALVLSNNLFDGPIPKEMSDLAMLEILDLSNNNLTGEVPQEIAEMQSIKHLLLSNNNFQWPLIQNSYRNFDQEIDFDVYDERGDVYQRSENGFESDSSSEENTKDNNNLSAHLSSQFAARNPTVQLSRRRLLEDTNLAAASANAPVPAVASVPSTGTGSFSAFKEIKVPPPLSPPSSPPMSSGPPQRSKRWLYAIVISSIALLFIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 33713 - protein, 318 aa, Streptomyces avermitilis MA-4680
MGRHRAACSRPMGRGRGSAVQTQTRMLDQVRTTDGRLLKVEISGDPRGRPVFLLHGMPGSRVGPRPRPMFLYQRGARLISYDRPGYGGSDRKAGRRVADVVQDVAEVADALELDRFAVAGRSGGAPHALACAALLPDRVTRAAALVTLAPRDAKGLDWFAGMAPSNVHEFRTAFNDPERFVARLIPRSAKIRSNPARLLEELRGDLTADDRQIVADGAIRSMLLRNYHEALRSSPYGWVDDALALTGPWGFDPADIRVPVLLWHGAQDVFSPAAHSTWLAGRIPRATAVLEPAAAHFAALRALPAVLTWLLADAARQG

SEQ ID NO: 33714 - protein, 460 aa, Photorhabdus luminescens subsp. laumondii TTO1
MSHNTVITLGTNQTGANNRVQLRKTLTLVQVVMMGLAYLQPMTIFDTFGIVSGLTDGHVATSYAIALIAILFTAVSYGKLVKRFPSAGSAYTYAQKSISPHVGFMVGWSSLLDYMFMPMINILLAKIYLQAIFPSVDPWIFVVGFALLMTAFNLRGINVVANLNTAIVIVQVTVMVVFVGLLIHGVYNGEGVGTLWNAKPFVSEDAHLIPMITGATILCFSFLGFDGISSLSEETPNAGKVIPKAIFLTVLIGGVIFIAVSYFLQLYFPDISRFENPDESQPEIMLYVAGTLFQSIILVFSCVTVLASGMAAHAGVSRLLYVMGRDGVFPEKIFGYVHPKWRTPVINVSLVGIIGLSAITFDLVTATALINFGALIAFTFVNLSVISQFYIRERRNRTLKDTINFLVLPVIGACTVSVLWMNLEQSSMELGLTWGAIGLVYMVFLTRRFRQPMPQCSEMV

SEQ ID NO: 33715 - protein, 527 aa, Zea mays
  misc_feature (27)..(27): Xaa can be any naturally occurring amino acid
  misc_feature (274)..(274): Xaa can be any naturally occurring amino acid
PRVAAGLLPGLSYISAAGKLSSDPFTXMGSSSSHQRSKTRSRNRKPLGIQLLERVRGSPISFRSCQALVLVLTFLSYASYHATRKTTSVVKSVLDPKTKTNLGTSSAHYWPPSHLFYLHNLKGADNNSSSGGGWAPFNAAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLIAAAMLRRRISVWRTMXKKPSDMDAPLLERERRRADVEEKAVGFIEAWRIPGVASFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPADSDLPVSSMDEP

SEQ ID NO: 33716 - protein, 651 aa, Oryza sativa (japonica cultivar-group)
MAGRSGGGGGGSSGKSGTGRMVSLQEFVSSMAPLIDLEKAAEISAESATSSKTLERRGCVMANLKCTDAQTGLMGKTLLEFQPNKGDVLPPHKFGTHDVVALKPNKADAGSAALGQGVVYRLKDSSITVAFDDIPEDGLNSPLRLEKLANEVTYRRMKDALVQLSKGIQTGPSANLIPVLFGENPPMSSKDVAKFSPFNKNLDESQKDAISKALRSRDVFLLHGPPGTGKTTTIIEIILQEVKRGSKILACAASNIAVDNIVERLSRYRTKLVRLGHPARLLPQVLDSALDAQVLRADNSSLAGDIRKEMKVLNSKLLKAKDKNTKRDIRKELRTLAKEERKRQQLAVADVIKNADVVLSTLTGASSKKLDGITFDLVIIDEAAQALEMACWIALLKGPRCVLAGDHLQLPPTIQSAEAEKKGMGKTLFERLTEAYGDQITSMLTIQYRMHELIMNWSSKELYNNKIKAHSSVADHMLYDIEEVKRSSSTEPTIILIDTTGCDMEEVKDEEESTMNEGEAAVSIAHAKLLVESGVRASDIGIITPYAAQVTCLKMMRNKDTKLKDLEISTVDGFQGREKEAIIISMVRSNSKKEVGFLSDHRRMNVAVTRARRQCCLVCDVETVSNDKFLKRLVEYFEENGEYLSASEYQS

SEQ ID NO: 33717 - protein, 554 aa, Escherichia coli K12
MCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 33718 - protein, 163 aa, Brassica napus
ILNLPKGQEQMSWLIDFTGWSMAANVPMKTTREIVYILQNHYPERLGIAFLYNPPRLFQAVYRAVKYFLDPCTAQKVKFVYPKDKTSDELMTSHFDVENLPKEFGGEATLEYDHEEFSKQMCEDDVKTAKFWGLEEKQYPKPNGFSPADVVPEPATSLASAAS

SEQ ID NO: 33719 - protein, 354 aa, Guillardia theta
MSLVGNQRYSVIGRVVGSGSFGVVFQAKCRSNEETVAIKKVFQDDRYENREVEIMSMLVHSNILDLKHCFNFSEGNDLYYNLELEFFAENIHRVCQHYSNHKQTLPTIYVKLYMYQVLRALGYLHSMGICHRDIKPQNLLIDPATQHLKLGDFGSAKLLTLNEPSISYICSRYYRAPELLLGAIDYTNSIDMWSVGCVMGELVIGFPFFRGESGTDQLVEIIKVLGTPTKAQVRAMNNDYLEFQFPRLSSHPWENVFHGKHLEPEAIDLIHKMLDYLPSRRITAIKAISHPFFKQLKIKGAKLPNSKNLPLLFDFSKKEFEYSSRFTTEISTQKYLLFYCKSFLCKWYFGISIC

SEQ ID NO: 33720 - protein, 600 aa, Escherichia coli O157:H7 EDL933
MVNNMTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPARVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMIEATKGINSYYLTSDGSTMSYRTRIRTPSYAHLQQIPAAIRGSLVSDLIVYLGSIDFVMSDVDR

SEQ ID NO: 33721 - protein, 493 aa, Photorhabdus luminescens subsp. laumondii TTO1
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 33722 - protein, 426 aa, Bacillus subtilis subsp. subtilis str. 168
MAADRNTGHTEEDKLDVLKSTQTVIHKALEKLGYPEEVYELLKEPMRLLTVKIPVRMDDGSVKIFTGYRAHNDSVGPTKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNRRIDMRLAAYMVGVRKMAEASRFRGWI

SEQ ID NO: 33723 - protein, 140 aa, Brucella melitensis 16M
MAIERTFSMIKPDATRRNLTGAIIAKLEEAGLRVVASKRVWMSRREAEGFYAVHKDRPFFGELVEFMSSGPTVVQVLEGENAIAKNREVMGATNPANADEGTIRKAFALSIGENSVHGSDAPETAAEEIAYWFSGTEIVG

SEQ ID NO: 33724 - protein, 468 aa, Sulfitobacter sp. EE-36
MSTKDFLKKIKDEDIEYVDVRFTDTRGKLQHVTIVSDLVDEDFVEEGFMFDGSSIAGWKSIEASDMKLMLDTDTAYVDPFYAEKTICVHCSVVEPDTGEAYERDPRGTAQKAEAYLKASGIGDVAYMGPEAEFFLFDNVKFSNSINKVSYEVDASDASWNTDTDYEMGNMGHRPGLKGGYFPVNPTDEAQDLRAEMLSTMKRLGMKVDKHHHEVASCQHELGLIFGTLTEQADELQKYKYVIHNVAHAYGKSATFMPKPIYGDNGSGMHVNMSIWKDGKPLFAGDKYADLSQEALYFIGGILSHAKSLNAFTNPATNSYKRLIPGFEAPVLRAYSARNRSGCVRIPWTESPKAKRVEARFPDPAANPYLCFAALLMAGLDGIKNKIDPGEAMDKNLYDLPAEELADIPTVSGSLREALEELQSDMDYLLAGDVFTKDQIEGYIELKMEEVHKYEHTPHPVEFGMYYSC

SEQ ID NO: 33725 - protein, 153 aa, Triticum aestivum
NLANQPWTISSLIAASARHYLLQPIIADHALLESLDLTDADGQGVLTMDKWQLQELRVRPVSASGDSHRTLMPALSMRLWYAPHIELPGGTVLNGATLVAIKPSEEAMMDAVGNATAGSAGGSWVSDAFEEPYRTAVGVLLKRRMYSLEMNSF

SEQ ID NO: 33726 - protein, 337 aa, Oryza sativa (japonica cultivar-group)
MAASSAAAGAGGEPQKQLLSIIRDFAAEKSHGGFSRDPLAASELLAERRVTDLKRRLDDLRAASDAAAAELEAAKRAREGPEQELPGGPVQVAIAAGSIQGLEATISHLQEEISKAGSDLDALKGKGDIERDEFISQMDQLNTKIRQFQQTVSVEFKRQKCSELPSGEGQHVRDMSKIEESEGILKDLIDKVNNADAELHVLEEEYKKDLLHHDEVRRELADTQAKRALMEAVMGETKQLQELGEYPFLGFVQKFSNSLHLVLFPVQIHQAFCKRRFFNGKQAGSRNGESARFACGGVAEAVRVPRLWSQQHGWVGGGGGGQLKMALAGWLLYIDKA

SEQ ID NO: 33727 - protein, 352 aa, Frankia sp. CcI3
MSEVPSSVTGMSMLPPAPFGRVITAMVTPFRADGGLDEAGAAQLASRLVDAGNDGLVVNGTTGESPTTTDEEKDRLVRVVVEAVGSRARVISGVGTSDTAHSVELARAAEAAGAHGLLVVTPYYNKPPQAGLLRHFVTVAEATGLPVVVYDIPGRTGVPVASETLVRLAEHPRIVAVKDAKDDLPASSWVLARTGLAYYSGTDALNLPLLSIGACGVISVVGHVAAPAIRAMIEAFGAGEVGRAIALHQGLLPAYEGMFRTQGVILAKAALRLAGLPAGPVRPPLVDATPAEVARLRADLAEALLDAAGPPGAPGGVEAGGRGAPAGASSGSGSSGSGSSVGLAVAAAGEVS

SEQ ID NO: 33728 - protein, 818 aa, Oryza sativa (japonica cultivar-group)
MTLANIPEIMESLPVETRFTEFPLRQYGGFWLLEVMLNGVAAAETSFQPRPSDILLSSFPKCGTTWLKALAFATLNRSTYPPSDEHHPLLEHNPHDLVGFLEIYPKLELYESLPSPRLLSTHLPYSMLPHRIREQETGCRLVYIYRDPKDAMVSMWHQNKKEKKNRLTFEEMFDMFCEGRCVVGPQWCHAGEYWDESQARPEKVLFLMYEDLLQDTVGNLRTLAEFMGCGFSRQEEDDGIVQQIVELCSLNNLKNLNVNKSGTTLLGISKDGFFRKGGTGDWSNHMSPEMAARLDKIVKERLEGSGHPIISRINAKATTSIGSSNHVLCIPCVSSVICPSFGSFFAKSTVPSVATCYQGFPNRWGQGYRVPAEVTAVFILPYPRGKPGNRGNRTFTGGMAISPAGPGPLRGPAPTGAGAGAIFDPWAAARARGRLAGSPLDLALSASPAPASRQATISSPLLSSLPSGVRRLELVLSLRSQRRRHTGRRRGGPAAAHRRGGEATPAARARPAAHRAAAAAHRARPAARLQHITKSERMSNPAATVESQVALTPSSTPTPTNAPSVEINDSQGTEVEHDNKRLKSAAWQDFVKKKINGAWKAECKWCHNKLGAESRNGTKHLLDHIKTCKSRQARKGLTQSNLKMGIDAEGRVTVGKYVFDQEVARKELALMICLHEYPLSIVDHVGFRRFCGALQPLFKIRTELDLYLEEKPLPRTQDFDIINWWKFGGIRYPTLRQIARDILAIPITTVASESAFSTGWRVITPNRNQLKPNLVEALMCVQAWGRADMLAEIANKTNALNTVLDDESESEASTVTEA

SEQ ID NO: 33729 - protein, 314 aa, Brassica napus
  misc_feature (99)..(99): Xaa can be any naturally occurring amino acid
  misc_feature (211)..(211): Xaa can be any naturally occurring amino acid
MSSVHSSTLMSVVCNNNNKNHSAWPKLPNSSLLPGFDVVVQAAAVRFKKDTTTTRATLTFDPPTTNSERAKQRKHTIDPSSPDFQPIPSFEECFPKSTXEHIEVVHEESGHVLKVPFRRVHLSGGEPAFDDHDTSGPQTVDPHVGLPKLRKEWIDRREKLGTPRFTQMYYAKQGIITEEMLYCATREKLDPEFVRSEVARGRAIIPSNKEXIWQLEPVIVGRKFLVKVNANIGNSAVASSIEEEVYKVQWATMWGADTIMDLSTGRHIHETREWILRNSAVPVGTVPIYQALEKVDGIAENLTWEVFRETLIEQ

SEQ ID NO: 33730 - protein, 219 aa, Oryza sativa
MDQQQQQPFFCDQSRCYAGCRLLNGSPDTEKLTSGNKIKGLLNSPASDDEGGRLGQRCTTASADLLRSHPPPFLILFSFSLLEMLSFFHCIFCVPEPEPHVLAVDDSIVDRTVISRLLRSSKYRVTTVDSGKRALEVLSLDRNVHMIITDYCMPEMTGFDLLKRVKESAELKEIPVVLMSSENSPTRIRRCLEEGAEDFLIKPVRPSDVSRLCNRVIMK

SEQ ID NO: 33731 - protein, 435 aa, Arabidopsis thaliana
MDRDYISELPDSLLTQILLELRTKDSVKTSVLSKRWRNLWLNVPGLELFTLQFTYPDREEIFVRFMDRFMEFKCRSRLKKFMITYVDCKGYRDRLMELIGTLVDHGLQHLYVFMHTFDRVDFKRQNIYKSKTLVSLKLHNVELKNSDFVVSLPCLKILKLENICHGEDGPLVVEKLISGCSVLEDLELIRPFDIRTHKVLLLLRVSSQTLKSFTLHFAIYKDRTDFSVEIDAPRLKYMTVEQSQSDSIVVKNLSSLFSIDIGTKFNPLRHEDLRMRNVFYDFLTGISSVKHMIICLWSLQRFSPYSKPGLIPKFQNLYHLKAQMWSSSTHLLEAFLESCPNLKNLILEYNVELDREQVDFTNVPQCLISTLEYVEIKEPNEKSTIKLVNYFLENSAVLKKLTLRFSYSSSIYLKSYKKLLTSTKLSPTCQVIFGC

SEQ ID NO: 33732 - protein, 260 aa, Triticum aestivum
  misc_feature (249)..(250): Xaa can be any naturally occurring amino acid
  misc_feature (254)..(254): Xaa can be any naturally occurring amino acid
FNVGSAIGLTIKNIPGSSRAIISRNKLATFGERNQDKDTENGMPKLQAETALTPNRTGRMVLPFTPLTISFQDVNYYVDTPAEMRKHGYMERKLQLLHNITGAFQPGVLSALMGVTGAGKTTLLDVLAGRKTGGVIEGDIRIGGYPKIQQTFATISCYCEQTDVHSPQITVGESVAYSAWLRLPPEIDSKARNEFVNEVLETIELDEIRDSLVGIPGVNGLSTEQRKRLTIAVELVSNPSIIFMDEPTXXLDAXAAAIVM

SEQ ID NO: 33733 - protein, 223 aa, Arabidopsis thaliana
  misc_feature (43)..(43): Xaa can be any naturally occurring amino acid
  misc_feature (165)..(165): Xaa can be any naturally occurring amino acid
  misc_feature (203)..(203): Xaa can be any naturally occurring amino acid
MSLFLKDDSIQIREVWNDNLQEEMDLIRDVVDDFPYVAMDTEXFPGIVVRPVGTFKSNADYHYETLKTNVNILKMIQLGLTFSNEQGNLPTCGTDKYCIWQFNFREFDLDSAIFALDSIELLKQSGIDLAKNTLDGIDSKRFADLLMCSGIVFNENAHWATIHSXGHDFRYLLNLLIFQNLPDLQIDFFKFINVFFANKYDIXHLKKFFKTFNGGSTTFGVFG

SEQ ID NO: 33734 - protein, 559 aa, Zea mays
MASSQEDKMKALMKVLVDCTEDATKSLGGLVDHALDHMHDEEILARTLFATKEKLELLQQDALEAKVQAFPEIAKYEWDDISVDPPSPSPPPTVTDPSVEEEEFYCPDVSDEWYFSDSDRMDPSNNATSSQPMSNSSSGQQFPPPHPLWPAGYMQQSAMDCNFMGNLNFPNPGQGPTTLWAPMQTGNTSSQSTMIPASQSAMYWNHYLNFVRNPLGSAEVNPFPDSIPPSNTSTPLQGSNTIPSLPVNLDSDAEHSVHDINSPEKNAPPIHKPKKSKEQNFTGPEDLLLCTTWLQISSDPVVHTGQRREGLWARIEKRYNEQRGKFPCRVNRALSSRWDKIRADVSKFAGYYARVLREKQSGLTDDDKTSKAATLFAHEENKPFQYMHCWHQLKGEPKWESICSGQSFRGLNANPIGCTGTPYAPATETESASAGLTGKRLRGRDFSKSERNKPASSSSPEYLSRLQEITEKQIQRSIEKGEKKEKCSEEDREMEKKRLELEAEKVIIRKRELKLQELDSAEKRLQRLEATNEEDVDPEVWIMMKEQKKKLQQFIFSYE

SEQ ID NO: 33735 - protein, 209 aa, Stevia rebaudiana
MASASLFKPSPATVLDKSDWVKGQTLRQVPVSVVRFNAAAPSALTVRASSYADELVKTAKTIASPGRGILAMDESNATCGKRLASIGLENTEANRQAYRTLLVSAPGLGNYISGAILFEETLYQSTIDGKKIVDVLAEQGIVPGIKTDKGLVPLAGSNDESWCQGLDGLASRSAAYYQQGARFAKWRTVVSIPNGPSALATKEAWESLK

SEQ ID NO: 33736 - protein, 280 aa, Sulfitobacter sp. EE-36
MQPSAITADTLDFDQLAKGQGHKFDHGHAIVVTGGAGRTGAARLSGRAALRMGAGLVTLAVPPAAQMEVAMQITALMLSRVTGPEDLAELAGDKRVRALCIGPGLGLKPAHVALVRAVLECGKPCVLDADALTLIAQEPTLWERLGPHCVLTPHGGEFARLFKQISDGDADKAQACLMAAQKAGAVVLYKGATTLIANPDGRVAAHHGTGDRAAPWLATAGAGDVLSGMITGLLARGIAPFEAAQYATWLHVEAARQFGPGLIAEDLVEEIPRVLKALDL

SEQ ID NO: 33737 - protein, 117 aa, Rhodobacter sphaeroides 2.4.1
MGRLTTHVLDTAQGRPAAGVRIVLCRLEGGNRSEIGTAVTNDDGRTDRPLLDGAALVPGTYELTFGAGAYLRAGGLGAAAPLFLDEIPIRFGIADAAGHYHVPLLLSPYGYSTYRGS

SEQ ID NO: 33738 - protein, 420 aa, Sinorhizobium meliloti 1021
MVEKRTQPLARDAMAYVLAGGRGSRLKELTDRRAKPAVYFGGKARIIDFALSNALNSGIRRIGVATQYKAHSLIRHLQRGWNFFRPERNESFDILPASQRVSETQWYEGTADAVYQNIDIIEDHGVEYMVILAGDHVYKMDYELMLQQHVDSGADVTVGCLEVPRMEATGFGVMHVDNADRIIAFVEKPADPPGIPGNPDMALASMGIYVFHTKFLMDMLRRDAADPKSSRDFGKDIIPYIVEHGKAVAHRFTHSCVRSDFEREAYWRDVGTIDAYWQANIDLTHITPELDIYDSTWPIWTFSEIKPPAKFVHDDENRRGSATSSLVSGDCIISGAALNRSLLFTGVRVNSYSRLENAVVLPDVTIGRHSILRNVVIDSRVVIPEGLVVGDDPELDAKRFRRTESGVCLITQTMIDKLGM

SEQ ID NO: 33739 - protein, 252 aa, Arabidopsis thaliana
MGIVAFEWAEGKTNQLTLLMNRDNWENRQILSGRCKANNGTWFGITKGGRVAFLVNTSLLLDRVKSYSGSELYPVRFLEGNMSPEQFANEVKVHEKETNERHAYSLVVADMTSSSMVHILKPSDTKSDVVIETVPFGVHTLSSYEGLDSTDSARDLLLRRLFTQMVGNLGNVQQRQMEEIAGRFMYDAQAGRDAVFYHSRDEHPNGKLGTQRFGTTSTTALVVKRTREVMLFEKYMEQNGAWNTNNFAFNIQ

SEQ ID NO: 33740 - protein, 437 aa, Triticum aestivum
  misc_feature (403)..(403): Xaa can be any naturally occurring amino acid
  misc_feature (414)..(414): Xaa can be any naturally occurring amino acid
  misc_feature (424)..(424): Xaa can be any naturally occurring amino acid
MASEKHFKYVILGGGVAAGYAAREFGKQGVQPGELAIISKESVAPYERPALSKGYLFPQNAARLPGFHTCVGSGGEKLLPEWYTEKGIELILSMEIVKADLASKTLTSADGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEEKGGLKTDTFFETSVAGVYAIGDVATFPMKLYDEPRRVEHVDHARKSAEQAVKAIKAKESGESVAEYDYLPYFYSRSFDVAWQFYGDNVGETVLFGDNDPAAAKPKFGTYWVKDGKVIGVFLEGGSAXENQAIAKVARXAQPPVDDVEXALGKEGLDFATKI

SEQ ID NO: 33741 - protein, 452 aa, Triticum aestivum
  misc_feature (198)..(198): Xaa can be any naturally occurring amino acid
  misc_feature (394)..(394): Xaa can be any naturally occurring amino acid
MPTVSVGRDRLFAALGRVYTQDEFEALCFDFGIELDDVTTEKAIIRKEKHLEEDVEADGDDEVIYKIEVAANRYDLLCLEGIARSLRIFTGSEATPIFKIASIPRGSMLQMHVRSQTSQIRPYVVCAVLRGVTFDEVRYNSFIDLQDKLHQNICRKRTLVAIGTHDLDTLQGPFSYEALPPQEINFIPLKQEQNFRAXDALMEFYRSDMKLKKFLHIIENSPVYPVIYDSNRTVLSLPPIINGAHSAITLKTRNVFIECTATDLTKANMVLNTMVAMFSEYCENKFEVEPVEVVSYDGSTAIYPDLSCYKMEVSLSDIVGPIGISLDETQVISLLNKMQLQAELCSSNREPCISVSVPPTRSDVLHARDLAEDVAIAYGYNNVPKSKPMSMTIXGGRQPLNRFSDKIRAEVARAGYMEVLTFVLTSHEENFDMLNRTDDGNKHHYCKPRTLN

SEQ ID NO: 33742 - protein, 392 aa, Bacillus cereus G9241
MKLFKPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPICFTNPGDTILVPDPGYPDYLSGVALAKAQFETMPLIAENKFLPDYTKIDDSIADRAKLMFLNYPNNPTGATASKDFFDETIQFANKHNILVVHDFAYGAIGFDGQKPVSFLQADGAKDTGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 33743 - protein, 1499 aa, Ustilago maydis 521
MGSISAVGAVARIAVLTSATLVNVAPSGKASTSSFSSVADKASELNAQLDVEHLNQHVELGSVLSQLKPAGNGLISVLSHAHQPTFTRLVPHLPKLVHTPLVFHVASAGEHSDIMALRQSGLVLLHSSTAAQAHDHALLATKIATSAKRAVLHFFEDASGPVEEVTNVDLASFIGSVAASTSTDAAAPKINGLNGHANGINGHVNGVNGANGNANGYASAVASEAGFDDLESAIDAAYEDVAELVGHAVEPFQLVGASDAQNLAVVLGAGSETLQDYTAPHNDLAVLDIRLVRPSLPQRLLDTIPAGIKRIAVLEQSVRRTTKLGPLFVDVASAFQGSERTLPSVFVSAILGHIDNGDNAAKELIKALQAPKPKHAFIVGDLKKLSARAQASPATAATTAPVQVPKHEEAYNLMLEQVFADRLALVNSANEESDDHPAARSPEYAFGQVLAQLEQRDELIRAVNDVLRDGGVSTELHEALSQWLVAKQDVKKNVASSNKVASLLQSSTSGAALQNIKSLSEHLLLKSRWIVGSDAWAYDAGMGGVHHVIASGRNVNMLIFDSVPYTKRDAQAAHKRKKDVALYAMNYGNVYVASTAIYADYTQVLHALMEADKFDGPSVVLAYVPYRTEDAPALDVLRETKLAVDSGYWPLFRWDPSAEARGSDVFRLDGVRLREQLQQFLDRQNLFTTLINSRPELSYDIAASQGNALRELQRRKAKEAYEKMLGSLDGPPLLILVASDGGNAEKVAKKLAVRAKARGVAARLLTMDDFPVTEELKDEKNVVFLTSTAGQGEAPQNGRFTYKALHAMADAALPDTLNFTVFAMGDSHYWPRPEDAHYYNKPGKDIDVRLEQLGATRMTPIGLGDDQDADGYQTGYKIWEPLLWKALGVDTVEVKEAEPEPITNEHMKIASNYLRGTIKEALVDTSTGAIPETDGQLTKFHGTYMQYDRDTLEERKAAGLEPAYSFMIRARIPGGVVTPAQWVQLDDVAEKYGNQTIKITTRQTIQYHCVIKSNLKAAMQGINKSMLDTIAACGDVNRNVMCSPNPNLSELHEDVYEFSKSISEHLLPRMNAYHEIWLDKETDSSKQLLIGGVLQDYEPLYGPYYLPRKFKIAIAVPPRNDTDCFAHDIGLIAIADPVTKRLAGFNLAVGGGMGVTHSMKATYPRLGNVIGFVTPEQTLDACRIVMLIQRDTGNRANRKQARLKYTIDKHWGGADNFKAEVERRLGYKLAEPKSYKFETNTDLYGWTQDYKGNYHCTLWLENGRVKDEPGAPFRTGLRELCKIHKGAFRLTPNQHIIVSDIKPEDKDTIDAHLRKYKMNNWEHSGVKLSASACVAFPTCGLAMAESERYLPLLMDKIESIFEANGLRSTDTVFRMSGCANGCSRPWMAEAGFVGKAPGQYVMTLGGSHNGTRLSKIYRESVDEKEILEIMNKLVPLYAENRIEGESFGDYVIRAGIIKPTTEGKAFYEDMCPSDVVPPSAAAKKGPAQATEHYDRASSA

SEQ ID NO: 33744 - protein, 214 aa, Oryza sativa (japonica cultivar-group)
MADVNCRCSRVVYVGNIAFHATEAELRDACELIGPVRSLRLAALDPATNKRKGYAFVEYADDETARSALRNLHGNLFRGRELRVGLAARPSIRRRGGGGGGEREPVGMEDAVHAASLVVSGRPLASVTRYLAARSRQEVREMVAALEATEQLKIPGLGTAMEQAQRLLEMFAADEEEVARKKLKRASDEEHAKQSKVVGVDGVVKASSRIVPCF

SEQ ID NO: 33745 - protein, 371 aa, Eriobotrya japonica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLSIAKSLGADEVVKVSTNIEDLAEEVATIQKVLENGVDVSFDCAGFDKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 33746 - protein, 391 aa, Pseudomonas aeruginosa
MDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEAAVGKLLVLSQVVLSLQLPFALWPLIRFSSDRGLMGEFVNPRWVSALAWSLFGLISAANLTLLYFWFG

SEQ ID NO: 33747 - protein, 173 aa, Burkholderia cepacia
WATDIQAGSQFGYSLLWVVAFSSLAAIFLQMLAARLGLVAGKDLAQASYERYGRFGRVVQWITAEVSIIACDIAEVLGCALAFKLLLGVPLAWGVVLTALDTVIVLGLQGKGFRQIEAIVLGLIATMAFCFVAQVAITPPDWHAVVGGLVPGDPGHDRKDAIVLALGIVGATI

SEQ ID NO: 33748 - protein, 558 aa, Zea mays
  misc_feature (139)..(139): Xaa can be any naturally occurring amino acid
MAAAPASVGCGGAYSCETAERTREWMQALATFLGRHRPLLEAHVVNFFKDRLWELVDAEWMECLRREPVESLLKLPSGCVQEHWPATLREFVLTARSLVIPREQKAPQSLVSDIHVAPVGTVLAQGMNSKKKHEVEIAXIQIENLAAVVHAIAKRCGAKTVVDVGSGQGYLAQALSFEYQLRVVAIDASSHHASVTIARAERIKKHYAAKCVEKQLLMVPRAVTCHVLSSDTLAAVTLDACKDDNGEHVRDTKTSTKKITQIQESTQGTPPLILAGLHACGDLSVNMLRVFVSCEQVKALVSIGCCYNLLSEDTYEDTDTCPGFPMSKAAKHSELVLGKSIRDLACQSAERWRNLTMDIALQNFDVHAFRAAFQMVLEKYFPEVSRLSPSIGRQGKALRRQRLRKVVESQMTTKKNDDFSCSTLKEQNKNTNDVHPVIHEVDTGPDDIHQNAHQKFILFKDFTLSGLGRLGCGSVEDTSLLEIWKDVQPFSEYIGPFWCLRAALGPLVETYILLDRLLYLQERSNLVEALLFPLFDPTISPRNMAVIAWKLCANSSEA

SEQ ID NO: 33749 - protein, 168 aa, Triticum aestivum
MGSLMAGWDSPVLGHDTKARVMRNRSLMKEEVEAFWRQRRKPAPEDVTSPLSSPGRPMEKSPLGSSQTQRSRSPASSPVAGGHEEIDAADAGKSRDWWTRSNWAFLNEPPQEERPGTAHTYTPQFHVAAGNRLTGHVRRVYAILVPRHAAGMPRLGLLPAPRIGHFPL

SEQ ID NO: 33750 - protein, 187 aa, Brassica napus
MATEANNPINMNSMSSSLQRTGQWVFSQDIPTDVVVEVGEANFSLHKFMLVAKSNYIRKLIMESKDIDVTRIDISDIPGGPEMFEKAAKFCYGVNFEITVQNAAALHCAAEFLQMTDKYCDNNLAGRTQDFLSQVALSSLSGAVVVLKSCEILLPISRDLGIVRRCVDVVGAKACNEAMFPCRTPPN

SEQ ID NO: 33751 - protein, 248 aa, Arabidopsis thaliana
MGRGRKHTDAAAEQRELAIKARKAAWEWDESQVLSGRCAETDGTWLGISIRGRVAFLVEAGPVNRDRIIGAECRTLDFLKSNLSPEDFADSLALDSGRNTGIAYHLIVADIVSNSMFYIYKPSLSEDGMVYTEPVGPGVHTLSSAGLDSEVGHRDLRLKRYFSERINRELPEPISGLAEEVMYDTVEAINGDPLSSIFVVDTLIENEHYGTRCTTALVVRRTMQVRFFERYRARFNDDWNVHDFRFTI

SEQ ID NO: 33752 - protein, 462 aa, Pediococcus pentosaceus ATCC 25745
MKIIDKILRKESLDNYLKTDSKFEKTIGPKDLLALGIGAVIGTGIFILPGTVAALKAGPSITISFVIAAIVCALAGMCYAEFAASIPVAGSAYSYGTIIYGELPGWVLGWALILEYVLAVAAVSTGWSAYFGSLLGGFGIHIPTAISGSFNPSHGTYINLFAIIIVLLIGFLLNRGFQSSIRINNFMVFVKIAIILIFILVGIFYVKPTNWKPYFPFGVHGTLAGASTVFFAYLGFDTVSASAAEVKNPSKTMPIGIIGTLIIATIFYVAVSLVLTGMVPYTKLNVANPVALALQLVHQNWVAGLLSLGALAGMTTMMISMIYGSSRLVYATGRDGLLPKVLGNLVGEHHSPRNAMVVVTIFIAFLGGFVPLDQLTNLVNMGTLLAFALVSLGIIPLRHRQDIPNTGFKVPGYPFIPIISALACIYLITTLSVETWIGSAIWFGIGLIIYFSYGIHHSKLAQ

SEQ ID NO: 33753 - protein, 304 aa, Arabidopsis thaliana
MTCTDNNNIVFGQREADSDSGGSTVTMDSTLQMMGLGQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTISGKSKSQDENENHELRGHGLCLVPISSTFPVANETTADFWTPTFGGNNFR

SEQ ID NO: 33754 - protein, 191 aa, Glycine max
  misc_feature (172)..(172): Xaa can be any naturally occurring amino acid
MGANHSREDLLESSDSEQEEHETFEDATEGSAERKPSTPSSLDDVEAKLKALKLKYSSNSTPAVNNAVKLYVHIGGNTPKAKWVTSEKLTSYSFKYNDSDNDNDNDDYDETNEKPFWVLKVGSKIRSKVGPEMGLKSFPEQRRVDFVVRGVWAMKFFSDQNQIDFIDSFQEXLFEDTHGVEAPGANELKST

SEQ ID NO: 33755 - protein, 179 aa, Oryza sativa
  misc_feature (125)..(125): Xaa can be any naturally occurring amino acid
MMAGLQRSATTFRRSGSSGLVWDERFLTEDAEAAKAGDGDGGGGTEEPQPELRHSKSVGSIGMMRRVAADDGDDSEKTTKQQRKKKKKKKKKKDGQKEDDNRSQQVFRTKDIAPDVDPPSPRVSXGCILCSIFSGSGSSSSATSRRAKPRQEVKPNGVTYKKPYIPSRWCCIICYCKAV

SEQ ID NO: 33756 - protein, 637 aa, Debaryomyces hansenii CBS767
MSIKPCKLYPPQPSTVRAQSLHLSYDPVHDRIAYPNGKSIIVRPLDPKNTAVGAKQFTKHIHTTTAATFAPSGNYVASGDESGQVKIWDSAVVGGSTDGTESAFEQPYIKSEFQILSGPIKDIAWDADNSRIIAVGQGKDKFGHCFTWDSGNSIGEIQGHSSTINAVAIKPQRPYRAATVSDDKALVFFNGPPFKFDKSIRGNHTNTIRDVSFSPDGKWLVSVGSDRLIALYDGKTGEFVKKIENAHEGGIFGVNWFKDSSKFVTCSADNTVKSWDVESAKSVETYVVDSSVTVDNQQVGVIVANDYIVSLSFNGNLNYFKENDSNLAFVLSGHQQPLTSVKYKSESELLFTGGSDGSIYQREVDEKSTLSPIPSAVGDSKTKHSNYVVDIVSSGKEELITSGWDDTLKIWNAKDLATTIPLESGQPKQVFQVTESTVIVLFESNIELYSKTSGNLKKVTAVDLEFSASSISLVPSTDKLLVTNLTANTVEEYIVDSNSIVKLSTNFPQGRAPPTLVRVSPDGKYAAVADSSGKYTVYNANDRSVVTTRWAFHSSKVLDAKWTTDSKFIISVGLDSGIFIYSVDKPSKVLKFPLAHQNGVSGVEWTSYEFNDKKSASFITTGLDGVIKTWNVDLSVY

SEQ ID NO: 33757 - protein, 116 aa, Triticum aestivum
MSSRGGKLAPEVNRALFVKNLSYNVTPEELFDLFGKFGPIRQVRQGIANNTKGTAFVVYEDVTDAKQACDKLNGFNFQNRYLVVLYHQPDKMAKSKEDLEARRESLAQLKQQHGID

SEQ ID NO: 33758 - protein, 127 aa, Triticum aestivum
GPNVAQSQLVCTGCRNLLMYPAGATSVCCAVCSTVTAVPAPGTEMAQLVCGGCHTLLMYLRGATSVQCSCCHTVNLAMEANQVAHVNCGNCRMLLMYQYGARSVKCAVCNFVTSVGASPGAEQKPSS

SEQ ID NO: 33759 - protein, 565 aa, Cryptococcus neoformans var. neoformans JEC21
MAFRQLARAQPLLARQAIAPRASTLLPRALPAQAASFSSTTRRANIPPPNEVPKGAEVVQPKPYVLTRGRRFLQNFGRVTLIAILTATGAFLYVTYSQSNPVEQLDSDPSKPTLVVLGSGWGATSFLKTLDTDEFNVVVVSPRNYFLFTPLLPSVTVGTLEPRSIIQPTRYITRHKKRKVSVYEAEAKEVDPVKKTVTFEDISDIKGKASTVTIPYDYLVYAVGCENQTFGIKGVPEYACFLKELSDADKIRTKLMDCIETASFKDQPQDEIDRLMHMVVVGGGPTGVEYAGELHDFLIDDLKKWYPEVADRLKITLIEALPNVLPAFSKQLIEYTESTFKENKIDVLTRTMVKDVKAQSVIVQDANKEIKEIPYGLLVWATGNTSRNITRDLMTKLSHVQTQRRGLLVDDNLSLLGADGVYAVGDCTATSYAPTAQVASQQGIYLANIFQKLGQKTKLEKQLAALRADPTADASEIESLTKKVNRASKITPFHYSHQGSLAYIGSEKAIADLRLFNGNVASGGSAAMLFWRSAYVSTLYSVRNRTLVLTDWLKVKLFGRDVSRE

SEQ ID NO: 33760 - protein, 506 aa, Lactococcus lactis subsp. lactis Il1403
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 33761 - protein, 220 aa, Lactobacillus johnsonii NCC 533
MLKGLIFDLDGVLTNSAVYHLTAWNNLAKELGINLTDDQLDSLRGISRMDSLNLILKYGDQEDKYSEAEKEKFAAEKNTKFVEQVEKMTPADILPGIPELLSDAKKQNLKMVIASASKNAPKILTKLGIMDEFDGIVDPATLHHGKPDPEIYEKAQELAGLNADEVISFEDAQAGVQSIKSAGQFAVGIGDKEVLKEADYIVPTTKELKLSEIESVFNKK

SEQ ID NO: 33762 - protein, 245 aa, Glycine max
MTDVVLHIYDVTNSGSEKTNNTIVQINKIFKDGIGLGGIFHSAVQVFGDDEWSFGFCEQGTGVFSCPSGKNPMYTYRESIVLGKTNFSIFKLNQILRELSREWPGSSYDLLSKNCNHFCDEFCERLGVPKLPGWVNRFANAGDTAMEVAGNTALRFRQAKTEIVSASKVAYRFLLGVTNNVTNNVKNGPETPNNSNRGGSPRLQGSWLKNIITNGAKPSTSSEAENQNGVMPLPPTRDDKALLHS

SEQ ID NO: 33763 - protein, 570 aa, Bacillus cereus G9241
MTLNIQGIAASSGIAIAKAFRLENPEFNIEKKSITNEAAEIARLEAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 33764 - protein, 2682 aa, Rhodopseudomonas palustris CGA009
MSDSNEIGFAIVGLSGRFPGAPDVQKFWQNIKAGRTSVSRFSPEELEDSFADQERADPDFVAAKPVLDDVDLFDSDYFGMSPREADLTDPQQRIFLEICSEALDDAGYDPERYQGAVGVFAGSSLNTYFLRHVCPDRAALERFTSNFQVGSYSELLGTLNDFIATRVAYKLNLKGPAVSVQSACSTSLLAVAQACESLAALQCDMALAGGVSVTFPQKRGYIYQDGGIASRDGTCRPFDVDAAGTVFGSGAGVVAIKRLADAVADRDAIYAVIRGYGINNDGAAKVGFAAPSVGGQAECIAAALAMAGFEAETIGYVECHGTGTPLGDPIEIEGLSQAFAEASTGAIEDRNCALGSVKANVGHLDAAAGVTGLIKTALILHHGVLPPQANFAEPNPRLDLAKRGFRVATELQEWPRGDAPRRAGVSAFGVGGTNVHLCLEESPPAAAESLLPVENAVVLRLSARSPTALEAMRLRLADHLEAAVQRGERIGLNELAHTLAAGRRTFDRRWAVAVNSVQGAVQSLREVRSDPRPTSLRPGAVFMFPGQGAQYPGMGRWLFESDREFRADVELGAAIVKEHLGVDILAVLFDDRDDDDHAIRSTTLAQPALFLIEYALAQRLLRSGIEPKAMIGHSLGELVAAALAGVMSYQDALKLVVHRGRIMQAQPPGAMLSVRLAASELAAHLPVGVEIASDNSPRLSVASGPFEAVEELECRLERAEIPHRRLHTSHAFHSAMMDPVAVELEKVAAGIPLRPPKRRLISTVTGAWMTAAEATSPAYWARQCREPVSFRAALTTLIDTISERVDCLLVEVGPGRTLATFAGASSSVSKVRAIITTAPDYVERNDEELTFAQALGDLWVHGARLKSDVRPAAGTARLRLPSYPFERTRHWIARPAPVNLDISMPVASAQGDSFPRTEPPQEASSDQGGLHSVSMESKMSGDEVSKALIKALAAILSDVSGRPLSDQDAATSFISLGFDSLLLGQVAQRVNKSFGVKITFRQLMRDLNSLDALAAMLKTSAPADKLPQVERAAVKPQVAMMQRPAEAVLPKDPPVPVMAGATGVEALLREQLQSMERIFAAQLAAVGKEGRVAAELPVTAVPANSGEAPSPDNSPDKALVMPDTGEEGGGRFKIYRPGAGDGDLALAPEQRAYIENLVQRYNDRTPGSKARAQASRRVLADPRTASGFNAQWKEIVYPIVCKRSKGASIWDVDGNEYIDLVNGYGQTMFGHVPPFVAAALQAQLDDGFAIGPQTELAGEVAARISAMTGNERVAFCNTGSEAVMAAIRVARAVTGRLKVVVFSGAYHGQFDEVLIKSCRAGSVPGALPIASGIPAENVGQMIVLPYGHPVSLEIVRQMADDLAAVIVEPIQSRHPALQPRDFVASLRELTAKSGTALVFDEVVTGFRVDPGGMQKVFGIKADMATYGKVLGGGMPIGVVAGRADFMDALDGGFWQYGDESEPEVAPTFFAGTFVRHPMVLAAARAVLEHIERNKAEIYAPLAQRTGQLVDRINSHLDSYGLPTRAETCASWFFVDGSPLGRFAGLLFAELRLQGIHVHEGFPCFLTTAHEAAQCQAIDGAFERAIGAFADAGLSTGETKGITRKSSLIGDDQAQPQPQKFKTVPLTEPQMEVLLAAQMGDAASMAFNESVSIRFNGTLVESALIKAVEEVVRRHEALRSRVVDFTGMLEINPDFVPEVPIIALDGEDADTELAQWLAKDARTPFDLFNGPLVRASVLRLGADVHVLVFTAHHIICDGWSMNVLLGDLAEIYNAYRDGKAPSLVPAASFAEHAAERPRPSASTIEFWRKQFENVPVASELPLDRPRPEVKSFFGASLRERLGQDLCRDARELAKRQGVTLFTVLFASVQTLFARLCDNERVVLTVPMGGQALLDRQDLVGHCVNFLPVPVTARSAVSFCDHLRHVDEKLNEIFDHQDYTLGSLVRDLDIPRSINRTPLSDIQFNLERVGSRLTFRGVDTRVDTNPKAFVNFDIFINMIETDDDLTIEVDYATDLLDRATVSRWLDQLRKILAQALERPEIKLQELKLQNPVVIGLESGQTTTLQAARFDIPLVEMIERNCDRTPDAIAVEYETDVLRYRELDSRSNRIADRLRALAPTKGARVAVAVQRGIDLPVALVAVAKAGLAYVPVDPSLPVVRIRQMAEAAEVAVFITSGADCPVAAEMGVPVIDLERDAAQIDAASSARPEPAPPQEVLDSTAYVIFTSGSTGTPKGVEISHRALANFLGSMAVRPGFGADDRIVAVTTVSFDIAVLELLLPLYCGGRTVICGKDRLLEPDSIVRLIKTSSATIVQATPTLWRVLLEAGLQPSRPLRALSGGEALPRDVAEKLIAAGFELWNMYGPTETTIWSACGRIVDASRPIVIGEPVANTDLYILSDDGTQAPVGTPGELCIGGLGLAKGYVNRPDLTAAAFPVTSLQDGRTVRLYRTGDLAVRLSDGGIQLLGRRDQQVKIRGFRIELEEIESVLRTCPDIVDAAVMVENAGTADAALVAAFVAKPGMAVSIDSLQQTAQLSLPHYMVPNRFVAVAELPKTANGKLDRKALSATIVSPSIVVNFIEKAELRDEPAPDVLTKVIAIVEAALNRTGIKPDDRVFALGATSLHVFRMAARFSEAQLPIRAQDLMTNPSMSDLARRASVAARAQTSDKKTPSLAEFRRPSSRARTT

SEQ ID NO: 33765 - protein, 292 aa, Pseudomonas syringae pv. tomato str. DC3000
MIAGSMVALVTPMDAQGRLDWDSLSKLVDFHLQEGTNAIVAVGTTGESATLDVSEHIEVIRRVVAQVAGRIPVIAGTGANSTREAVELTTNAKTAGADACLLVTPYYNKPTQEGLFQHFSHIANAVDIPQILYNVPGRTACDMLPETVARLSRVKNIIGIKEATGNLQRAKDILASVSSDFLLYSGDDATAVELMLLGGKGNISVTANVAPRAMSDLCAAAMRGDAETARAIHQTLMPLNNTLFIESNPIPVKWALHEMGLMPDGIRLPLTWLSEACHEPLRQAMRQSGVLV

SEQ ID NO: 33766 - protein, 505 aa, Cicer arietinum
DKVPHSSSSSKVANKAIQQSNLSFSSSHLSGDKIVTLSGAGRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEFLILAGDHLYRMDYEKFIQAHRETDADITVAALPMDEKRATAFGLMKIDEEGRIIEFAEKPKGDQLNAMKVDTTILGLDDERAKEMPFIASMGIYVISKNVMLDLLSDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVIGLRSCISEGAIIEDTLLMGADYYETDADKRFLAAKGSVPIGIGRNSHIKRAIVDKNARIGENVKIINSDNVQEAARETDGYFIKSGIVTVIKDALIPSGTVI

SEQ ID NO: 33767 - protein, 421 aa, Frankia sp. CcI3
MTATTAESGRPDQPPTAEAGRPVRLTLTRRAGRAPRHLADLTRQERRDVAVSLGQPAFRADQVARHYYARLIAADEPEAMTDLPERDRQPLLDALLPRLLVPVRTLSCDDGLTRKTAWRTVDGASLESVIMRYPDRATVCVSSQAGCGMGCPFCATGQGGLTRNLSTAEIVEQVVHAARVLRRRELAGGETRLSNVVFMGMGEPLANYAAVIAALRRLTAHPPEGLGLSARGLTVSTVGLVPAIRRLAGEGLPVTLAVSLHAPDDVLRNELVPINTRWPVVEVLAAAWEYAEVTGRRVSVEYALIDGVNDDVGRADALADLLVGRLAHVNLIPLNPTGGSSWRASAPAGQRAFVRRLRDRGIVTTVRDTRGREIAAACGQLAAEPAGKPERTDRPEQVGSDRLVEFGAVGSTTPDGDRVLR

SEQ ID NO: 33768 - protein, 467 aa, Arabidopsis thaliana
  misc_feature (226)..(226): Xaa can be any naturally occurring amino acid
MEKQAHKKFCWIIKNFSPQSERLYSVPVLIGDCKWRPIAYPIRDKYFSLCLQVVDFESLPCGWGRYVELRLTLRNQHNSLNLSIKADHCFDEKRTTWGIPIPERIPICKLQTELYQSEHVVKGDFKIIAEVDVFEAVGTLTESDISGKASELLTKKIRNDGNESVDLLKKTSPEKESNHVNESKPESFITPTEKQVGHKFVWVIKNFSFSNSEKCYSDPFVIRGFXGVFLLNMTLCLPDSQLFPSEVVKARLTIVNQLSEKLSISKESEHCFDEQNPTLGYTFPYELLVEDGGFLVNEDLMIIVEVIGASDVFEDSSTQGKVDVNGFQVLPSQVEYVRSIFERHPDIAVEFRAKNQHLRTSCMIFLLSLIETLCQSLEELSNEDLVEADIALTYVKDAGFKVDWLEKKLDQVKEKKEKELSDMVQLQEMEDHLLKLKQSCSDLDDLVVKKKDELSVTRSPLSFDDVV

SEQ ID NO: 33769 - protein, 496 aa, Glycine max
MSTSSQHQFRYTQTPSKVLHLRNLPWECSEEELRELCRPFGKIVNTKCNVGANRNQAFVEFVDLNQAISMVSYYASSSEPAMVRGKTVYIQYSNRHEIVNNKSPGDIPGNVLLVTIEGVEAGDVSIDVIHLVFSAFGFVHKIATFEKTAGFQALIQFTDAETASSARDALDGRSIPRYLLPAHVGSCNLRISYSAHKDLNIKFQSNRSRDYTNPMLPVNYTAIEGAVQTAVGPDGKRKEPDSNVLLASIENMQYAVTVDVLHTVFSAFGTVQKIAIFEKNGQTQALIQYPDIITASAAREALEGHCIYDGGYCKLHLSYSRHTDLNVKAFSDKSRDYTVPDPSLLAAQGPATAWQNPQAASMYPGSAPAYHTQVPGGQVPSWDPSLQAVRPSYVSAPGTFHVQSGAAPPMPAYAPAAAMPVASSPHAQSSPMAHNANPMGIAQPRVPPNANLQSSGASLSAPGSSPLMQTSQAAQGLVQPNARPGGASPPGQHYYG

SEQ ID NO: 33770 - protein, 427 aa, Escherichia coli K12
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 33771 - protein, 191 aa, Arabidopsis thaliana
MGKKRKSTATSLDEVDRTVYASFRTAANSLSQLYTQSMNHQKLSFQAGERHGLEKLYQWIWRQQEGGSRVTPMDIVNYIQNELECCIDEPPISPRAPPPQSTMHVTNPGLMTTSGTSFPTAVPVVRSEQCENQAKNSVFSNALSSPIRRSLQNYQIPQGGYTSGGTTRSSEVNRGSNSPGSIDSSMDMHAE

SEQ ID NO: 33772 - protein, 582 aa, Magnetospirillum magnetotacticum MS-1
MCGLAALFSYRADAPPPDAAELARMTGAMTRRGPDGEGVWSGAEGRVRLGHRRLSIIELGEPGAQPMIADDGKTAIVFNGEIYNYRALRLRLEQQGVRLRSHSDTEVILEGYRLLGPDILAQLRGMFALAIWDGERGGILAARDGLGIKPLYVADDGRTVRLASQVKALLAGGGIETAPDPAGHAGFFLWGHVPEPHTLYRSIRALKPGTWERWGLDGRRDSGAFFDLGAELRRPRQAPRADLKSALEDSVAHHLVADVPVGVFLSAGRDSTTLAAMAAKLGTGKVKSVTLAFEEFAGTPKDEAPLAELAARHYATEHITRRIPGGDFAACRDQILADMDQPTIDGVNVWFVARAARESGLKVALSGLGGDELFAGYDNFTTIPRIVSVLGPSGAIPGLGRGFRALAGHFVRPKLAGLLELGTTLPDAYLLRRGLFMPWELPQVMDADMARIGLEALAPRLHLKRAAAGLGDDVAAISALEMQFYMRNQLLRDADWAGMAHSLEIRVPLVDTHLLDAVLDLRAAGRTPGKADMAACADPGLPTAILERPKTGFFVPVAQWLGESSLRGWAKRVHAALCEETL

SEQ ID NO: 33773 - protein, 321 aa, Solanum lycopersicum
MSTASINNCLTLSPAQASLKKPTRPVAFARLGNSSSSSSIPSLIRNEPVFAAPTPIINPIVREEMAKESYDQAIAALEKLLSEKAELGPVAAARVDQITAELKSADGGKAFDPVEHMKAGFIHFKTEKYDTNPALYGELAKGQSPKFMVFACSDSRVCPSHVLNFQPGEAFMVRNIANMVPAYDKVRYSGVGAAIEYAVLHLKVENIVVIGHSACGGIKGLMSLPEDGSESTAFIEDWVKICLPAKAKVLADHGGKEFAHQCTACEKEAVNVSLGNLLTYPFVREGLVKKTLALKGGYYDFVKGGFELWGLEFGLSPPLSV

SEQ ID NO: 33774 - protein, 266 aa, Prochlorococcus marinus str. MIT 9303
METPFRNVTPNTPGGAASLLIALLFSGLILITQALFVVPAGQVAVVTTLGKVSGGSRLPGLNLKIPFIQAVAPFDVRTQVRPEKFASLTKDLQVIEATATVKYAVRPNEAGRVYSTIASNDREIYPRIIQPSLLKALKSVFSQYELVTIASKWSDISELVERAVADELDKFDYVEVRGLDLTGLVIAEEYRAAIEQKQIAEQQLLRAQTEVKIAEQEAQRYETLNRTLDDKVLFKLFLDKWDGSTKVVPALPGTKGGGTPVIVGGR

SEQ ID NO: 33775 - protein, 130 aa, Brassica napus
  misc_feature (25)..(25): Xaa can be any naturally occurring amino acid
  misc_feature (30)..(30): Xaa can be any naturally occurring amino acid
  misc_feature (41)..(41): Xaa can be any naturally occurring amino acid
  misc_feature (46)..(46): Xaa can be any naturally occurring amino acid
  misc_feature (55)..(55): Xaa can be any naturally occurring amino acid
  misc_feature (57)..(57): Xaa can be any naturally occurring amino acid
  misc_feature (61)..(61): Xaa can be any naturally occurring amino acid
  misc_feature (63)..(64): Xaa can be any naturally occurring amino acid
  misc_feature (68)..(68): Xaa can be any naturally occurring amino acid
  misc_feature (74)..(74): Xaa can be any naturally occurring amino acid
IVRSVSVSMAAEGVRVEQRHGKARXRVGRXWRQGGDGSHHXVEWNXSISLLSHCXSXYHRXFXXTSPXTDTMKXFVPPPPAGGGGRPLLPWLPPPPPSPPPSPLPSPPARRPAHPAPSPPTPPPVPFPQL

SEQ ID NO: 33776 - protein, 123 aa, Silicibacter sp. TM1040
MDLIAQLEAEQIAALGKEIPDFKAGDTIRVGYKVTEGTRTRVQAYEGVCISRKNGSGIAGSFTVRKISFGEGVERVFPLYSTNIESIEVVRRGRVRRAKLYYLRSRRGKSARIAEDANYKAKA

SEQ ID NO: 33777 - protein, 883 aa, Arabidopsis thaliana
MPWWSKSKDEKKKTNKESIIDAFNRKLGFASEDRSSGRSRKSRRRRDEIVSERGAISRLPSRSPSPSTRVSRCQSFAERSPAVPLPRPIVRPHVTSTDSGMNGSQRPGLDANLKPSWLPLPKPHGATSIPDNTGAEPDFATASVSSGSSVGDIPSDSLLSPLASDCENGNRTPVNISSRDQSMHSNKNSAEMFKPVPNKNRILSASPRRRPLGTHVKNLQIPQRDLVLCSAPDSLLSSPSRSPMRSFIPDQVSNHGLLISKPYSDVSLLGSGQCSSPGSGYNSGNNSIGGDMATQLFWPQSRCSPECSPVPSPRMTSPGPSSRIQSGAVTPLHPRAGGSTTGSPTRRLDDNRQQSHRLPLPPLLISNTCPFSPTYSAATSPSVPRSPARAEATVSPGSRWKKGRLLGMGSFGHVYLGFNSESGEMCAMKEVTLCSDDPKSRESAQQLGQEISVLSRLRHQNIVQYYGSETVDDKLYIYLEYVSGGSIYKLLQEYGQFGENAIRNYTQQILSGLAYLHAKNTVHRDIKGANILVDPHGRVKVADFGMAKHITAQSGPLSFKGSPYWMAPEVIKNSNGSNLAVDIWSLGCTVLEMATTKPPWSQYEGVPAMFKIGNSKELPDIPDHLSEEGKDFVRKCLQRNPANRPTAAQLLDHAFVRNVMPMERPIVSGEPAEAMNVASSTMRSLDIGHARSLPCLDSEDATNYQQKGLKHGSGFSISQSPRNMSCPISPVGSPIFHSHSPHISGRRSPSPISSPHALSGSSTPLTGCGGAIPFHHQRQTTVNFLHEGIGSSRSPGSGGNFYTNSFFQEPSRQQDRSRSSPRTPPHVFWDNNGSIQPGYNWNKDNQPVLSDHVSQQLLSEHLKLKSLDLRPGFSTPGSTNRGP

SEQ ID NO: 33778 - protein, 446 aa, Lactococcus lactis subsp. lactis Il1403
MTITAADIRRDVKEKDIKFLRLMFTDILGTLKNVEVPATDEQLDKLFENKMMFDGSSIEGFVRINESDMYLYPDLDTWIVFPWGDEYGKVAGVICDVYTPEGEPFAGDPRGVLKRNLKSMEKLGFKSFNLGPEPEFFLFKLNENDEPTLEVNDKGGYFDLAPTDLAGNTRREIVNVLTDLGFEVEASHHEVAIGQHEIDFKYANALKACDNIQIFKLVVKTIARKHGLHATFMAKPVHGINGSGMHCNMSLFTEDGANAFADPTGDMGLSDVAHSFIAGLLKHAYNFTAITNPTVNSYKRLVPGYEAPVYVAWAGRNRSPLIRVPASRGLSTRVELRAVDPTANPYLALAVLLAAGLDGVEHKLEAPEAIESNIYVMTEEERKAHGITDLPSTLHNAVKALPEDTIVTEALGEHVLVNFVEAKRIEWASYAQFVSQWEIDNYLELY

SEQ ID NO: 33779 - protein, 439 aa, Bacillus subtilis subsp. subtilis str. 168
MFLHGTSRQNQHGHLEIGGVDALYLAEKYGTPLYVYDVALIRERAKSFKQAFISAGLKAQVAYASKAFSSVAMIQLAEEEGLSLDVVSGGELYTAVAAGFPAERIHFHGNNKSREELRMALEHRIGCIVVDNFYEIALLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVFCTGAYGYSMANNYNRIPRPAVVFVENGEAHLVVKRETYEDIVKLDLPFKTGVKQ

SEQ ID NO: 33780 - protein, 132 aa, Acidovorax sp. JS42
MDTMNWLDQVKWDAQGLVPVIAQEAATGDVLMFAWMNREALAKTAELGRAVYYSRSRGKLWFKGEESGHVQQVHDIRLDCDSDVVLLKVTQLGHEPGIACHTGRHSCFFNALQNGAWQAVDPVLKDPESIYK

SEQ ID NO: 33781 - protein, 442 aa, Lactobacillus johnsonii NCC 533
MKHTQVNHKKAALLGLQHLLAMYSGAIAVPLLIGTALKFNSTQMTYLVSIDIFMCGLATALQLLRNRYFGIGLPVVLGCAIQAVAPLQMIGKKFTIGTMYGAIIVAGVFVFLVAGYFSKIKKLFPPVVTGSLITVIGLSLIPVSIQNLGGGNSTAKNFGDPKNLLTGFITVAIILALQVWGKGFIKSIAVLVGLIAGTLIASTLGMVSLTPVAQASWFHLPQPFYFGMPQFEWSSSLTMIIIALVSMVESTGVFFAIGDLLHKDITSDDLKKGYRAEGLAQILGGIFNTFPYTTFSQNVGLLELSGITTKRPIYWASGFLMLMGLLPKFGALVTIIPDSVLGGAMLVMFTMIAVQGMRMLKRVDFEDTRNILIVAISIGLGLGVTVYPQVFQALPETIQLFLGNGIVVASLSATILNLLFKGKSGLEEQHIPAAPEKIEVQS

SEQ ID NO: 33782 - protein, 552 aa, Pseudomonas syringae pv. tomato str. DC3000
MYVYDDYDQKIIEDRVKQFRDQTRRYLAGELSEEEFRPLRLQNGLYVQRFAPMLRVAVPYGQLTSRQARMMAKIARDYDKGYAHISTRQNVQFNWPALEDVPDILAELATVQMHAIQTSGNCLRNVTTDQFAGVAADELVDPRPWCEIVRQWTTFHPEFAYLPRKFKIAINGSTSDRAAIEVHDIGLEPLRNEAGELGFRVLVGGGLGRTPVVGAFINEFLPWQDLLSYLDAILRVYNRYGRRDNKYKARIKILVKALTPEVFAAKVDAEMAHLRGGQTTLTEAEVQRVSRHFVDPQYKALDDQHAELAALEAQHPGFARWRQRNVLAHKKPGYIAVTLSLKPTGVAPGDVTDKQLDTIADLADRFSFGQLRTSHEQNIILADVEQAELFTLWNELRDNGFATPNIGLLTDIICCPGGDFCSLANAKSIPIAESIQRRFDDLDYLFDIGELDLNISGCMNACGHHHVGHIGVLGVDKKGEEFYQVSLGGSASRDASLGKILGPSFAQDAMPDVIEKLIDVYVEKRNEDERFIDTYQRIGIDPFKERVYAANH

SEQ ID NO: 33783 - protein, 119 aa, Acidovorax sp. JS42
MQHDPNCLFCKIIVGQIPSKKVYEDERVFAFHDIHPWAPVHFLVVPKVHLHSMAAVTPEHADLLGHMMTLAPKLAQEQGCNPYPDGGFRIVVNTGSEGGQEIHHLHMHVIGGPRPWLKG

SEQ ID NO: 33784 - protein, 93 aa, Zea mays
  misc_feature (66)..(66): Xaa can be any naturally occurring amino acid
MVFWATTLIFVLAGVAASLFTLLCCNRGPSTNLFHLTLVTTAVICCWMIWARCEYLGRRLHNMMSXNSKSIFRYAIVYLAQMKPLINPILSGE

SEQ ID NO: 33785 - protein, 517 aa, Lactobacillus johnsonii NCC 533
MAKTNLNDFDKIIVLDFGSQYNQLITRRIRDFGIYSELLPHDLSIEKIKEMAPKGIIFSGGPNSVYDKGALKVDPEIFKLGIPILGICYGMQLMSYDLGGKVEKADNSEYGRADIEVIDPNAVLFEGLPREQYVWMSHGDLVTKAPEGFTITAKSKNCPISAIANDEKKFYGIQFHAEVRNSEYGLDILKNFAFKVCGAKANWTMDDFIEMQVDEIRKKVGDKKVILGLSGGVDSSVTATLLHKAIGDQLTAIFVDHGMLRKDEGDQVMQALNKDLGVNIIRVNAQERFLNKLKGVTDPEQKRKIIGKEFIEVFNEEAKKLKDVDFLAQGTLYTDVIESGTNTAQTIKSHHNVGGLPEDMHFELIEPLRKLFKDEVRELGEKLGIPHDLVWRQPFPGPGLGIRVIGEVTEDKLKIVRESDAILREEIKNAGLQEDIWQYFTVLPGIRSVGVMGDGRTYDYTIGIRAVTSIDGMTADFAQIPWDVLSKISTRIVDECDHINRVVYDITSKPPSTIEWE

SEQ ID NO: 33786 - protein, 422 aa, Arabidopsis thaliana
MVKTGYVWSSLGLLNNEYALTDADIVHRKIELDLLKCIDFPEFTGSVVKALKREEKNSETIPFDLVIEILTRLPVKSIARFRCLSKLCASTLNNSDFTESFFTISSSRPKLLFTCPKDGETFFFSSPKPRDSSPLASYENLKGRTISKPLICNPSTGESWPLPRVKTNRTIITSYFGYDPINKEFKVLCMTKSKFGVFGEHQVLTFGTGKELSWRKIKCDMAHYPDVVDYEASGYPRPLYDGICINGVLYYLGRVHDDLDGFPDIVCFDIKFEKFSYIKKANGMKRNSGVNLQPTLVNHKGKIAKLQANIGPGSIRYTGIQLWVLEDAEKHQWSSYIYVLPPPWKNIIEETKLRFVGTSDTGDIVLSPCNISNSFYLLYYNPERNAITRVEIQGVEAFKSHKSYAFLDYAENIVKPKPTRKL

SEQ ID NO: 33787 - protein, 221 aa, Arabidopsis thaliana
MNYSNNYIEHQNKKKTIIIFFRQFKKQKPMLRMGVHLVGKTKKIFVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLNREAHRKYNTSKFFHAARSEPAGFLL

SEQ ID NO: 33788 - protein, 168 aa, Brassica napus
MAILAPASFGRLTVPSRAQVRVRVSASANPRTSVDWVKETSSFFEQDKRPIMLFDGVCNLCNGGVKFVRDHDRNRSIRFEALQSEAGKKLLMRSGRAPDDISSVVLVEKDRSYVKSEAVLKIMKYIDLPFPQLAFFLQFSPLFVRDFLYENVANNRYALFGRSDSCEI

SEQ ID NO: 33789 - protein, 76 aa, Picea mariana
HYFLKNGGHFVLSIKANCIDSTVPAEAVFAQEVKKLQKEQFKPFEQVTLEPFERDHACVVGGYRMPKKQKAADAAA

SEQ ID NO: 33790 - protein, 129 aa, Vibrio vulnificus CMCP6
MTKVLHTDSAPAAIGPYIQGVDLGNMVLTSGQIPVNPATGEVPADIAAQARQSLDNVKAVVEASGLTVGDIVKMTVFVKDLNDFGTVNEVYGNFFDEHNVAHYPARSCVEVARLPKDVGIEIEAIAVRK

SEQ ID NO: 33791 - protein, 172 aa, Synechococcus elongatus PCC 7942
MPEELTPTPETAVVEAGPVSRWLSENGFENTALERDHLGVEIVQVDREVLLPIAAALFAYGFNYLQCQGGYDLGPGQDLVSFYHLTKVSDDASQPQEVRVKVFLPRHDPKVPSVFWIWKGADWQERETFDMYGIQFEGHPNLKRILMPEDWVGWPLRKDYISPDFYELQDAY

SEQ ID NO: 33792 - protein, 307 aa, Brucella melitensis 16M
MLRGVPSICFRSSRMLKGSITALVTPFDREGAFDEKAFRAFVNWQIEEGTKGLVPVGTTGETPTLSHDEHKRVIEVCIEVAAGRVPVIAGAGSNNTVEAIELAQHAEKAGADAVLVVTPYYNKPNQRGLYEHFSRVARSISIPLVIYNIPGRSIIDMTPETMGALVRDCKNIVGVKDATGKIERVSEQRAICGKEFIQLSGEDATALGFNAHGGVGCISVTSNIAPRLCAEFQEACQAGNFAKALELQDRLMPLHKALFLEPNPSGPKYALSRLGRIENVLRSPMVTIEAATAEKIDHAMKHAVLIN

SEQ ID NO: 33793 - protein, 449 aa, Staphylococcus aureus
MMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 33794 - protein, 468 aa, Aspergillus nidulans FGSC A4
MAGNAPKKLCLRPSGFARSTLVPRSRSIATSVSRRATEPTSYQATRLIPTDPTFSHFINKDSDVPETSAGLESEAEGVGRKIRHYTVNFGPQHPAAHGVLRLILEINGEEIVRADPHVGLLHRGTEKLIEYKSYFQALPYFDRLDYVSMMTNEQCYSLAVEKLLNIEIPERAKYIRTMFGEITRILNHLMSVLSHAMDVGALTPFLWGFEEREKLMEFYERVSGARLHAAYVRPGGVSQDLPLGLLDDIYQWATQFGDRIDETEELLTDNRIWKARTQGVGVVSAADALNMSFTGVMLRGSGVPWDIRKSQPYDAYDKVEFDVPVGVNGDCYDRYLCRMEEFRQSLRIIHQCLNQMPAGPVRVEDYKIMPPPRAAMKENMEALIHHFLLYTKGYAVPPGETYSAIEAPKGEMGVFLVSDGSERPYRCKIRAPGFAHLGGFDQIARGHLLADAVAIIGTMDLVFGEVDR

SEQ ID NO: 33795 - protein, 373 aa, Aspergillus nidulans FGSC A4
MAPLVPSHEELERRRIVNVNAETVTNIASTDFPGHWPGESHEWNLDKFRDGFRVDFHQNKKFEASFSLIGLDASIANAFRRIVMAEVPTLAIEWVYIHNNTSVIQDEVLAQRLGLIPLQGSVEGLNWMQWYNKGSEDEPGSGSDLADYNTVVLRLDVECTKNPNASRDETDPRKLYKNAHVYAKDIVFHPVGRQEEFFTGEGAIRAVNPDILVAKLRPGQKIELEMHCIKGIGADHAKFSPVATATYRLMPVIQILRPIIGEDAKKFAKCFPKGVIGLEPITAEDERQNAEYRGRGGELKAVVRDAFNDTVSRECLRHDEFKGKVKLGRIRDHFIFNIESTGQFDSDVLFLESVKVLKLKCARWKRGLTDLMR

SEQ ID NO: 33796 - protein, 429 aa, Zea mays
  misc_feature (75)..(75): Xaa can be any naturally occurring amino acid
  misc_feature (86)..(86): Xaa can be any naturally occurring amino acid
  misc_feature (174)..(174): Xaa can be any naturally occurring amino acid
  misc_feature (225)..(225): Xaa can be any naturally occurring amino acid
  misc_feature (286)..(286): Xaa can be any naturally occurring amino acid
  misc_feature (322)..(322): Xaa can be any naturally occurring amino acid
  misc_feature (338)..(338): Xaa can be any naturally occurring amino acid
  misc_feature (352)..(352): Xaa can be any naturally occurring amino acid
  misc_feature (375)..(375): Xaa can be any naturally occurring amino acid
PPRLPRRRVSGAAATAAACRAVMATKRSVGTLGEADLKGKKVFVRADLNVPLDDAQKITDDTRIRASVPTIKFLXEKGAKVILASXLGRPKGVTPKYSLKPLVPRLSELLGVEVVMANDCIGEEVEKLAAALPEGGVLLLENVRFYKEEEKNEPEFAKKLASVADLYVNDAFGXTAHRAHASTEGVTKYLKPAVAGFLMQKELDYLVGAVANPKKPFAAIVGGSXVSSKIGVIESLLAKVDILILGGGMIYTFYKAQGYSVGKSLVEEDKLELATSLIEKAKAKGXVSLLLPTDIVVADKFAADAESKIVPATAIPDDWMGXLDVGPDATKTFNEALXDTTKTVIWNGPMGXVFEFEKFAAGTEAIAKKLAELTXTKGVTTIIGGGDSVAAVEKAGLADKMSHISTGGGASLELLEGKTLPGVLALDDA

SEQ ID NO: 33797 - protein, 114 aa, Zea mays
  misc_feature (65)..(65): Xaa can be any naturally occurring amino acid
QQLINYLLNFENSKPIIWLSHTSGCQDIMHYMHTNFDSFKNVYSVILHTQLTDSQYKDTLPETYXMIHLARKLINHCPRTYLMPRKANSYAPITAYRYHYLCSYITHDYIFNSH

SEQ ID NO: 33798 - protein, 118 aa, Frankia sp. CcI3
MHTLDSLDAESLRTDVPEFWPGDTLKVHVRVVEGNRQRIQVFQGAVIRRQGGGVRETFTVRKVSFGVGVERTFPLHSPIVSKIEIVSRGDVRRAKLYYLRQLRGKAAKIKEKREPVAR

SEQ ID NO: 33799 - protein, 563 aa, Vibrio angustum S14
MTDQKLSDNERLKRESNFLRGTIEQDLGDRMTGGFTADNFQLIRFHGMYQQDDRDIRAERAKQKLEPLHNVMLRARMPGGIITPKQWLEIDKFADEHTSYGSIRLTTRQTFQFHGVLKPNIKLMHQTLNSIGIDSIATAGDVNRNVLCTTNPVESELHQEAYEWAKKISEHLLPKTRAYAEIWLDGEKVETTDEEPILGSNYLPRKFKTTVVIPPQNDVDVHANDLNFVAIADNGKLVGFNVLVGGGLAMTHGDHSTYPRRADDFGFIPLEKTLDVAAAVVTTQRDWGNRSNRKNAKTKYTLDRVGSDVFKAEVEKRAGIQFEDSRPYEFTDRGDRIGWVEGIDGKHHLALFIENGRLLDYPNKPLKTGVAEIAKVHGGDFRMTANQNLIVAGVLAKDKDKIEKIARDHGLIDDGVSEQRKNSMACVSLPTCPLAMAEAERFLPEFVTDVEGILEKHGLDDDENIILRVTGCPNGCGRAMLAEIGLVGKAPGRYNLHLGGNRNGTRVPKMYRENITVAQIMDEIDSLVGRWSTERQESEDFGDFTIRAGIIDEVKVSKRDFYG

SEQ ID NO: 33800 - protein, 154 aa, Brassica napus
  misc_feature (147)..(147): Xaa can be any naturally occurring amino acid
MAASNGEKSLIVSFGEMLIDFVPTVSGVSLAEAPGFIKAPGGAPANVAIAVSRLGGRAAFVGKLGDDEFGHMLAGILKQNGVSAEGINFDTGARTALAFVTLRSDGEREFMFYRNPSADMLLRPDELNLDLIKSAKVFHYGSISLIXEPCRSAH

SEQ ID NO: 33801 - protein, 1096 aa, Klebsiella aerogenes
MLRYTCHALFLGSLVLLSGCDNSSSSSTSGSPGSPGNPGNPGTPGTPDPQDVVVRLPDVAVPGEAVQASARQAVIHLVDIAGITSSTPADYATKNLYLWNNETCDALSAPVADWNDVSTTPTGSDKYGPYWVIPLTKESGSINVIVRDGTNKLIDSGRVSFSDFTDRTVSVIAGNSAVYDSRADAFRAAFGVALADAHWVDKTTLLWPGGENKPIVRLYYSHSSKVAADSNGEFSDKYVKLTPTTVNQQVSMRFPHLASYPAFKLPDDVNVDELLQGDDGGIAESDGILSLSHPGADRRRAGRYLCRRAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMGYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGRQSGQPCRRHRGGDQRRAGKPDAAGLRRHIAPAERYSAGGGRPVAGERVQVAADGSVTLPAWSVAVLELPQASRRALACR

SEQ ID NO: 33802 - protein, 1090 aa, Klebsiella pneumoniae
MLRYTRNALVLGSLVLLSGCDNGSSSSSSGNPDTPDNQDVVVRLPDVAVPGEAVTAVENQAVIHLVDIAGITSSSAADYSSKNLYLWNNETCDALSAPVADWNDVSTTPSGSDKYGPYWVIPLNKESGCINVIVRDGTDKLIDSDLRVAFGDFTDRTVSVIAGNSAVYDSRADAFRAAFGVALAEAHWVDKNTLLWPGGQDKPIVRLYYSHSSKVAADGEGKFTDRYLKLTPTTVSQQVSMRFPHLSSYAAFKLPDNANVDELLQGETVAIAAAEDGILISATQVQTAGVLDDAYAEAAEALSYGAQLADGGVTFRVWAPTAQQVDVVVYSADKKVIGSHPMTRDSASGAWSWQGGSDLKGAFYRYAMTVYHPQSRKVEQYEVTDPYAHSLSTNSEYSQVVDLNDSALKPDGWDNLTMPHAQKTKADLAKMTIHESHIRDLSAWDQTVPAELRGKYLALTAGDSNMVQHLKTLSASGVTHVELLPVFDLATVNEFSDKVADIQQPFSRLCEVNSAVKSSEFAGYCDSGSTVEEVLNQLKQSDSQDNPQVQALNTLVAQTDSYNWGYDPFHYTVPEGSYATDPEGTTRIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMGYHPKAQILSAWERIKALNPDIYFFGEGWDSNQSDRFEIASQINLKGTGIGTFSDRLRDSVRGGGPFDSGDALRQNQGIGSGAGVLPNELASLSDDQVRHLADLTRLGMAGNLADFVMIDKDGAAKKGSEIDYNGAPGGYAADPTEVVNYVSKHDNQTLWDMISYKASQEADLATRVRMQAVSLATVMLGQGIAFDQQGSELLRSKSFTRDSYDSGDWFNRVDYSLQDNNYNVGMPRISDDGSNYEVITRVKEMVATPGEAELKQMTAFYQELTELRKSSPLFTLGDGSAVMKRVDFRNTGSDQQAGLLVMTVDDGMKAGASLDSRLDGLVVAINAAPESRTLNEFAGETLQLSAIQQTAGENSLANGVQIAADGTVTLPAWSVAVLELPQGEAQGAGLPVSSK

SEQ ID NO: 33803 - protein, 568 aa, Triticum turgidum
MASWFETYHHPSKPPRERETAAFFGCRLGIRENNCELTCASCRSFLPPVKILIRSIRLGCCCSWVRGSCACCCSWIRGLCGRKKREAGKETSTPETKKTKRKWRRNFCGWTSHEAEEPLTSETKKKREAGQEASTSETKKTKRKWGRSFCGWTSHEAEEPLTSETKKKRKNGASSSEPDKKRWFKNKIWRKKKAKNKQLATLVKEISLPNSPKARAAAGEILRIGNHNIPSRVFAYSQLSDATNSFSQENLLGEGGFGRVYKGYISETMEVIAVKQLDKDGLQGNREFLVEVLMLSLLHHPHLVTLLGYCTECDQKILVYEYMPLGSLQDHLLDLTPKSQPLSWNTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPKLDSKYPLKGLYQALAISSMCLQEEASSRPLISDVVTALTFLADPNYDPPDDIEPLPITVPDFDRGISLSEPEEVKEKFEGKQVEDS

SEQ ID NO: 33804 - protein, 391 aa, Thermosynechococcus elongatus BP-1
MNLLEQLRQMTVVVADTGDILAIQKFTPRDATTNPSLITAAAQMKEYQSIVDETLRQAKADLGSGATSREIVSLAVDRLAVAFGLKILQIIPGRVSTEVDARLSYDTAATVQKARELISQYEAAGVGRDRVLIKIAATWEGIRAAEILEKEGIHCNLTLLFGFHQAVACAEAGVTLISPFVGRILDWYKKKTGRAEYPGPEDPGVISVTKIYNYYKKFGYPTEVMGASFRNIGEIIELAGCDLLTISPALLQELQNTTGELKRKLDPAIAATLDIEKVAMDEATFRKMHAADEMASEKLEEGIKGFTKALETLEDLLRRHLARIEGEATLTHAAEELFHVYDLDGDGIITREEWLGTDAVFDALDANHDGKVTPEDMGAGLGVVLHLAQAK

SEQ ID NO: 33805 - protein, 765 aa, Oryza sativa
  misc_feature (483)..(483): Xaa can be any naturally occurring amino acid
  misc_feature (508)..(508): Xaa can be any naturally occurring amino acid
MGRDAARALRLSGRGMGLQRTRGDAGPDGRRAVARGGALRRREGRHGAGARRKVGGQGEGLGRSRGGPRKVAAPGIKERREADGRGGTAEVAERGSSESGDATRGREGRPAAETAAWGGREGTQERRWLEESPRGRPTAALDCAWRRKQSTRDASYASAGTAEKGGEELTDGRRHRVTVGVPGKGTEACGGALGRGGGDAPGLAARRRPRLREEAAEDGPCDGEMSPDMELDATARSSHGGRAPPLGGGTKQGREEAQGVGFIETEWERQGRFEVAAVFLALGWCSWAPRERATARMQRVVEAVDRVVGNRTASTGGLARGERVRSRWGRRGAAAASAALPFEQEAKEWRQGARYPGGEKAKGGGGGKGALLLPFWEERDENEPRLTVLDACGMGRRAREDDAGDDCKRTGTVVDLAKELISMFTAREMGKVFFTNSGSEANDSQVKIVWYYNNALGRPKKKNIISRTQSYHGTTFISASLSXDFDLPGRFVLHTDCPHYWRFHLPEXFFDEINDFCGRQIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 33806 - protein, 105 aa, Gossypium hirsutum
LPLGGQITILTGIFYWIAQLLGSIVACFLLKAVTGGLTVPIHGLGAGVGAIQGVVMEIIITFALVYTVYATAADPKKGSLGTIAPIAIGFIVGANILAAGPFSGG

SEQ ID NO: 33807 - protein, 189 aa, Gossypium hirsutum
NTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPFIVGIFFGVETLSGVLAGSLVSGVQVAISASNTGGAWDNAKKYIEAGASEHAKTLGPKGSDPHKAAVIG

SEQ ID NO: 33808 - protein, 356 aa, Triticum aestivum
MDQPKPTPSAAASPAGADAAPNPYAFTCELPQSIYALAFSPSAPVLAAGSFLEDLHNRVSLLCFDSVHPTAASFRAVPSLSFDHPYPPTKLQFNPRAASTPLLASSSDALRLWHAPLDDLSASAPAPELRSVLDNRKASASDFCAPLTSFDWNEIEPRRIGTASIDTTCTVWDIERGVVETQLIAHDKAVHDIAWGEAGVFASVSADGSVRVFDLRDKEHSTIVYESPRPDTPLLRLAWNRYDLRYMAALLMDSNAVVVLDIRAPGVPVAELHRHGGCVNAVAWAPQAARHLCSAGDDGQALIWELPEAPAAVPPEGIDPVLVYDAGAEINQLQWVAGHPDWMGISIENKVQLLRV

SEQ ID NO: 33809 - protein, 573 aa, Coprinopsis cinerea okayama7#130
MEFLPQPNVPLPHLPDDLTLPQFILDAEHPTKPKRNEDIPWLIDDETGRRLGGAELKRRTLGLSNALHLRYGIGRDDVVLVYSRNHTDYPVAIWATQQLGGVISGANPDFSKQELVYQIQEAKARLLIAHPQSFDTALAAARETGIPDQNVILFDVPGVQPPSTRQTVEGLVQYGLSQPISFTELKLRPGEGKTKLAFLSFSSGTTGRPKAVAIQHHSVIVNIIQWAVHNKVNDDYAPWSEQRFRPGDVATAVLPFYHIYGLVLNLHALLHAGMSVVVTARFNIDSMMKSIAKYRITHLYLVPPMVVQFCKYPGINESPIRKQIRLVFCGAAPLTHELNAQMFELFPNAQIGQGYGMTESGPLTMAFPISQKRGVPGSSGHLLPGTVARVVKFDGTLAGYDEPGELWIKTPAITLGYANNEEATRETFIDGWVRTGDEVVIDKAGEEIMKVRGFQVAPAELEGCLLEHPDVSNACVVGIPDDYSGEVPLAFVALSPSAATRAKDPMEAERIKASITKHVADQKVHYKRLAGGVEFIAQIPVSPSGKLLRRVLRDQAKTLAANRSKPNGRTAKL

SEQ ID NO: 33810 - protein, 574 aa, Oryza sativa (japonica cultivar-group)
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNNRAIRAEWRRW

SEQ ID NO: 33811 - protein, 183 aa, Oryza sativa
QPWRLVDLLHLALAGVVLQRRHVGVSLSRLVLVDTQAELEHPVDPGAEGVGVLKAEAGGQEGSLEEQHHQVLHRLVVLVSIGTLALRAEFGTRPRAEFGTRDTLKLGVCANVLNGLINVQLGTPPRQPCCSLIQGLADLEAAVCLCTALRANILGINLNLPINLSLLVNYCGRSVPSGFQCSN

SEQ ID NO: 33812 - protein, 323 aa, Nostoc punctiforme PCC 73102
MTPATSLFTPVEADLRLLADNLKQLVGNRHPILFAAAEHLFGAGGKRIRPAIVLLISRATMLEQDITPRHRRLAEITEMIHTASLVHDDVVDESDVRRGVPTVHSLFGNRIAILAGDFLFAQSSWYLANLDNLEVVKLLSEVIMDLATGEIQQGLNRFDAGISIETYLQKSYYKTASLIANSSKAAGLLSEVSRETVEHLYSYGRHFGIAFQIVDDILDFTSTTDTLGKPVGSDLKSGNLTAPVLFALAEKPSLEVLIDREFAQEGDLEQALALIQDSQGIHKARELAAHHAKLAIEHLAVLPPSESHQALINIAEYTLSRLY

SEQ ID NO: 33813 - protein, 420 aa, Arabidopsis thaliana
MLLHFGSVPVIVASTAEAARDVLKTHDRVFASRPRSKIFEKLLYKSRNMASAPYGEYWRQMKSVSVLHLLSNKMVRSFQDVRQEEITLMMETIRKSSSKPVNLSKILSSLTNDVICRVALGRKYGVGTDFKELIDRLMRQLGTFTIGSYVPWLAWTDWVSGLEARLEKTANDFDKLLERIVQDHEDGDGDKTDFVDVLLAAQRDKSFGFDIDRLSIKAIVLDAFVGGTDTSSTLVEWEMTELLRHPTCLKKLQEEVRTICKGKSSVSEDDIQGMEYLKAVVKEALRLHPPVPLMVPHQSTQDVRLRDNHIPAGTQVIVNLWAVGREAATWGPDANEFRPERHLESPSDFRGQDFELIPFGAGRRMCPGISFAVVLNEVVLANLVHGFDWQSIDDETDVAESIGSVIRRMHPLYVIPSSTT

SEQ ID NO: 33814 - protein, 434 aa, Triticum aestivum
  misc_feature (79)..(79): Xaa can be any naturally occurring amino acid
  misc_feature (111)..(111): Xaa can be any naturally occurring amino acid
  misc_feature (282)..(282): Xaa can be any naturally occurring amino acid
  misc_feature (331)..(331): Xaa can be any naturally occurring amino acid
MGSSASCLWSGSKSEPGPNGLAAAAASPRSGHVLSRSGRNIQVFSLKELKSATRNFHMMNCIGRGGFGPAYKLDLRPIXGDTTEQVCTKKQAGTGPEFPGYRRPPRPTSLXDLRDGTQVAIKRLSAESKQGTNEFLTEIDVISNVRHPNLVKLIGCCVEGNNRLLVYEYAENNSLSNALLGPKSRCIPLNWQTRAAICTGTASGLAFLHEEAQPRIVHRDIKASNILLDKTLVPKIGDFGLAKLFPDAITHISTRVAGTMGYLAPEYALLGQLTKKADIYSXFGVLLLEVISGESSSKSTWGEDMHVLVEWTWKLREEGRLLEIVDPDVEXEYPEEQVLRFIKVALLCTQPTAQQRPSMKQVVHMLANETEIDLQNAVPPGVLKEPRRKMGSLGDLALDTSSSQSTRANVAGSCTTQTRDMNSCNFSTTEVSPR

SEQ ID NO: 33815 - protein, 175 aa, Arabidopsis thaliana
MGKKRKSEATRLDEVDRTMYDAFRGAANSLSQLYTHAMNHQRVSFLAGERRGMEKLYQWIVRQEEQGTRVSTADITTYLQNALEYEPEETSIPLPMQEFYQHQFAPPNVNTSVAHVPSSHIAQQQHYDCNQEKLLIPPNGLSSPVRRTLQDFNLCEAESGNNNYNPNSTGEHLSY

SEQ ID NO: 33816 - protein, 358 aa, Glycine max
MGEEVDTAFVQAPEHRPKSSVIVAEGIPLIDLSPINYQNEDTLLDSSIENLVKEIGSACKKWGFFQVINHKVPLDKRERIEEAAKKFFALGLEEKLKVRRDAVNVLGYFEAEHTKNVRDWKEIYDFNVQEPTFIPPSDEPDDEENVQFQWDNRWPQNPPEFKEACQEYAQEVEKLAYKLMELVALSLGLVPNRFRGYFTHNTSNIRLNHYPACPYPHLALGLGRHKDTGVLTVLAQDDTGGLEVRRKSDGEWIRVKPIFNSFIINVGDMIQVWSNDAYESVEHRVMVNSEKDRFSIPFFLKPALYTDVKPLEELLDDRNPPIYRPVNWGKFRSARMRSNFAKSKVENLQIYDFKFPSN

SEQ ID NO: 33817 - protein, 227 aa, Pneumocystis carinii
NDPNRTIEGDLFRAFVDTGGIAEMNADDPKKSSLNRAARTDRGVHAACNVLSLKLIIEQPNLLERINEALPETIRVWGISRTLKSFNPRTFCEARIYEYLVPSYVFIPPYPMTQLAQRITKHREMINCIENSEWINGNEYLLYCKDAKDIWSDERIQHLEKMINESSTSIENVDEKNGETSNISSQFQEHLEKEKIKQIELEIRRTYRISNERLQLIRDAFKIFEGS

SEQ ID NO: 33818 - protein, 513 aa, Arabidopsis thaliana
MKNRSLGFWAIGVLLIGSLIGATEGSIHEYNNEKFTAKFNARFFHGGSEGLYASKSQDLNSSSSSDNSFKGKSFIRFDDVTFVRTKESASKQNAMQSTSGLVEAIILEVKDRDRIGGTFLKSEVICCTPELADTGSCSLGEVIIKRESNDVEWPRQIKTFFKGNKTEVNMSPETVVINKTGMYYLYFMICDPELDGTRIKGRTVWKNPDGYLPGKVAPLMNVFGFMSLAYILLGLVWFVRFVQFWKDIIQLHYHITLVIALGMCEMAVRYFEYVNFNSTGMRPMDVTLWAVTFSSIKKTLSRLLLLVVSMGYGVVKPTLGGITSRILLLGVIYFVATEALELVEHLGNINDFSGKTMIVLVIPVALLDACFILWIFSSLARTLEKLQIKRNMAKLELYRNFTNALAISVLLSIAWIGFELYFNGTDPLIELWRMAWIIPAFWNLLSYGLLAVICILWAPSNNPTRYSYLAETGDEFEEEGISLTGSGIKSTEDVERNELLFGLPDDVEEGKRE

SEQ ID NO: 33819 - protein, 411 aa, Thermosynechococcus elongatus BP-1
MPGGVSSPVRAFKSVGGQPIVFDHVKGAHIWDVDGNQYIDYVGSWGPAIVGHAHPEVIDALHAALEKGTSFGAPCLLENILAEMVIAAVPSVEMVRFVNSGTEACMAVLRLMRAYTQREKVIKFEGCYHGHADMFLVKAGSGVATLGLPDSPGVPKATTAATLTAPYNDLEAVSRLFEQYPNDIAGVILEPVVGNAGFIPPDAGFLEGLRELTKQYGALLVFDEVMTGFRIAYGGAQEKFGVTPDLTTLGKVIGGGLPVGAYGGRAEIMKMVAPAGPVYQAGTLSGNPLAMTAGIKTLEILSRPGSYEHLDRITGKLVQGLLDAAREFGHEVCGGHISGMFGLFFTAGPVTNYEQAKQSDLKKFAAFHRGMLEQGIYLAPSQFEAGFTSLAHTEADIERTIAAARTVLSQL

SEQ ID NO: 33820 - protein, 637 aa, Cryptococcus neoformans var. neoformans JEC21
MAATDVNGLASQMNSVNLNGASQKPQKPAYVPPHLRNRAAPPAAVPPAAPAAYRPSPTGLPTPATTPPTRHIVPAAVAEDDVGGWGAQPRVRKTFEHGAPPGFGSWKNGQHVVGARNTRMEKEMYGEVGDGLHQATGINFDKYADIPVEVSGKGVPEPVTEFTNPPINPVLLENVKYARYATPTPVQKYSIPIVADGRDLMACAQTGSGKTGGFLFPILSALFTYGPSTPPVEQDTGYGYRRTKKVYPTALVLAPTRELVSQIHEEARKFAYRSWVRPAVVYGGADIGSQMRALDRGCDLLSATPGRLVDLIERGKISLANVKYLVLDEADRMLDMGFEPQIRRIVDEEDMPGVLERQTLMFSATFPREIQNLARSFLKEYIFLTVGRVGSTSENITQRVEYVDDQDKRSLLLDLLLAEQSGGLILVFVETKRMADTLCDFLCSRRHNATSIHGDRTQREREAALYAFKSGRAPILVATAVAARGLDIPNVTHVILYDLPNDVAEYTHRIGRTGRAGNVGTSTAFFNRGNTNIGKDLIELLKEANQEVPQWLVEISSERSYGGGGGGGYKGSRGRSTGGGGGARLGGRDMRQGGGGYGGGGRTSGYGGGYGGGGGGAGWGSGGGFPPAGGDSGASWW

SEQ ID NO: 33821 - protein, 263 aa, Oryza sativa (japonica cultivar-group)
MAGLYERPSETYTKKRPRYPDAWFSKLAALTAGHHRAWDAGCGTGQASISIAEHYDSVVATDASEGQIRHAVAHPKVRYLHTPVDLSEDDLVAMVGGEGSLDLVVVATSIHWFDIPLFYAVANRVLKRPGGVLAVWGYNYEIHPFEDKLHGQLYPAMRPYMDPRTRLAMDRYRDLPFPFEPVGVGREGEPADVDIEVDMTLDDLVGFLKTGSVVTTAREKGVDLEAVTKDVMKGVEAEWGDPAVARKLVFKAFMLAGKPKVLN

SEQ ID NO: 33822 - protein, 144 aa, Zea mays
MGNTPVTISQALHSYFAVSDVRQARVEGVEGLSYIETLADWEQRQQQGPLAFAGETDRIYLATPQTLSIVDPHWERRITLTSSGSRSAVIWNPWTERARELPDMADDGWQRMLCIETANVWDDLVELKPVGSSSLGVRIGCEMI

SEQ ID NO: 33823 - protein, 311 aa, Haemophilus somnus 2336
MNYLQIARNSLAAEQNALAKLSQNLNQQFNQVVELILNCEGRLVVGGIGKSGLIGKKMVATFASTGTPSFFLHPTEAFHGDLGMLKPIDIVMLISYSGESDDVNKLIPSLKNFGNKIIALTGNLNSTLAKHADYILDISVEREACPNNLAPTTSALVTLALGDALAVSLITARNFQPADFAKFHPGGSLGRRLLCRVKDQMQVRLPKVTENTNFTGCLTVMNEGRMGVALVMENENLKGIITDGDIRRALSANGTNTLNKIAKDLMTSNPKTINYNTYLSEAENFMKEKKIHSLVVVDDQNKVIGLVEFSS

SEQ ID NO: 33824 - protein, 130 aa, Glycine max
  misc_feature (119)..(119): Xaa can be any naturally occurring amino acid
MARNEEKAQSMLNRFITMKAEEKKKPKERRPFLASECRDLSEADKWRQQIMREIGRKVAEIQNEGLGEHRLRDLNDEINKLIREKSHWERRIVELGGPNYSKHSAKMTDLDGNIVDVPXPGGRGPGYRYF

SEQ ID NO: 33825 - protein, 675 aa, Zea mays
GAVETLQGKAATGELLEKSVNTIRFLAIDAVEKANSGHPGLPMGCAPMGHVLYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVPEDVKSHWSRHTPEGAALEADWNAKFAEYEKKYADDAATLKSIITGELPTGWVDALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVMGTGSELEIAAKAADELRKEGKTVRVVSFVSWELFDEQSDEYKESVLPAAVTARISIEAGSTLGWQKYVGAQGKAIGIDKFGASAPAGTIYKEYGITVESIIAAAKSF

SEQ ID NO: 33826 - protein, 550 aa, Vibrio angustum S14
MLKNINPTQTQAWQDLTAHFEQAQDFQLSDLFANDSARFSKFSAQFGSDILLDYSKNLITEETLTKLFALAKETELDAAIADMFSGEKINRTEDRAVLHVALRNRSNTPIMVDGEDVMPAVNAVLEKMKSFSDRIISGEWKGYTGKEITDIVNIGIGGSDLGPYMVSEALGAYKTRLNMHFVSNVDGTHIAETLKDLNPETTLFLIASKTFTTQETMTNALSARDWFLAKAEDKAHVAKHFAALSTNGEAVTEFGIDTDNMFEFWDWVGGRYSLWSAIGLSICLSVGFDNFVALLDGGHAMDKHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRPTNSILVKEITPYTLGALIALYEHKIFTQGVIWNIFSFDQWGVELGKQLANQILPELNNKEEVSSHDSSTNGLINAFKQWRA

SEQ ID NO: 33827 - protein, 320 aa, Bacillus cereus G9241
MKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYNYDQNLRTYLRRIKRKTALLIAASCQLGAIAAGANRDTVSRLFWYGYFVGMSYQIIDDILDFVSTEEKLGKPAGGDLLQGNITLPALYAMEDPILCKKIRSVHENTTADEMKEIIEAVKNSAAIDKAFAFSERYLHKALEIIKPLPRGQAKYALQNVAKYIGKRKF

SEQ ID NO: 33828 - protein, 343 aa, Gibberella zeae PH-1
MTSDLAVGPYLERTSSYQLIHLKLIDFSLFLNGTPSERNDTANAILEGFKTAGFIYLKNHPVSPKELQHAFDMSARWFDQPLESKMKVVWTTPEANRGYSAPGREKVSQLTDLADVEKMRAALPDIKESLEIGRENEAGHPNYWLEESGELVGFRKDMLGFFEQCRQLHVEVMKAIAVGMGLDDGFFDGFVDVGDNTLRLLHYPSVQSNVFKMNPGTVRAGEHSDYGSITLLFQDVRGGLQVKSPTGQFVDATPIEGTVVVNAGDLLARWSNDMIKSTIHRVVEPPQKEAESYPPRYSIAYFCNPNFKSFIEAIPGTFETEKDKKYDGINSGDYLVQRLTATY

SEQ ID NO: 33829 - protein, 148 aa, Bacillus cereus G9241
MEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 33830 - protein, 174 aa, Zea mays
MAKQGAKKMKDENKKRLDLLLRIILISNVIYIVVRMAIMHSSFTWKHWIGLMVTSAGYFLPYKQLASMAKPVYSDNGELLDGGFDLSTGGVCEYLYDVIYITVFVQLMSIISEKFWWTYLVIPAFAGYKISGLLRGAFFSGGSEGEVEDEKTRKKREKMEKKASRGKMIKIRTR

SEQ ID NO: 33831 - protein, 191 aa, Oryza sativa
  misc_feature (152)..(152): Xaa can be any naturally occurring amino acid
MSHFGRSGPPDIRDTFSLLVLNISFRTTADDLFPLFDRYGKVVDVFIPRDRRTGDSRGFAFVRYKYAEEAQKAIDRLDGRNVDGRNIMVQFAKYGPTAEPIRNGRIIEEVEKSRDRSRSRSPRRRHRDDHRDRERRCRRRSRRSERHGRARXRDHRRYSRRRSRTSRRCRKRDYDRVKTGVRRELQGGHRR

SEQ ID NO: 33832 - protein, 125 aa, Glycine max
MSSFLPASAESLDLAVEAKDPSESISILYQVLDDPSSSPDALRMKEQAITNLTEHLREQNRAEDLHSLLTQLRPFFSLIPKAKTAKIVKGIIDTVAKIPGTSDLQITLCELVMQWTVVAARLLEP

SEQ ID NO: 33833 - protein, 103 aa, Aspergillus nidulans FGSC A4
MSGRGKGGKGLGKGGAKRHRKILRDNIQGITKPAIRRLARRGGVKRISAMIYEETRGVLKSFLESVIRDAVTYTEHAKRKTVTSLDVVYALKRQGRTLYGFGG

SEQ ID NO: 33834 - protein, 187 aa, Hevea brasiliensis
EQCGRQAGGKLCPNNLCCSQWGWCGSTDEYCSPDHNCQSNCKDSGEGVGGGSASNVLATYHLYNSQDHGWDLNAASAYCSTWDANKPYSWRSKYGWTAFCGPVGAHGQPSCGKCLSVTNTGTGAKATVRIVDQCSNGGLDLDVNVFRQLDTDGKGYERGHLTVNYQFVDCGDSFNPLFSVMKSSVIN

SEQ ID NO: 33835 - protein, 502 aa, Silicibacter sp. TM1040
MARTADDILKNLGLTAAELSGGSRAVRSPIDGSTLAEVHDTPAGEMPAILDRAQSAFKAWRVVPAPRRGELIRLLGEELRAAKEDLGALVSWEAGKITSEGLGEVQEMIDICDFAVGLSRQLYGLTIASERPGHSMRETWHPAGPVGVISAFNFPVAVWSWNAALAIVCGDPVIWKPSEKTPLTALACTKIFERAVKRFGEDAPEGLLQILIGDAELGKELVASPSVPVISATGSTRMGRAVAPVVAERFGKCILELGGNNAMIVAPSADLEMAVRAIVFSAVGTAGQRCTSLRRLIVHNSIRADLVKRLKAAYAGLPIGDPQAAGTLVGPLVDEAAGDAMISALKAAESEGGTVHGGARVTEGVPAGGVYMAPAIVEMPGQSASVKEETFAPILYVMGYDDFEDAVEMQNDVPQGLSSCVFTLNMREAESFLTAAGSDCGIANVNIGPSGAEIGGAFGGEKETGGGRESGSDAWKSYMRRQTNTVNYSAELPLAQGVKFDI

SEQ ID NO: 33836 - protein, 1531 aa, Debaryomyces hansenii CBS767
MGRYRDRNRETDENDDTNRQATMTTTLVQQHSRQSLGKFVNPSPTKYESTENMDKVVQSVTNATKRLSQISTNTNSSAKKRKTQNRIGPWKLGRTLGRGSTGRVRLAKNVNSGKLAAVKIVPKSNFKKLENPKYKRNSVDSSGSVKDRLPYGIEREIIIMKLISHPNIMGLYDVWENKNDLYLILEYIEGGELFDYLIKKGKLQEFEAISYFKQIINGIHYLHQFNICHRDLKPENLLLDFNKNIKIADFGMAALEVREKLLETSCGSPHYASPEIVAGKNYHGAPSDIWSCGIILFALLTGHLPFDDENIRKLLLKVQNGKFLMPNNLSSESKDLISKMLKVNPSERITIDAILQHPLLTKYPEPSVRKDKVTEYSDLNIRPIDSINNIDKEILKNLSVLFHNRDEQTIISKLLSPEDCSEKTFYYLLVKYRNEHLTASNNTINNYEDDPDLTGSESKQTITRSTSIVKTTTTDPLTGEKHTTIRKIPNSTSNFSNRSRSPKKKPEVLGNITNTAPTFKASTSFNKKKTLMNNNVISRNNSSKSLRKRPPQQQPPKLSRKISGMPDLNDLRLEKTQLNSLYKQQKLNGSFGNKSLFNFESVCQEIFGNAEQHEGDRKIEPKENLRKDKQMDGRTGKLSNIEKCERELAAKVHEKNDARALKLQHQQKEEDAKLQHKKQLESKKRDQSKLLQEKQRQALEKLGSQIQDNNDNNRRGIAHRTQQRHVTEPAPTSSLDPKLGGGAKSLLRAKSLASPSSYVSLRQNTHTSDNTSKVLQTLGIEVAPLKTSTKFNSNLKTSSSKNLSDYLDNETLYSRSDKSIEHQKENISMNKFNEKEKVNQSIAKPNYSRTSTSKLQPLAISRTTTLNSIGYRSLLDGIDENKVQKDLPKRPNGEKDYDTTLSTIETRKNGLIPNPRFSRFSFNGLLNSRFDNPDVTIQNNLVSSGTVVRKSVNQKEPISSRIIEEDPQTSHLKLETGSLKKSSTNLLGLGIVQNHQGKTSRKVSQNSEYCDSNFISVNLSDTADDSQDNTTLEENAISLSHANSVLKDDHANTTVSNTTISKQQEVLNTNVDQRNKRKSSYLGNLEGSKETLVENDKEDKSFQDSIKSMYKDYAKLYNDKKPKSETNTQELGETDDNIPSEKQTRERQSILRDDRINSIDSDNDLSFAADGSSNIDILDSSSIADTNMIENRSEIQLNDNKYSPTITDNQKDFGDEYEDEIDDQFSQHGDQQEYNHEYDHENNHEYNQEDGQEQHEHDHNQQNDQQLQDSDRLQTGTDLRKSTASTQIFSTMNLPKIRDKNSVVEENKEIKHSEVKSEESNQRHNSIFNKLKPKREAPKPPGFKWDDEKSQGHNRFSRISVSSKFDKQQKLNDNYNDSSKSNWFMKFINSLTANSKTPKGEKRKSLIRKFNSDKLDDNETKNFCVLDSTLQSSELTRVIKDTLELKKIEGSVSKVDIDEDFGMISGVIPARYSGGRRLRFKIEIINLKNSSSLHLSKLKGTDKGFKNLTNTVKFIVSKEEQNINRMSSVEA

SEQ ID NO: 33837 - protein, 349 aa, Thermosynechococcus elongatus BP-1
MSNKGSSDLRLLLSTLVISGLVAGLAYWQLSQHWTRSPDQNAGSPLHTPTSKWQKIALAMTLRGHEDEVNAIALSPDGNFLVSAGDDRRLYFWNLATGTALGQAKGHTDWIYALVMTPDGQTVISGSKDKTIKLWGVGDRQLQATLSGHQDFVNGLALSPDGRTLASASYDHTVKLWNVPSRQEITTLKANEGIMLSVAISRDGRFLATGGVDKLIRIWDLPSRRLLRTLEGHTSDVNSLAFTPDSSQLVSGSDKDGIKLWNLTTGELQQQFGTEGGQVFSVAVSPDGSTLASGHGDQTVKLWSLSGQLLRNLKGHSGAVYSVVFGQDQLISASEDKTIKVWRLFPETP

SEQ ID NO: 33838 - protein, 345 aa, Escherichia coli W3110
MGQQKQRNRRWVLASRPHGAPVPENFRLEEDDVATPGEGQVLLRTVYLSLDPYMRGRMSDEPSYSPPVDIGGVMVGGTVSRVVESNHPDYQSGDWVLGYSGWQDYDISSGDDLVKLGDHPQNPSWSLGVLGMPGFTAYMGLLDIGQPKEGETLVVAAATGPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQREMGQWVKEDKIHYREEITDGLENAPQTFIGLLKGKNFGKVVIRVAGDD

SEQ ID NO: 33839 - protein, 128 aa, Fusobacterium nucleatum subsp. nucleatum ATCC 25586
MFKMKKVINTKNAPAALGPYSQAIEANGVLYVSGQIPFVPATMTLVSEDVEEQTKQSLENIGAILKEAGYDFKDVVSATVYIKDMNDFTKINGVYDKYLGEVKPARACVEVARLPKDVKVEIGVIAVK

SEQ ID NO: 33840 - protein, 447 aa, Oryza sativa (indica cultivar-group)
MASEKHFKYVILGGGVAAGYAAREFAKQGVKPGELAIISKEAVLLLTGTIPVLVVAPYERPALSKGYLFPQNAARLPGFHVCVGSGGERLLPEWYSEKGIELILSTEIVKADLASKTLTSAVGATFTYEILIIATGSSVIKLSDFGTQGADSNNILYLREVDDADKLVAAIQAKKGGKAVIVGGGYIGLELSAALKINDFDVTMVFPEPWCMPRLFTADIAAFYESYYTNKGVKIVKGTVAVGFDADANGDVTAVNLKNGSVLEADIVVVGVGGRPLTTLFKGQVAEEKGGIKTDAFFETSVPGVYAVGDVATFPMKMYNELRRVEHVDHARKSAEQAVKAIKGKESGESVVEYDYLPYFYSRSFDLGWQFYGDNVGDTILFGDSDPTSAKPKFGSYWIKDGKVLGAFLEGGSPDENKAIAKVAKTQPPVANIEELKKEGLQFASKI

SEQ ID NO: 33841 - protein, 318 aa, Coprinopsis cinerea okayama7#130
MLSTDTPRPIGTFKTSSDYHYQTMRCNVDLLKIIQVGLTLADEEGHNPPECSTWQFNFKFSLAEDMFAPDSVELLQKSGINFELHEREGILPNDFAELMITSGLVLTDETKWISFHSGYDFGYFVKLLTAQSLPTSEDDFFALLKIWFPTVYDIKFLMRAAKNLKGGLQDVADDLGVMRIGSSHQAGSDSLLTSSTFFKMREIYFNDQIDDAEYSGKLYGLGQTFSLTNGLTDHGRGGATIAERDDRGSSVVRDGSQHGHNGTPGPGSAGAPQTPGMLPLGPMQAGGPMQAAMNQAGYGPLGANGPFGLRSSLVGGGR

SEQ ID NO: 33842 - protein, 1142 aa, Bacillus sp. KSM-1876
MKGKLKKFLVLSMVFILTFSSFGMMGTTQLVEAETKSSIEESEIPENTLRIHYQNSSGDYSNLGVWTWDDVESPTDNWPSGGIPFTEEQVTDYGAYVDVPLESGARNVGFLILDIVTGGKDDAGHNGGDKRLELFSPNINEVWISEGSDEISFIEPVDLPEDTVRVHYKKADGNYENWSLWFWGDVQSPSETQGDFPSGATGFSEEQIGKYGAYIDIPLNEGAEEIGLVVVNKETNEQEADRSFTQLNQFNQIFIVEGDGAVYSNPYGAIATELLSAEQLSDEKIVLYFSRTDELTEEALLEQVGIRDIEEHTVDVNEVEIKTDNRTVEVKGDFNLDQSPYTVSLGEVSVPAKIGWRLIDEMYAYDGELGAQLHQDGTATIKLWSPKAEHVQVILYDKDNPDDIVTEVEMKLGDRGVWEVQLTKENTGLDSLRGYYYHYEIDHDGDKKIALDPYAKSLSAWNSDEQGPYAKAAIVDPSSIGPELEFAHIEGFEKKEDTIIYEVHVRDFTSDPHIADELTAQFGTFASFVDKLDYIEDLGVTHIQLLPVMSYFFANEFKNDERMLDFSSTNTNYNWGYDPQSYFALTGMYSEDPTDPELRIKEFKKLIDEIHSRGMGVVLDVVYNHTARVGIFEDLVPNYYHFMDADGTPRTSFGGGRLGTTHEMSRRILVDSITYWVEEFKIDGFRFDMMGDHDAESIQIAYDKAKEINPNIVMIGEGWITYAGDEDDPNVQAADQHWMQYTESVGVFSDEFRNELKSGFGHEGEPRFLTGGARNIDLIFDNIKAQPHNFIADDPGDVVPYIEAHDNLTLHDVIAMAIQKDPDDHQEEIHQRIRLGNLMTLTSQGIAFLHAGQEYGRTKQFRAETSEPPYKSTYMTDENGEPFRYPYFIHDSYDSTDIINRFDWERATNADAYPIQNLTREYTTGLIELRRSSDAFRLGTKDLVDEKVTQLNIPEIEETDLVVAYRIEATTGEAFYVFVNADDEERTLTLEEDLTVGEFVVDGKTAGVTAIAEPQGVELSAEQIKLDPLTAAIVQVGGIEAPEKPTPPKEEPKEPKEPKEPKEPKEPKDPKDPKDPKDPLDPPGTDDQNGETPKGNEEKKEEQKGDNLPNTATSNYQFIALGIALVLMATAIYWWKRKRQVA

SEQ ID NO: 33843 - protein, 356 aa, Mycosphaerella graminicola
MSRTAQQQQQQGSRKISFNVSEQYDIQDVVGEGAYGVVCSALHKPSGQKVAIKKISPFDHSMFALRTLREMKLLRYFNHENIISILDIQKPKSYETFTEVYLIQELMETDMHRVIRTQELSDDHCQYFIYQTLRALKAMHSANVLHRDLKPSNLLLNANCDLKVCDFGLARSAASTEDNQGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTSDLALDLLEKLLAFNPTKRITVEEALKHPYLEPYHDPEDEPNAEPIPEEFFDFDKNKDNLSKEQLKRLIYEEIMR

SEQ ID NO: 33844 - protein, 250 aa, Salmonella enterica subsp. enterica serovar Paratyphi A str.
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWTDTILPRMKSGERVIIAAHGNSLRALVKYLDNMSEDEILELNIPTGVPLVYEFDENFKPLKHYYLGNADEIAAKAAAVANQGKAK

SEQ ID NO: 33845 - protein, 140 aa, Brassica napus
RASNVVYLRCAAELLEMTEEYGEGNLISQTETFFNQVVLKSWEDSVKALQSCDEVLEYADELNITKKCIESLAMRAFTDPNLFGWPVVEHGGGPMQSPGGSVLWNGISTGARPRQTNSDWWYEDASMLSFPLFQRLITVM

SEQ ID NO: 33846 - protein, 151 aa, Rhodopseudomonas palustris CGA009
MSSESRSASSPVAPDDIEEGVVLRPKFDAHGLVTVVATDARTGDVLMVAFMNGEALDRTIQTGEAWYYSRSRKRLWKKGETSGHIQKVLEMRVDCDQDAVWIKVDQTGGAACHTGRHSCFYRRIDRGGDGAPVLIETDSERKFDPDKVYGK

SEQ ID NO: 33847 - protein, 171 aa, Geobacter sulfurreducens PCA
MDELKNIIRDVPDFPKKGIIFKDITTLLADAPSFQRMVDLIAHRYVGKKISKVVVVEARGFVIGAALAYKLGAGVVLVRKPGKLPSETYSKTYQLEYGSDTLEIHTDAIAKGERVIIADDILATGGTMAAVVDMVEALGGEIVECCFMAELEFLGGRKRLPEGKVYSLLTF

SEQ ID NO: 33848 - protein, 306 aa, Vibrio vulnificus CMCP6
MKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 33849 - protein, 205 aa, Xanthomonas campestris pv. campestris str. ATCC 33913
MYVDYSPSPEARYPVAIHQAYAATKWVAAHGAEIGVDGTRLALVGNSVGGNMAASVALQAKAAGTPAIRYEVLLWPVTDAAFDNGSYQQFQQGYFLSRNMMRWFWDSYTTDPAQRREIYASPLQASVEQLKGLPPTLIQTAELDVLRDEGEAYGRKLDQAGVEVTVIRYNGLIHDYGLLNALSDVPAVRTAIRQAGDALQQHLAK

SEQ ID NO: 33850 - protein, 605 aa, Methylococcus capsulatus str. Bath
MCGIAGLVLKGRNVQADRLHPMIERLAHRGPDGQGVFTEGGFGLAHTRLSIIDLSGGRQPILADDGRLAVVANGEIYNHVELREALEREGRRFATHSDSETILHAYALDPEGFAGRLHGMFAFALYDGVRRRLVLGRDRLGIKPLFYAALPDRLVFASEMKAILPLLPNAPTIDAGAFSQFLHTHCSTGEETLFSGIRRLGPGEILEADAELNLRKRRYWTPLGVRSRALDFAEAEAEFEGMFEQVMKEHVRSDVPYGLFLSGGNDSAILLAMLSRLQAQPVRTFSIGYVDAAMKDELGDAERIAQVFGSRHTSIRLRREDLFRRIPHTVWAADDLMRDYASFPTSALSEAAAKELKVVFTGEGGDEVFGGYRRYRQPRLAWLARNLLAPGTGGFRTRSEWWRKRSQRLFGPALAAERKHFRAPYLKAWSEAPAVWSHLQHCQYTDLVTDLPDSLLVKVDRMMMGFGLEGRVPFLDHRVVEFGLGLPDALKTDGKRPKVFLRRWAERHVPKEHLYTKKRGFTVPVREWLGGELLDRLEGKLSGNAAVREWFDTRHFPALFQAQRKKGNASREIFCLMQFAIWHRLFIDQPGLKPSPDEDPLDWIS

SEQ ID NO: 33851 - protein, 342 aa, Xanthomonas campestris pv. campestris str. ATCC 33913
MTSLTNRRIVLASRPHGEPGTDNFRIEDAPVPPTGHNQILVRNRFLSLDPYMRGRMDEGPSYAAPVAIDAVMEGGTVGEVLESNHPDYHPGELLVLGGGWQTHTVLEPTAPLRKLPKDDALPLSTALGVYGMPGFTAYAGLHEIGKPQAGETLVVAAASGPVGATVAQLARLQGLRVVAIAGGEEKVRYLRDTLRVDVALDHRAEDFAAQLRAATPDGIDVYFENVGGKVFDAVMPQLNDFARIPVCGVVATYNSRGQVAPGPDRLPDFIGQVLRKRLTVRGFIQHDFIRLMPAFLREMGQWLREDKIQYREHVLHGLDSAPQGLISLLRGENFGKAVVALD

SEQ ID NO: 33852 - protein, 439 aa, Debaryomyces hansenii CBS767
MAVTKLFARYVYDSRGNPTVEVDLTTDKGLFRSIVPSGASTGIHEALELRDGDKSKWLGKGVTKAVANVNELIAPAFVKANLDVTNQSAVDDFLNKLDGTPNKSKLGANAILGVSLATAKAAAAEKNVPLYQHLADISGSKQDKFVLPVPFQNVLNGGSHAGGALAFQEFMIVPTDAPTFSEALRMGSEVYHNLKSLTKKKYGQSAGNVGDEGGVAPDIGSPREALDLIMDAIDKAGYKGKIGIALDVAASEFYKDGKYDLDFKNPNSDESKWLSGEQLASLYEELINEYPIVSIEDPFGEDDWDAWVHFYSKVSSKVQIVGDDLTVTNPLRIKTAIEKKAANALLLKVNQIGSLTESIKAAQDSFDATWGVMVSHRSGETEDTFIADLSVGLRAGQIKTGAPARSERLAKLNQILRIEEELGDKAIYAGKNFHAASQL

SEQ ID NO: 33853 - protein, 353 aa, Thermosynechococcus elongatus BP-1
MVRILAIETSCDETAAAVVRDRAIESNVIASQVCAHQPFGGVVPEVASRAHLENINGVITAAISEAGCDWSAIDAIAVTCAPGLVGSLLIGVTAAKTLALVHQKPLLGIHHLEGHLYASYLAEPTLEPPFLCLLVSGGHTSLIGVYGCGEYQLFGQTRDDAAGEAYDKVARLMGLGYPGGPLLDRWAQQGNPEAFDLPEGNIRLPDGKVHPYDASFSGLKTAVARLVAELRQTHPELPVADLAASFQKAVAQALTKRAIAAAVDHGFKTLAIGGGVAANSGLRQHLTAAAEPLGLRLIFPPLRLCTDNAAMIGCAAADHFQRGDRSPLDLTARSRLSLLEISALYGPTPLAVS

SEQ ID NO: 33854 - protein, 478 aa, Rhodococcus sp. RHA1
MRERYETFVGGHDERSKSGQYFSTRDPATGDVIAEVALGGAEDIEAAVAVAQSAFRSWRDTPAATRGRILLEVARTLREHADELARIETLDTGQTLSQSNVDIETAARYFEYYGGAADKVHGETIPLGPDYLSYTRNEPFGVIGVVTPWNAPINQAARAIAPALAMGNVVVLKPAEDTPLSALEMSRLAVEAGLPAGVLNVVPGFGADAGAALTGHDKVRKIVFTGSVETGRAIMRAAAQRLIPLTLELGGKSPNIVFDDADLDAAATGAWTAFTTKAGQVCSAGSRLLVHSSVHDELVGRLVQHAKTTVIAPGIEDPDIGSLATRGQFDKVRSYLELGPSEGARVATGGHVADTGRLGRGLFIEPTIFVDVDNTMRVAREEIFGPVLTVLRFDSDEEAVEIANDSDYGLVAGVWTRDHGRAHRVAGAIEAGQVFINQYFAGGVETPFGGYKLSGFGREKGFEALKHYCQLKTITARL

SEQ ID NO: 33855 - protein, 290 aa, Morus alba
NWGFFELVNHGIPHEFLDTVEKMTKDHYRKCMEQRFKELVASKGLEAVQAEVNDMDWESTFFLRHLPVSNISEIPDLDDEYRKVMREFAKQLEKLAEELLDLLCENLGLEKGYLKKAFYGSKGPTFGTKVSNYPPCPKPDLIKGLRAHTDAGGIILLFQDDKVSGLQLLKDGHWIDVPPMRHSIVINLGDQLEVITNGKYKSVLHRVIAQTDGTRMSIASFYNPGSDAVIYPEPTLVEKEAEEKNQVYPKFVFEDYMKLYAGLKFQAKEPRFEAMKAVETSVTLGPIATA

SEQ ID NO: 33856 - protein, 128 aa, Pseudomonas syringae pv. tomato str. DC3000
MTITRYGAGSTAGGGQPRPFARAVEADGWLHVSGQVPALDGEIIVGGIVEQTHQTMRNLIAILEEAGYDIKDVVRVGVWLEDPRDFWSFNKVFGEYFSPEHAPARACVQASMMVDCKVEIDCIAYKRK

SEQ ID NO: 33857 - protein, 334 aa, Morus alba
DNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGS

SEQ ID NO: 33858 - protein, 125 aa, Geobacter sulfurreducens PCA
MITIDFQKMGGLIPAIIQDHATNEVLMVAFMDEKTLNLTLESGKTWFFSRSRNKYWMKGEESGNTQEVVEVLTDCDADAVVIKVKQNGPAACHTGNRSCFYVRWEDGQWVEHSEPLFDPAEVYKK

SEQ ID NO: 33859 - protein, 191 aa, Brassica napus
MVLWEITLGTAYFLGLRRTYRLALKIQRRIVSPKHPKIRQFLHRRTRKIFDVAVSVHKNIQHRDIEVGRNLGNWILRWLDRMKPAAQIRTRPEPNSNVDKAKRLSESNTTQSPPKRDSDRHLFSSLNHFQHRPFPTVSTMIQPPSRPNGITTQYRHYSAGAAASLIPPSYVRGSGFDGVIRKDILQWMFQR

SEQ ID NO: 33860 - protein, 511 aa, Gossypium hirsutum
MMAVLFVYLGFMVFGIIVLRFLYRFIDNNGLPRNWPFVGMIPTLLLNIHRPHDKVAQVLRRSNGTFFYRGLWFTNTSFLATSDPENVRYILSSNSSVYLKGPEWLKQFDIFGEALFNSDGEAWKCHRRVFHAFLNHPQYRQSLSKVLHQRIEEALVKVLEYVSGREMVVNLQDLLAGHAFDIGCITGVGFDPGLLSIEFPENRFQKAMSDTLEAAFYRYVVPDSLWKLQSWPQIGKGKKRSDAWKALDDLLTQFISTQRHKSTKSVASSGSNEEHDFNFLNCYLTGHEITGPTPKESLIRDNLIHFLFASDGTYSLTLTWFFYLISKAPVVENKIREEIKRHLSMKQVEGSLQIPSNYDELSKLTYLHAALCETLRLYPPIPFDFRTCTKQEYLPSGHRVDQNTRIIIGIHAMGRMESLWGEDCYAFKPERWIGEDGKIKRESPTKFSAFLAGPRICPGKEVSFLLMKATATAIIHNYNVHVVEGQNIGPKNSVVYQMKKGLMVRIKKRWS

SEQ ID NO: 33861 - protein, 254 aa, Arabidopsis thaliana
MATTMKGLLKGLRYITQIFDEEKEQEMQIGFPTDVKHVAHIGSDGPTNTTPSWVRSYVHLYVFSYMSHMNDFKTQEHEKGQVVSRGNSNKYNPQGTNLDWFEELMCISIGTNQRGAGLKELLPSNTNEKPKQKTRRKPGGAASPNHNGSPPRKSSGNAASSDEPSKHSRHNRSAHGSTDSSNDQEPSVRRRRGGIPAPDTEVPNQIPDGSAPPRKATSRPRKLKGSSAGGEGSIKKSSKGKPENSVDTTCNDII

SEQ ID NO: 33862 - protein, 525 aa, Pseudoalteromonas tunicata D2
MSKNIHDSRVLILDFGSQYTQLIARRIREIGVYCELWAWDVTEEQIREFAPDGIILSGGPESTTEDNSPRAPEYVFNAGVPVLGICYGMQTMAMQLGGLVQSSDKREFGYAKVAKLGQCKLFDAIEDHVADNGQGILDVWMSHGDKVIEIPASFTTTAQTETCPHAAMADEAKRFYGVQFHPEVTHTQQGQRLLERFVVDICGCEKLWTPATIIEDAIERIKEKVGDDEVILGLSGGVDSSVVAMLLHRAIGSKLTCVFVDNGLLRLNEGQQVMDMFGDHFGLNIIKVDAEAQFLADLAGLSDPEAKRKAIGHTFIDIFDAESKKLKNAKWLGQGTIYPDVIESAASATGKAHVIKSHHNVGGLPDDMEMGLVEPLRELFKDEVRKIGLELGLPYDMLYRHPFPGPGLGVRVLGEIKKEYCDLLRRADAIFIEELHKADLYNKVSQAFTVFLPVKSVGVMGDARKYDWVVSLRCVETIDFMTARWSHLPYDFLGLVSNRIINEIDGISRVVYDISGKPPATIEWE

SEQ ID NO: 33863 - protein, 523 aa, Candida maltosa
MAIEQIIEEVLPYLTKWYTILFGAAVTYFLSIALRNKFYEYKLKCENPVYFEDAGLFGIPALIDIIKVRKAGQLADYTDTTFDKYPNLSSYMTVAGVLKIVFTVDPENIKAVLATQFNDFALGARHAHFDPLLGDGIFTLDGEGWKLSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 33864 - protein, 538 aa, Candida maltosa
MSVSFVHNVLEVVTPYVEYYQENLTKWYILIPTILLTLPFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMVPSTKNIAGREEFADAFNYSQTYNAYRFLLQQFYWILNGSKFNKSIKTVHKFADFYVQKALSLTDDDLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTISATHRDPSIYGEDANVFRPERWFEPETRKLGWAYVPFNGGPRICLGQQFALTEASYVTVRLLQEFHTLTQDANTRYPPRLQNSLTVSLCDGANIQMY

SEQ ID NO: 33865 - protein, 523 aa, Candida maltosa
MAIEQIIEEVLPYLTKWYTILFGAAFTYFLSIALRNKYYEYKLKCENPPYFKTAGFVGIPGLIDVIKAKNAGKLADYADQTFDEYPHHSFYMTVAGMLKIVLTVDPENIKAVLATQFNDFALGARHAHFDPLLGDGIFTLDGEGWKHSRAMLRPQFAREQIAHVKALEPHVQVLAKQIKLNKGETFDLQELFFRFTVDTATEFLFGESVHSLYDEKLGVPPPNNIPGRENFAKAFNTSQHYLATRTYSQMFYFLTNPKEFRDCNAKVHKLAQYFVNKALDASEDEVAEKSKGGYVFLYELVKQTRDPKVLQDQLLNIMVAGRDTTAGLLSFAMFELARNPKIWNKLREEIEVNFGLGEEARVDEISFETLKKCEYLKAVLNETLRMYPSVPVNFRTATRDTTLPRGGGKDGTSPIFVPKGSSVVYTVYKTHRLEEYYGKDAYEFRPERWFEPSTRKLGWAYVPFNGGPRICLGQQFALTEASYVITRLAQMFEHLESKDETYPPNKCIHLTMNHNEGVFISAK

SEQ ID NO: 33866 - protein, 168 aa, Triticum aestivum
MAPTVMASSATSVDPFQGLKSTAGLPVSRRSNGASLGSVSNGGRIRCMQVWPIEGIKKCETLSYLPPLSTEALLKQVDYLIRSKWVPCLEFSKVGFIFREHNASPGYYDGRYWTMWKLPMFGCTDATQVINEVEEVNKEYPDAYVRIIGFDNMRQVQCVSFIAFKPPG

SEQ ID NO: 33867 - protein, 487 aa, Vitis vinifera
RFFIRSLLPKPSRKLPPGPRGWPLLGALPLLGNMPHVALAKMAKRYGPVMFLKMGTNCMVVASTPEAARAFLKTLDINVSNRPPNAGATHLAYDAQDMVFADYGPRWKLLRKLSNLHMLGGKALEDWSQVRTVELGHMLRAMLELSQREEPVVVPEMLSFSVANMIGQVILSRRVFETKGSESNEFKDMVVELMTTAGYFNIGDFIPSIAWLDIQGIERGMKHLHKKFDKLLTRMIEEHTASAHERKGNPDFLDVVMGYQGNSTGEKLTLTNIKALLLNLFTAGTDTSSSVIEWSLAEMLKNPSILKRVHEEMDQVIGRSRRLVESDLPKLPYLQAICKESFRKHPSTPLNLPRVSAQACEVNGYYIPKNTRLSVNIWAIGRDPDVWESPEEFRPERFLSGRNAKIDPRGNDFELIPFGAGRRICAGTRMGIVLVEYILGSLVHSFDWKMPDGVEINMDEAFGLALQKAVSLSAMVTPRLHQSAYAV

SEQ ID NO: 33868 - protein, 487 aa, Vitis vinifera
RFFIRSLLPKPSRKLPPGPRGWPLLGALPLLGNMPHVALAKMAKRYGPVMFLKMGTNSMVVASTPEAARAFLKTLDINFSNRPPNAGATLLAYHAQDMVFADYGARWKLLRKLSNLHMLGGKALEDWSQVRAVELGHMLRAMLELSQRAEPVVVPEMLTFSMANMIGQVILSRRVFETKGSESNEFKDMVVELMTTAGYFNIGDFIPSIAWLDIQGIQRGMKHLHRKFDRLLTKMMEEHTASAHERKGNPDFLDVIMANQENSTGEKLTITNIKALLLNLFTAGTDTSSSVIEWSLAEMLKNPSILKRVHEEMDQVIGRSRRLVESDLPKLPYLQAICKESFRKHPSTPLNLPRVSTQACEVNGYYIPENTRLSVNIWAIGRDPDVWESPEEFRPERFLSGRNEKIDPRGNDFELIPFGAGRRICAGTRMGIVLVEYILGTLVHSFDWKMPDGVEINMDEAFGLALQKAVSLSAMVTPRLHQSAYAV

SEQ ID NO: 33869 - protein, 119 aa, Xanthomonas campestris pv. campestris str. ATCC 33913
MATAHAGGGMSTLSTHVLDTAAGRPAAGVTLRLFAGDTLCLEAATDADGRCPALATLHLARGRYRLEFDVAGYWQASGTALADPPFLEMVPIVFNLGEHGHYHVPLLLSPYGYSTYRGS

SEQ ID NO: 33870 - protein, 445 aa, Corynebacterium glutamicum ATCC 13032
MATVENFNELPAHVWPRNAVRQEDGVVTVAGVPLPDLAEEYGTPLFVVDEDDFRSRCRDMATAFGGPGNVHYASKAFLTKTIARWVDEEGLALDIASINELGIALAAGFPASRITAHGNNKGVEFLRALVQNGVGHVVLDSAQELELLDYVAAGEGKIQDVLIRVKPGIEAHTHEFIATSHEDQKFGFSLASGSAFEAAKAANNAENLNLVGLHCHVGSQVFDAEGFKLAAERVLGLYSQIHSELGVALPELDLGGGYGIAYTAAEEPLNVAEVASDLLTAVGKMAAELGIDAPTVLVEPGRAIAGPSTVTIYEVGTTKDVHVDDDKTRRYIAVDGGMSDNIRPALYGSEYDARVVSRFAEGDPVSTRIVGSHCESGDILINDEIYPSDITSGDFLALAATGAYCYAMSSRYNAFTRPAVVSVRAGSSRLMLRRETLDDILSLEA

SEQ ID NO: 33871 - protein, 471 aa, Persea americana
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGI

SEQ ID NO: 33872 - protein, 407 aa, Yersinia pestis CO92
MSSVDINVPDLPESVADGSVATWHKKPGDSVKRDEVLVEIETDKVILEVPASQDGILDAILEDEGATVTSRQVLGRIRPSDSSGKPTEEKSQSTESTPAQRQTASLEEESNETLSPAIRRLIAEHDLDATAIKGSGVGGRITREDVDSHLASRKSASAVVADAKAVAAAAPVLAGRSEKRVPMSRLRKRVAERLLEAKNSTAMLTTFNEINMQPIMDLRKQYGEAFEKRHGVRLGFMSFYIKAVVEALKRYPEVNASIDGEDVVYHNYFDVSIAVSTPRGLVTPVLRDVDTLSMADIEKKIKELAVKGRDGKLKVEELTGGNFTITNGGVFGSLMSTPIINPPQSAILGMHAIKDRPMAVNGQVVILPMMYLALSYDHRLIDGRESVGYLVTVKEMLEDPARLLLDV

SEQ ID NO: 33873 - protein, 121 aa, Triticum aestivum
MNARGFRSTRTALFDGIEEGGIRASAYSSHEIDEHENERAVDGLQDRVSILKRISGDINEEVEAHNRMLDRMGNDMDSSRGFLSGTVDKFKTVFETKSSRRMGTLVASFVALFMLVYYLTR

SEQ ID NO: 33874 - protein, 529 aa, Leifsonia xyli subsp. xyli str. CTCB07
MSDGSSFYITTPIFYVNDVPHIGHAYTEVAADVLARWRRQAGDDTWLLTGTDEHGQKILRTATANGTTPKEWADRLVRDEWLPLLTTVDIANDDFIRTTDERHEKNVQKFLQKLYDDGFIYAGEYEALYCVGCEEFKPQSEIVDGTGEYADQKVCAIHSKPLELLQEKNYFFRMSDFAEKLLALYEERPDFVQPESARNEVVSFVRQGLSDLSISRSSFDWGIKVPWDESHVVYVWFDALLNYITAVGYGQDEEAFERRWPATHLVGKDILRFHAVIWPAMLLAAGLEVPHRVFGHGWLLVGGEKMSKSKLTGIAPTQITDTFGSDAFRYYFLRAINFGQDGSFSWEDLSARYQAELANGFGNLASRVVAMVMRYFGGEVPAAGEFREADLEVQRVVAQAAADADAAMARLAIHDGIAAVWTIVDQLNGYITEQEPWALAKDEAKRERLQTVLYTAVEGLRALAVLLSPVIPKATAALWTALGVEGELGGLDAQRLRSAGDWGQVPAGTAVNGLEALFPRIETDTALGA

SEQ ID NO: 33875 - protein, 191 aa, Debaryomyces hansenii CBS767
MQTIKCVVVGDGAVGKTCLLISYTTSKFPADYVPTVFDNYAVTVMIGDEPFTLGLFDTAGQEDYDRLRPLSYPSTDVFLVCFSVISPASFENVKEKWFPEVHHHCPGVPCLIVGTQTDLRNDDVILQRLQRQKLTPISNDMGEKLAKELRAVKYVECSALTQRGLKTVFDEAIVAALEPPVIKKSKKCTIL

SEQ ID NO: 33876 - protein, 155 aa, Zea mays
  misc_feature (4)..(4): Xaa can be any naturally occurring amino acid
AVIXRRKTESGEPSFMAEKAMAKSAHKLAFITGNDKYVTTGVEGSIPVLIKSGNWIDTAEEIDDLFLGDAEVWRRPSFGTAGPLGGYHPLVTKDGHHVLDVIFTTPIQDLGQVAEKLDKVDGVVDHGIICSNQPYAVIASKGEVQVLDEKSSVIH

SEQ ID NO: 33877 - protein, 268 aa, Coprinopsis cinerea okayama7#130
MKIDIHKTANYKGYTALLAENTDVTGNGDLHEGFDIGWEAKDLASGGAVTEDRCGEAGNGAGGAMQGGNVWPEGLPGFKEAVLEYYHAAFALGQALFPLFALALELPERWFDDKTTNPAAIMRLLHYPPQDPTKLNEKEIGIGAHTDYECFTILWQDPCGGLQVQNTSGKWVDAVPIPGTVVVNLGDQFARWTNDVFKSTPHRVINRSGRERYSIPLFFGTDYNVLLEPIETCVYPDSPPHYEVMTAGDYVKSRLDATYAHSAPASNI

SEQ ID NO: 33878 - protein, 273 aa, Aspergillus nidulans FGSC A4
MAELIEKAKRAAGKAAVENHYPKDAKFVGIGSGSTIVYVVEAIKELGIDTSGTCYVPTGFQSKQLIVSAGLTAVDFDAIPEGTVLDIAFDGADEVDDELNLIKGGGACLFQEKIVALQAKEFICVADSRKLQSRLLSNWKYIPIEVAPIAAKRVLPALRQLGSINPVLRPQTGSKLGPLKTDQDFYIIDAPFPTLLTKADVAAGKDGSGKDGIWEVDALSLAIKQIPGVLDVGIFSGVTGPQAQALGGIGGQKPVAAYFGMPDGSVQVRKADA

SEQ ID NO: 33879 - protein, 232 aa, Rosa hybrid cultivar
EWGVMHLVNHGISDELMERVKKAGQAFFDLPIEQKEKYANDQASGKIQGYGSKLANNASGQLEWEDYFFHCVYPEDKRDLSIWPQTPSDYIVATSEYAKELRGLATKILTVLSLGLGLEEGRLEKEVGGLEELVLQMKINYYPKCPQPELALGVEAHTDISALTFILHNMVPGLQLFYGGKWVTAKCVPNSIVMHIGDTLEILSNGKYKSILHRGLVNKEKVRISWAVFCEP

SEQ ID NO: 33880 - protein, 327 aa, Acidovorax sp. JS42
MAANSPSTAATLALIADDMREVDKVIAARLQSSVPLVGSVAQYIISAGGKRLRPALLLLTCGALEYKGEQRFNLAAVVEFIHTATLLHDDVVDESTLRRGRPTANETFGNPASVLVGDFLHTRSFQMMVEAGSMRILQVLADATNVIAEGEVQQLMNTHDASLDEAGYLHVIRSKTAKLFEASARLAAILAGSTPDIEQACADYGQALGTAFQVIDDVLDYDGDAQEMGKNLGDDLREGKVTLPLIIAMQRGSQAQRELLRNVIETGSADELQPVIAIIRETGALTATRDAAAAQARLAMDAAAKLPANPYTKGLLQLAAQLLERRT

SEQ ID NO: 33881 - protein, 338 aa, Rhodococcus sp. RHA1
MKIAVIPGDGIGPEVIDQAVRTLHEVAPTIDTSYFDLGARNFRETGRLLAPETLDEIRHHDAILLGAIGDPTVPAGTLERGILLEMRFALDHHINPRPTKTMPGAPRVLAGDVNVDLLVVREGTEGPYTGNGGALRVGTPHEVATEVSVNTRFGVDRLLREAFERATVRRQRLTIVHKPNVLAFAGSLWTRAADDLSALYPDVEVDHMLVDAAMLHLVTNPARFDVIATDNLFGDLITDLTSALGGGVGLAASANIDGSRRNPGMFEPVHGSAPDIAGRGVADPTAAILSVALMLHHLGRSPEANAIDQAVQDHVATRGPESCSTEEIGEQIRSRVGS

SEQ ID NO: 33882 - protein, 494 aa, Vibrio angustum S14
MITHDIPLLLYTSEQIRQGEQLLTEQQNSVTLYHLMERAGEATFDLMRQLYPECKKLLVCCGKGNNGGDGYVVARLAHEQGVDVTVWELPTVEHLPTDARCARSYWLQCNGKTITDTPTTSYELIIDALLGIGIKGQVRSEMADRIRWINHQMTPVIAVDVPSGLCADTGATFGDVIKASQTLSFIGFKQGLTTGQAAQYCGERYFSDLGVALQFSQVMKPSALHITESQVQSLLLPRSRVAHKGCFGRVLCIGGDLGMAGAIRLSSEACARAGAGLTSVITRPDNALSIVMMRPEIMAIGWQESSNILIDKLAWSDVVVLGPGLGTSDWGQSLFAQCHHVDKPCVVDADGLNLLAKVPDYRDNRIITPHPGEAARLLNVSIDEIEADRFAAIQRLQQNYGGVVVLKGAGSLIYDGKTLWICTCGNPGMATGGMGDVLSGIIGALLGQGLALVEAAYAGVWIHSRAADLCAQSGERGMLASDLFPFIRQLVNPR

SEQ ID NO: 33883 - protein, 236 aa, Lactobacillus sanfranciscensis
DSFALAVDPEIFNLGLPILGICYGMQLMAKDLKGGEIVTADNSEYGQAQIEVTDKDSKFFKGMNDKQTVLMSHGDFVTKVPDGFEITATSGSCPISAMADPKRGFYAVQFHPEVNLTEEGREMLHHFVFDIAGAEANWSMDDFIEDAIANIKETVGDKKVLLGLSGGVDSSVVAVLLHRAIGDQLISVFVDHGLLRKNEAQQVLKALGDDFGLNIDFVDASELFLGKLKGVTDPET

SEQ ID NO: 33884 - protein, 255 aa, Cynodon dactylon
AIDWIWKVIEHYNFAPLTAVLSVNYLDRFLSTYEFPEGQAWMTQLLAVACLSLASKVEETFVPLPLDLQVAEAKFVFEGRTIKRMELLVLSTLKWRMQAVTACSFIDYFLHKLNDHGAPSMLARSRAADLILSTAKGAEFLVFRPTEIAASIALAAMGELRSSVLERAATGCKYLNKDNVSRCYGMIQEKITLGNIALKSAGSSLSSVPQSPIGVLDAGACLSQQSDDATVGSSPATCYHSSSTSKRRRISSRLI

SEQ ID NO: 33885 - protein, 431 aa, Brassica napus
MTTCGLWTPPSFSPRRRLCNFSSSRRSPLSVIRFDEERVSRRVFCSDNQENTNKDRPQPSGIQVYGEIERLLTETVKQSQSSFAGTADWSEVEGAWVLRPRNSNPKMVAHFIGGIFVGAAPQLTYRLFLERLAEKDVLVIATPYASGFDHFAIADEVQFKFDRCCRSLHESVQDLPSFGIGHSLGSLIHLLIGSRYAVQRNGNVFMAFNNKEASLAIPLFSPVLVPMAQSLGPLLSQVATSPTVRLGAEMTRKQLETLSPPIMKQILPLVEQLPPLYMDLVKGREDFIPKPEETRRLIRSYYGISRNLLIKFEDDSIDETPILAQVLGVESSISSKLDMSIRTLPGDHGLPLQQALPDVPPAMADAVNRGSEFLANMAVGTPWESVAKEVGGTLGMDSKILRAYTSKDLAQLVDAITSWMASNMGPKLLRS

SEQ ID NO: 33886 - protein, 142 aa, Rhodopseudomonas palustris CGA009
MTVRAILETKGRYIHTVEAEARLASAVKTLAERRIGAVLVMHGTRLEGILSERDVVRVLADRGPAALDEPIGAVMTRDVFTCRQDDTVGEIMERMTAGKFRHLPVMEHDRVVGLISIGDIVKSRLSEYEHEQQALHDYIKSA

SEQ ID NO: 33887 - protein, 291 aa, Listeria monocytogenes EGD-e
MTNKITERITGHTELIGLIATPIRHSLSPTMHNEAFAKLGLDYVYLAFEVGDKELKDVVQGFRAMNLRGWNVSMPNKTNIHKYLDKLSPAAELVGAVNTVVNDDGVLTGHITDGTGYMRALKEAGHDIIGKKMTICGAGGAATAICIQAALDGVKEISIFNRKDDFYANAEKTVEKINSKTDCKAQLFDIEDHEQLRKEIAESVIFTNATGVGMKPFEGETLLPSADMLRPELIVSDVVYKPTKTRLLEIAEEQGCQTLNGLGMMLWQGAKAFEIWTHKEMPVDYIKEILF

SEQ ID NO: 33888 - protein, 252 aa, Listeria monocytogenes EGD-e
MNKVVVKNVTFGEGAPKICVPMVGKTVAALKEEAEMLQTIDLDVVEWRVDFFEDVKDLAKVEAALGEIRAILPETPILFTFRSAKEGGELAVSDEFYFELNETLAGTGKIDLVDVELFNEEADVLRLIETAHKNNVKVVMSNHDFDKTPAKEEIVSRLTRMEALGADLPKIAVMPKSAGDVLTLLDATNTVFEKANQPIITMSMAGTGVISRLAGEVFGSAMTFGAAKKASAPGQIDVNELRHVLDLLHKQF

SEQ ID NO: 33889 - protein, 161 aa, Cichorium intybus x Cichorium endivia
MGFSEKQEALVKESWEVMKQDIPALSLYLYAMILEIAPEARGLFSFLKDTNVIPQNNPKLKSHAVKVFKMVCESAIQLREKGEVVVSGSTLKYLGSVHLEKGIVDPQFEVVKEALIRTVAKAMGEKCSEEMKSAWSEAYDELADAIKTEMKKEAAETQTHI

SEQ ID NO: 33890 - protein, 793 aa, Thermococcus kodakarensis KOD1
MSEYRFIKWFEELGKEDVPLVGGKGANLGELTKAGIPVPPGFCVTAEAYKYFVENVKLEDGKTLQEWIMEIISQTNVDDSKQLQENTAKIRQKIIELPMLPEIAEEIERAYKELSARFNKDAVYVAVRSSATAEDLPEASFAGQQETYLDVYGVDDVIDKVKKCWASLWTARATFYRAKQGFDHSKVYLSAVVQKMVNSEKSGVMFTANPVTNNRNEIMINASWGLGEAVVSGSVTPDEYIVEKGTWKIKEKFIAKKEVMVVRNPETGKGTVYVKVADYLGPEWVEKQVLTDEQIIEVAKMGAKIEEHYGWPQDIEWAYDKDDGKLYIVQSRPITTLKEETKAEEVEGTEEAEVILKGLGASPGIGAGRVVVIFDASEIDKVKEGDVLVTTMTNPDMVPAMKRASAIVTDEGGRTSHAAIVSRELGIPAVVGTKEATKKLKTGDYVTVDGTRGVVYKGIVKSLVEKKEEKAAGAAGGQVVVAGAPLITATKVKVNVSMPEVAERAAATGADGVGLLRAEHMILSIGQHPIKFIKEGKFDELVEKLADGIRTVAAAFYPRPVWYRTLDAPTNEFKEMPGGEDEPDERNPMLGWRGIRRGLDQPELLKAEFTAIKKVVEEGYNNIGVMLPLVGHPEQIRKAKEIARSVGLEPHKDVEWGIMIEVPAAALIIEDLIKEGIDFVSFGTNDLTQYTLAIDRDNDRIAHLYDETHPAVLKLIKHVIKVAKKHGVETSICGQAGSDPKMAKILVRLGIDSISANPDAVELIRKTVAQEEQKILLEAARKRLFEEEDELEF

SEQ ID NO: 33891 - protein, 109 aa, Acidovorax sp. JS42
MSDVQQRIDQLVKTNDILLFMKGNASFPMCGFSGRAVQILKACGVDPKNIATVNVLDDQEIRQGIKDYSHWPTIPQLYVKGEFIGGSDIMMEMYESGELQQVLGTGDAA

SEQ ID NO: 33892 - protein, 560 aa, Rhodococcus sp. RHA1
MTTPKTRSVQAKAPRTEGQWAQGDREPLNVNEQVKQDDDGLNVRKRIEEVYCRTGVAGIDPTDRRSRFRWWGLYTQRAPGIEGGRTATLPPEELEDEHFMLRIRIDGGALTTEQLRVVGEVSRLFARDTADLTDRQNIQLHWIRVEDLPEIWRRLEGVGLTTAESAGDTPRVVLGSPMAGIAVDEVLDATPALHEITRRLIANPDYSNLPRKFKTAISGLQDVVHEINDVAFIGVDHPDHGPGLDVWVGGGLSTNPRIGERLGAWVPLEDVPDVWIGIVSLFRDYGYRRLRAKARLKFLVSDWGVEKFRDVLEKEYLGRAMLDGPAPEPLDEPRDHVGIQRQKNGLNAVGIAPVVGRVGGTVLTDLARAAEASGSRRVRITPMQKLVILDVEDDSIDSLQADLEKLGFPARPSPWRRSTMACTGIEFCKFGIVETKARAATLIADVEKRLADVQDQLEHPITVHLNGCPNSCARIQVADIGLKGMIVTDVDSNQVEGFQVHLGGGLGLDTSFGRKLRGHKLPATEVPDYVERIVRRYVAGREGSEKFATWVQRATEADLA

SEQ ID NO: 33893 - protein, 215 aa, Glycine max
  misc_feature (174)..(174): Xaa can be any naturally occurring amino acid
MDSDSWISTRMSSSSRRYHSRSDLYVEESEGSDDFRAEFLCPFCAEDYDVVSLCCHIDDHHPIQAKNGVCPICGKKVGLDLVGHITTQHGNFLRVQRKRRVRKVGSGSTMSILRKELREGALHSLLGGSSYLASSNSEPDPLLSSFMVNPVVADESVSATPPSTEDALVKESSXDDFLKSLPQQLQLSEEDQVEKARRFEFVQGLLMSTILDDKL

SEQ ID NO: 33894 - protein, 443 aa, Myxococcus xanthus DK 1622
MKRADIVGLDKAHVWHPYTAMEAYIAETDPLVVVRSEGAYLHDADGTRYLDANGSWWVSTLGHRHPRLMRALAEQAAALPHVSLAGITHEPAALLASELAAIAPGSDRPGLPSSERLSRVFYSDNGSTAVEVAIKMAAQYWAQNGQPRRTRFITLSGAFHGETMGATSVGGVPLFREVFGPLLFDVVHVPSPAEEGGWARAFEQVQSTLRAHPEVIAGVILEPVLQGAAGMVMYSPDFVRAVREATSEVDTFLIADEVFTGLGRTGARFAVDLAGVVPDMLCLAKALSGGILPFGATLASERVFSGFLGASNRALYYGHSYCGNPLGAAIAREVLAVYRDEDVMGQVARKAPRVKAAFERMAASIPGLVRPRAVGMVGAVDLGGGGYLARGGWRVYEAARRRGLYLRPMGDTVYIAPALTISDEALEELLSGVEASLQEVAGG

SEQ ID NO: 33895 - protein, 605 aa, Burkholderia mallei ATCC 23344
MYRYTEFDKAFVRNRAAQFRDQLERWRQGALSEDAFRPLRLQNGWYVQRHAPMLRVAVPYGELSSAQIRMLARIARDYDVPEPARYRAACDAQARLGTVRLPTRNAHFTTRTNVQFNWIPLEKAADVMDLLATVDMHGIQTSGNCIRNISCDERASVAPDEIADPRPFAEVMRQWTTLHPEFAFLPRKFKIAITGAADDRAATDWHDVGLRLVRDAAGELGFRVSVGGGMGRTPMTATLVRAFVPWRHVMNYIEAIVRVYNRYGRRDNRYKARIKILVKAEGQRYIDDVDEEFRQIVEHDGGPHTIEQAEFDRVCASFVPPVPPPCAAGRHAKTDIDADMDAALARMRTLAGAQPAFARWLERNVAPHRDPARRIVTLSFKRRHQAPGDASPEQLDALAHLAERFSAGEARVTHAQNVVLPWVRAIDLHALWEAARDAGLASANVRLLTDMIACPGGDFCALANARSIPIADAIAERFDDLDELHDIGDVDLHVSGCINSCGHHHSGHIGILGVDKDGDEWYQVTLGGSDGTAANGPAQPGKVIGPSFSADEIVDVVDALVATYLRVRRTEAGRVERFIDAYRRVGPEPFKAAANAARHPETSVA

SEQ ID NO: 33896 - protein, 585 aa, Corynebacterium glutamicum ATCC 13032
MSHAPAIVDCMLSTMQDVPLSLTRILEYGSTVHGDTLITTWGGADGIEQAQQTFSAVGARAAALAHALHDSLGITGDQRVASMLYNCAEHMETMFAVACMGAVFNPLNKQLMNDQIVFILNHSEAEVVIADPRMAEQLGEILKETPKVRAVVFIGPNDFSSAAAHMPEGMKLYSYEALLDGRSTVYNWPEQDERTAAAICYSTGTSGPPKGVVYSHRSLYLQSLSLRTTDSLAVEHGETFLCCVPIYHVLSWGVPIAAFMSGTPLVLPGPDLSAPTLAKIISTTLPRVAHGVPTLWIQLMVHYLKNPPERMSLRELYVGGSAVPPIVITMWEQRYGVDVVHVWGMTETSTVGTVSRPPSGVSGESRWNYRVSQGRFPASLQYRIVNDGQVMASTDRNEGEIQVRGPWVTASYFHPDVEKEGGTASTFRDHDVEEENDELFTADGWLRTGDVGSVTSDGFLTIQDRARDVIRSGGEWIYSAQLENLIVATEEVVECAVIGFPDDKWVERPLAVTMLYPGIERTRETAERLRDQLRDRLPNWMLPEYWTFVDEVDKTSVGKYDKKDLRNHLRNGDFEVIKLKGPGEK

SEQ ID NO: 33897 - protein, 250 aa, Yersinia pestis CO92
MAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 33898 - protein, 511 aa, Campylobacter jejuni RM1221
MKKADILVLDFGSQYTQLIARRLREQGVYAEILPFNVSLTDIKAKEPKGIILSGGPASVYATDAYFCDKGIFDLNLPILGICYGMQLMAHHYKATVAPAGHKEYGKANIEIKKDNALFKNLPKKQTVWMSHSDKVENLPQGFEVLATSENSPFCVFGNEDKKFFALQFHPEVQHSEFGKNILKNFAKYACNCESVWNMGSFAKTQAEKIREEVGNDKVLCAVSGGVDSSVVAALLASAIKEQVIVVFVDNGLLRSREKEQVEFMFKNTLGIDLISIDASEIFLSRLANVTDPEQKRKIIGNTFIEVFEEEAKKHKDVKYLAQGTLYTDIIESSVVGASKTIKSHHNVGGLPEKMNLKLIEPLKEIFKDEVRALGLELGLSKEVVYRHPFPGPGLAIRIMGEVNRPGLELLRKADVILLEELKSTGWYDKTWQAFCVLLNVKSVGVMGDNRTYDNAVCIRVVDASDGMTATFSHLPYEVLENISRRIINEVEGINRVVYDISSKPPATIEWE

SEQ ID NO: 33899 - protein, 200 aa, Listeria monocytogenes EGD-e
MDKQAILNNIHQTWQEEANAISRLPEVTSEEALVKTVEKIAECTGKIVVAGCGTSGVAAKKLVHSFNCIERPAVFLTPSDAVHGTLGVLQKEDILILISKGGNTGELLNLIPACKTKGSTLIGVTENPDSVIAKEADIFFPVSVSKEPDPFNMLATASTMAVIASFDAVIVCLMTYMNYTKEQFSVIHPGGAVGNKLLNK

SEQ ID NO: 33900 - protein, 428 aa, Corynebacterium diphtheriae NCTC 13129
MSTASWGWTLHGDGKTIAPGAVVAPEERLSWSRTIGIGMQHVIAMFGATLLVPTLTGFPVNTTLLFSGISTMVFLLITRNRLPSYLGSSFGFIAPLMASQGEGIGVQLGGVVATGLALILVGFIVKSAGRKVIDLVMPPAVTGAIVALIGLNLAPSAAGNFQSQPLVAVVTLASILLFTVAGRGMVARLGILIGVIIGWVFAAITGNLAEGASDSVREAAWIGFPQFHTPEFTTHAILVTLPVVIVLIAENVGHVKAVSEMTGRNLDDLAGDALIADGIGTTFAGAFGGSGTTTYAENIGVMAATKVYSTAAYWVAALTAVVLAFIPKFGALIFTIPTGVLGGAALVLYGLIGMLGVRIWQDNKVNFNNPVNLTAAAVALIAGIGNLTLVIGGIELQGIAWGSMGIIVFYPVLKWLYLRVGEGNNARF

SEQ ID NO: 33901 - protein, 348 aa, Listeria monocytogenes EGD-e
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPNELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 33902 - protein, 202 aa, Hevea brasiliensis
MEFSQDDFDRLLMFEHTRKSAEATYAKDPLDADNLTKWGGALIELSQFQSVPDAKKMLNDAISKLEEALVINPARLTHYGIEMQIPHMHFLLTLLRQKGILIKHLITSNKPMRNPVTISTENLKSLQRHQSYTWRSISMELVNRLWVEGLLLLQMQRVPRRIRRVVISNMTFLDGSLQLGLLHGWEWRNPMFPLHLQDKAIK

SEQ ID NO: 33903 - protein, 382 aa, Rhodococcus sp. RHA1
MFELIDEWGPEKVVCVSDARTGMRGVLVIDNTARGMGKGGTRMSTTVSVGEVARLARNMTWKWAGVDLFYGGAKAGIWADPTASSKEAVLRAFVRALRNEVPEEYVFGLDVGLTEKDAAIMLDEVGGRGGAVGTPHALGGLPYDQLGVTGHGVAESADAAAQALGLSTGSLSVSIQGFGAVGAASAKRLAELGATIVAVSTSQGGIHNPDGLDVATLLDLRDQYGDGLVDQYSDAKPLAAGEELSVTADILIPAALQDVIDADLARTLPAKIVVEGANLPSSPEAQSVLFDRGVTVVPDFIANAGGVVAAAVAMDARYSGIRPEPAAVFDNISNKLRASTIDTLDASKAQGRTTHEVARATAQERVREAMVLRGRSPQNAAF

SEQ ID NO: 33904 - protein, 336 aa, Streptococcus agalactiae
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVETLEKDVTVEEVNAAMKAAANDSYGYTEDPIVSSAYRGISYGSLFDATQTKVQTVDGNQLVKVVSWYDNEMSYTSKLVRTLEYFAKIAK

SEQ ID NO: 33905 - protein, 518 aa, Rhodococcus sp. RHA1
MSTAVAETIALPTTDELRTLARTSLQRCGVDPAVLDTAGVENTITTRSPVTGESLFDYPAADATDVEAAIDAAHEAFLQWRTVPGPVRGFLIKRLGELLTEHKEDVANLISIEVGKIRSEALGEVQEMIDICDFAVGLSRQLDGRTMPSERPGHRLMETWHPLGVVGVVSAFNFPAAVWSWNLALAIVCGDSVIWKPAQLTTLTAAACSALFDRAAKESGAPANLNVLVSASAADTQALIDSPKVPLISATGSERMGEQIAPRVAARFGRAILELGGNNAAIVTPSADLDIATRGIVFAAAGTAGQRCTSMRRIIVHQDIADELIDRISQVYGRLPIGDPFADGTLVGPLIDGKSHANMTAALDKAVAQGGEILVGGKRRPSSESSYYVEPAIVRMPAQSEIVKDETFAPILYVLTYDTFEEAIALHNDVPQGLSSSIFTTDQREAERFIAADGSDCGIVNVNIGTSGAEIGGAFGGEKTTGGGRESGSDAWRAYMRRATNTINYSRELPLAQGVNFG

SEQ ID NO: 33906 - protein, 336 aa, Streptococcus sp. 'group C'
MVVKVGINGFGRIGRLTFRRIQNVEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 33907 - protein, 226 aa, Pseudoalteromonas tunicata D2
MTFFAKELIIFDLDGTLIDSAPDLALTINLMLADLQLEPVDESLIRTWVGNGAQVLVERALAHAYLSKPVELSLIDDALAIFLNHYQHNLVVKSRLYPDVYRTLTTLKQQGFTLALITNKPERFIAPILAAIELNSLFSNVLGGDSLARKKPDPLPLITACQQLDFSVEQAVMVGDSKNDILAAKAAKMQSVGLTYGYNYGEPIANSKPDLVLDHFAKLIDHLVRV

SEQ ID NO: 33908 - protein, 270 aa, Mycobacterium sp. JLS
MTFAQKYGPWAVVAGASDGLGAAFAERIAENGVNVVLLARRQSVLDDVAAGIRDRTGVETRTLAIDLTDPAATGAVADATDDLEIGFLVYCAGADPAFEPFLAQPIEAAEAMVQRNCVAPMRLCHHFAPAMAARGRGGIVIFGSGAGLAGGPNMVAYAATKAFDMVFAEALWAELHDTGVDVLGLILGKTDTPALRTLEHRRGQIASTEQTPPGAVPVADVVSEAFDNLANGPTWIVGEDLRAATQMMGSISRSDAVRFIVEASRDAMGP

SEQ ID NO: 33909 - protein, 527 aa, Rhodococcus sp. RHA1
MITHERKFAISPGPGPHFRPRPVTVSRRPITPATTGAQLALSISCPTRPLERLMSTLEQPPETLQKSLKQRHLTMIAIGGVIGAGLFVGSSALLHTSGPAAFVSYAITGVVIVLVMRMLGEMATTNPSTGSFAGYARKAFGGWAGFTTGWLYWFFWVVAVGAEAVIGGKLLQRWIDLPSWVMAVVLLLAMVATNLRSVRNFGEFEYWFAGIKVAAILLFLGLGAAYVFGLWPSHSADFSNLTDHGGFTPNGWTVILSGVVVAVFSMVGPEIATIAAAESAEPEKAVAKATNSVIARIGFFYIGSVLLLAIIVPWTDVKVGQSPFVDALTHMGIPGGPDIMNAVVLVAVLSCLNSGLYTSSRMLFTLAHKGDAPQSIARLDKHGVPRNSLLLATLVGFACIGLDYLSPDTVFAFLLNASGATILMVYLMIAMSQIKLRGLMTREEVAQLRLKMWLFPYLSILAAGGILAVLVSMFYVESSRSQLSLSVGALIATLIAYRLRRRINPQNPLANNISAPAPGPITKPASK

SEQ ID NO: 33910 - protein, 744 aa, Zea mays
MPDLPCDGDGVCMVCRVTSPPEVDLLHCSTCATPWHSPCLSKAPALADAASWSCPDCSLDSATVAAPSAPANTLVAAIRAIESDNTLSDQEKARRRQALLAGDAPDVADDDDAADDTLEIVGKNFSCVFCMKLPERPVTTPCGHNFCLKCFQKWIQSKKRTCGKCRAPIPAKMAEQPRINSALVEVIRMAKISKNHNSAGSAVPYHYMRNDDRPDKAFTTDRAKKAGKANASSGQIFVTIAPDHFGPILAENDPRRNMGVRVGETWEDRLECRQWGAHFPHVAGIAGQSTHGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCSDDHGDRPRPLPKIKELQGATDITERKGRPSWDYDEKDGWKWMVPPPVSKRPVLSGDPETDKLIRKATKRAHLSVAERLLKEFGCSICRAVIKEPLTTPCAHNFCKTCLLGAYDSQSSMRERSRGGRTLRAQKIVKTCPSCPTDICDFLENPQINREMMELIESLQRKAVEEGKMAAGDAEESGDGDSEENGGALVKGEDDSNLNEEGQDGVDADGSVKIVVEMEGAKDDKKSKMGAAEVVDVLVEDAAAKQPKKRTADEDAAAKQTKHKADAETGGKRVKSSAAVEEVDVCVTPMKRTRKSGDMHDDGNGSPAVSSGRRVTRSSVNATGADDSPARRTRSRGRAC

SEQ ID NO: 33911 - protein, 100 aa, Plantago major
FLGLSVPQYFNEYTAINAYGPVHTSARWFNDMVNVPFSSEAFVAGLLAYFLDNTMHKKEAQIRKDRGKHWWDKFKSYKTDARSEEFYSLPFNLNKYFPSV

SEQ ID NO: 33912 - protein, 413 aa, Arabidopsis thaliana
MTLTISDLPRDLKKKIFSRIPLRYVRALRLTCKEWETLIKSRSLKIDEEESQMVALMDYNLCLMSKSFNGGDPSTEIKGKLTCFDEQVKVSMLFHCEGLLLCILKDDNTKVVVWNPYLGQRRFIQVRFSHIPGGWDQFSYALGYYKNNNMMKSFKLLRFFDYFYTSNDFVFYEIYDFDSGLWKTLDVTPYWRIRFFDDIGVSLKGNTYWCAKERKPEWNADPFIIVDHIICFDFTSERFGPLVPLPFRAMKESLVTLSCVREEKLAALFCRDVVVEVWITTTIEFDKVSWSKFLTFGVRDCPMIYSCTGSFFIDEVNKVAVIFGQPLKRDKVFIIGEAGQVRDVDLGEPAHQDSWLYVCPYVPSLVKIKQPPGCKRRRQSSSENRRYKRNMMRLVELEKYHIAMEPKRGDKTI

SEQ ID NO: 33913 - protein, 373 aa, Campylobacter jejuni RM1221
MEISYYEILEITQNADKETIKKAYRKMALKYHPDRNQGDKEAEDKFKLVNEAYEVLSNDEKRAIYDRYGKDALKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKNSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTSLNDEQKELLEKLSESFGIKDGMHQEQKGLFEKIANWFKS

SEQ ID NO: 33914 - protein, 422 aa, Yersinia pestis CO92
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGERRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVVDRGS

SEQ ID NO: 33915 - protein, 172 aa, Triticum aestivum
  misc_feature (80)..(80): Xaa can be any naturally occurring amino acid
MAAAGDAGEKKMVTLKSSDGEEFEVEEAVAMESQTIRHMIEDDCADNGIPLPNVTSKILSKVIEYCNKHVQAKPADAAAXGAAAPDAAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 33916 - protein, 174 aa, Thermococcus kodakarensis KOD1
MADKQIERTLIILKPDAVVRGLMGEIISRFEKRGLKIVGMKMIWIDRKLAEKHYAEHKGKPFFEPLIDYITKAPSVVMVVEGRYAISVVRKMAGATDPKDAEPGSIRGDYGLDVGDAIYNVIHASDSPESAEREINLYFKPEELFEYCKAADWFYHTHARSKKEYLDSMDCLER

SEQ ID NO: 33917 - protein, 471 aa, Coprinopsis cinerea okayama7#130
MEDAHATVLDLDEGKEDSNAFFAVYDGHGGSTVAKFAGANVHKRLVNEESYKAGDYETALKRAFLGTDEDLLANPGHTRDPSGCTAVAALITTDGKIYVANAGDSRSVIGIKGEVKPLSFDHKPTSERNLALSRALGDFEFKKNYALPPEKQIITADPDVTVHEITEEDEFLVVACDGKCFIHSDQVVDFVRYQVSQGKELQEIGEMICDHCLAPDTSSGAGIGCDNMTVLIVAITHGRTKEEWYKWITDRVNSNYGYATPSQPPQLYAASRIASFRARQEAQQARDRLNSQGLNEPAFPMETDDFLRRYGLTVSTFGGGISFRPGGNIMGDSGTLMFTNDDSDEDDSEDEGVGSRSFFTETLGLGRSQSPDATKNLKAQLEEFEKSIDVDEDGDAQMSDPEDDNSKSSSEESTKTLQGEAPPPPKALPNGDSSSIAVPVKQLEPLPAGDKPEPVSNVEGLLDKSEEPLKG

SEQ ID NO: 33918 - protein, 348 aa, Thermosynechococcus elongatus BP-1
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 33919 - protein, 562 aa, Aspergillus nidulans FGSC A4
MPVYSQYPPVDIPNIDLWAFLFERKDRQFPDNKVIYTDADTRRSYTYNDVKQSAITFGQGLKSLFDWRKGDVLALFTPNSIDTPIVMYGALWAGGVVSPSNPAYTVEELAFQLRNSGAKAVVTQLPVLSVARAAAKEVGIPDDRIILIGDQRDPEARFKHFTSIRNISGATRYRRTKINPEKDLSFLVYSSGTTGVPKGVMLSHRNIVANSLQLAAGEAGNLTWNGGADGKGDRLLAFLPFFHIYGLTCLVHQTIYKGYELFVMAKFDLEKWCQHVQNYRITFSYVVPPVVLLLGKHPIVEKYDLSSLRMMNSGAAPLTQELVEAVYNRLHIGIKQGYGLSETSPTTHTQPWGEWRESVGSVGKLLPNMEAKYMTMPEDGSEPTEVPTGEVGELYLRGPNVFQGYHNNPAATADSISPDGWFRTGDVGYQDSKGNFYITDRVKELIKYKGFQVAPAELEGILVDNPAVDDVAVVGVESAEHGTEVPVAFVVRSAKSKSSGVSAAEEAKNIAKWLDGKVAHHKRLRGGVRFVDEIPKSAAGKILRRLLKKQAQEEAASPKAKL

SEQ ID NO: 33920 - protein, 521 aa, Acidovorax sp. JS42
MSRFARGITIVWVVLRYGLDELVLSTFRQPWLRAVTRVITFGRKLDAPRGQRLREALESLGPIFVKFGQVLSTRRDLMPPDIADELALLQDRVPPFDPDVAIATIERAFRRPIGEVFVSFDRQPVASASIAQVHFAVIRDRQGHAREVAVKVLRPGMLPVIDKDLALMRMMAGWVESLSADGKRLKPREVVAEFDNYLHDELDLVREAANAAQLRRNMQGLDLVLIPEVFWDFCHAEVLVMERMKGVPINQVDRLRSAGVDIPKLARDGVTIFFTQVFRDGFFHADMHPGNIQVSLAPETFGRYISLDFGIVGTLTEFDKEYLAQNFTAFFRRDYKRVAELHIESGWVPAHTRVNELEAAIRTVCEPYFDRPLKEISLGMVLLRLFQTSRRFQVEIQPQLVLLQKTLLNIEGLGRQLDPDLDLWSTAKPFLEKWMLDQLGPQRLWRELRAEAPHYAKILPDLPRLLHDFLRQRPNDNRVDLQELLATQKRTNRLLQSLIYGGLGFVLGLLVMQLFVRVRIF

SEQ ID NO: 33921 - protein, 118 aa, Calonectria avesiculata
RSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 33922 - protein, 369 aa, Aspergillus nidulans FGSC A4
MANVHHISVPSKVLFQKARKLVPPMLEKFHKGQQGRVAVIGGSLDYTGAPYFSAMASARLGCDLSHVICESSAATVIKSYSPNLMVHPILPSSASVKDPSSIDAPSLASPIIAMLGRLHALVIGPGLGRDGVTLKVVTEVMKEARSRSIPFVLDADGLLLVTENPDLVKGYKDCILTPNVNEFSRLAKALNIEVPSLAQISSKESGDKTSKEAEACEKLSQALGGVTIIQKGPHDVISNGVTSIVSDLPGGLKRSGGQGDTLTGSLGTLLAWRAAYHDALWDSGEQEHSKEAENKEEVQGELESNKRMSPSTTLLLAAWAGAAITRECSRRAFKAKGRSMQASDLTDEVHESFLTLIGEPEGSKVPERL

SEQ ID NO: 33923 - protein, 543 aa, Glycine max
MVSVFNEILFPPNQTLLRPSLHSPTSFFTSPTRKFPRSRPNPILRCSIAEESTASPPKTRDSAPVDCVVVGGGVSGLCIAQALATKHANANVVVTEARDRVGGNITTMERDGYLWEEGPNSFQPSDPMLTMVVDSGLKDELVLGDPDAPRFVLWNRKLRPVPGKLTDLPFFDLMSIGGKIRAGFGALGIRPPPPGHEESVEEFVRRNLGDEVFERLIEPFCSGVYAGDPSKLSMKAAFGKVWKLEKNGGSIIGGTFKAIQERNGASKPPRDPRLPKPKGQTVGSFRKGLTMLPDAISARLGNKVKLSWKLSSISKLDSGEYSLTYETPEGVVSLQCKTVVLTIPSYVASTLLRPLSAAAADALSKFYYPPVAAVSISYPKEAIRSECLIDGELKGFGQLHPRSQGVETLGTIYSSSLFPNRAPPGRVLLLNYIGGATNTGILSKTDSELVETVDRDLRKILINPNAQDPFVVGVRLWPQAIPQFLVGHLDLLDVAKASIRNTGFEGLFLGGNYVSGVALGRCVEGAYEVAAEVNDFLTNRVYK

SEQ ID NO: 33924 - protein, 159 aa, Plantago major
MLQRIGIGLVLSLVSIVYAAIIERKRLATAMEYGLVDMPKAVVPMSALWLAPQYVLSGVADVFTMIGLQEFFYDQIPCDLKSIGLAMYLSILGIGSLLSSFLVSFIQNMTKGHGQDGWFADNLNKAHLDYFYWLLAGLSTVGLSAYIYFARSYVYRRKV

SEQ ID NO: 33925 - protein, 737 aa, Bordetella bronchiseptica RB50
MSATSAPDTPTPFDDAWRQLAAAGLDDAGQRQLAHAAAWAWPRFEAQKALTGEPLASHAAGAVRILASLHTDQATRVAAVLASLPADLNAPAPTLRNDPVASEFGVEVARLVQGARALLRLGIVARHASDSEAESGSQKEMQRKMLLAMAADLRIVLMRLASRLQSLRWHAETRTPCAAGFARETLDLYTPLANRLGIWQLKWEMEDLAFRFLEPERYKQIAHLLEEKRVEREAFIAEAIARMQEALARAGVVAEVSGRPKHIYSIWNKMRLKGLDFSQMYDLRALRIIVDDVRACYTALGLVHEMWTPLPEEFDDYISRPKPNGYRSLHTVVTDAQGRAFEVQIRTREMHQFAEYGMAAHWRYKEAGARGGQVAASSEYDRQLSWMRQLLAWNSDVEDEGEAARRADQRIYVLTPQARVIELPAGATPVDFAYHLHTDLGHRCRGARVDGQMVPLNTRLATGQTVEVIAAKSGGPSRDWLNTQLGYLASPRARAKVRMWFNAIELQQRITQGQALVEKELQRLGKTAVNLEQLAQGLGFARADDLYVAAAKDEFSLRQIDAVFQQPAPVAEPEPAALAHARSADSAEKSGKSGVLVVGVGSLLTQLARCCRPAPPDEIAGFVTRGRGVSIHRADCPSYKALAEREPERVIEVAWGKTSDSFYPVDISVRAQDRPGLLRDLSEVFARQRLNVVGVNTQSRQSLAHMVFTVEVRGGESLHKALDALGEVAGVTSAARR

SEQ ID NO: 33926 - protein, 179 aa, Plantago major
PRGIFATFMLASMLGSSIAARLLSRNTVKVEAYMQIVFVISSGSLLLPILTNFLISPSTERGTGISFGGCFQLLGFCVFEACVGIFWPSIMKMRSQYIPEEARSTIMNFFRIPLNIFVCIVLYNVNAFPITIMFGMCSIFLFVASLLQRRLSAIGDKPKTEEWTSLRQKNPEDESQDIA

SEQ ID NO: 33927 - protein, 162 aa, Medicago sativa
MQIQIAKQKQKNKKRNMGFTEKQEALVNSSFESFKQNPGYSVLFYTIILEKAPAAKGMFSFLKDSAGVQDSPKLQAHAGKVFGMVRDSAAQLRATGGVVLGDATLGAIHIQNGVVDPHFVVVKEALLKTIKESSGDKWSEELSTAWEVAYDALATAIKKAMS

SEQ ID NO: 33928 - protein, 318 aa, Plantago major
MATFPVVNMENLNGDERSSTMDIIKDACENWGFFELVNHGIAPEFMDTVEKLTKDHYRRSMEQRFNEMVANKGLEAVQSEIEDLDWESTFFLRHLPVSNISEIPDLQDEYRKVMKEFASQLEKLAEVLLDLLCENLGLEKGYLKKAFYGSKGPTFGTKVSNYPPCPKPDLIKGLRAHTDAGGIILLFQDDKVSGLQLLKDGEWVDVPPMRHSIVINIGDQLEVITNGKYKSVMHRVLAQTDGSGRMSLASFYNPGSDAVIYPAPALVEKEDSKDLYPKFVFEDYMKLYSGVKFQAKEPRFEAFKAMESNATVGPIATA

SEQ ID NO: 33929 - protein, 377 aa, Methylococcus capsulatus str. Bath
MAKEDYYETLGVPRNASDSDIKKAFRRLAMKYHPDRNKDNPEAEERFKSVKEAYDVLSDPKKRSAYDQFGHAGIDPSMGGGGGFGFTGDSFSDIFGDVFGDIFGGGGRRRGRGQRGSDLRYNLELTLEEAVAGTEAKIKVPTWVTCTECGGSGAKKGSAPVTCPTCHGQGAVRMQQGFFSVQQTCPTCRGTGQHISDPCRVCYGQGRVQETKTLSVKIPPGVDTGDRIRLSGEGEAGEGGGPPGDLYVHIGVKQHPIFTRDGADLYCEVPIGFPTACLGGELEVPTLDGKVVLKIPAETQTGRLFRVRGKGVKPVRGGVAGDLLCRVRVETPVHLNKEQIDLIRQLDESLRGGGSHHSPQAHGWLDGVKQFFDRLGL

SEQ ID NO: 33930 - protein, 116 aa, Triticum aestivum
  misc_feature (67)..(67): Xaa can be any naturally occurring amino acid
  misc_feature (111)..(111): Xaa can be any naturally occurring amino acid
MGVYLSTPKTEKLSEDGENDQLKFGLSSMQGWRASMEDAHSALLDIDEGTSFFGVFDGHGGKVVPKXCKYLHREVLKSEVYLAGDLGAAVHGAFFRMDEMMRGQRGWRELXALGDK

SEQ ID NO: 33931 - protein, 397 aa, Oryza sativa
  misc_feature (277)..(277): Xaa can be any naturally occurring amino acid
IRSLKPPANQPNPKDAKNFGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSXIPPLSVVGLSEQQALEEAKSDVLVCTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 33932 - protein, 1072 aa, Methylococcus capsulatus str. Bath
MPKRTDIKSILLLGAGPIVIGQACEFDYSGAQACKALKEEGYRVILVNSNPATIMTDPEMADATYIEPIDWQTVARIIEKERPDALLPTMGGQTALNCALDLDREGVLERFGVEMIGASREAIAKAEDRDQFRKAMIKIGLSVPKSEVAHSLEEALSVLDMVGYPAIIRPSFTLGGSGGGIAYNREEFVEICERGLELSPTHELLIEESVLGWKEYEMEVVRDRADNCIIVCSIENLDPMGVHTGDSITVAPAQTLTDKEYQIMRDASIAVLREIGVDTGGSNVQFAVNPRDGRLIVIEMNPRVSRSSALASKATGFPIAKVAAKLAVGYTLDELRNEITGGAMPASFEPTIDYVVTKVPRFTFEKFPQADDRLTTQMKSVGEAMAIGRTFQESLQKALRSLEIGVDGLVGKLTADSDDRVERLQRELGHPGCDRLFYVADAFRLGWSLDQVHELSAIDPWFLAQIEDLILEEAALAKRTLASLTPDELLALKRKGFSDSRLARLLDRSEAEVRAVRHRFGIRPVYKRIDSCAAEFATVTAYLYSTYEEECEAAPTDREKIVVLGGGPNRIGQGIEFDYCCVHAAMALREDGFETIMINCNPETVSTDFDTSDRLYFEPLTLEDVLEVVHLEKPKGVIVQYGGQTPLKLARALEAAGVPIIGTSPDSIDLAEDRERFQKLIDRLNLKQPPNRTARSLEEALRGAQEIGYPLVVRPSYVLGGRAMEIVFNDDDLKRYMLEAVSVSNESPVLLDRFLSDAIEMDVDAVADGQRVMIGGLMQHIEQAGVHSGDSACSIPPYDLRADIQDRVREQVRLLAEALGVVGLMNTQFAIQDDEIFVLEVNPRASRTVPFVSKATGYPLAKVAARCMVGRSLDQQGVSEERVPPYFSVKEAVFPFIKFPGVDPLLGPEMKSTGEVMGVGASFGEAYAKAQRAASVRLAYEGTTLISIRDADKPKIVPIAKALVARGFRLVATRGTAKVLQDAGVPCEKVNKVYEGRPHIVDMIKNGQIQLIINTTEGKKAIADSFTIRRQALQHQVTYTTTISGAHAICCALDELGSVDVNRLQDLHGALS

SEQ ID NO: 33933 - protein, 395 aa, Desulfitobacterium hafniense DCB-2
MMNKKGLKDIAVQGKRVFVRVDFNVPMDDHGNITNDTRIRAALPTIHYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLEGKTLPGIAALQNI

SEQ ID NO: 33934 - protein, 255 aa, Desulfitobacterium hafniense DCB-2
MAKRHPIIAGNWKMNKSLRETQEYAVKLLGVLGEVTAIDVVVCAPFTALNVLKNELEESVIHIGAQDMFYAPDGAYTGEISAAMLVDVACTYVILGHSERREILRETDEEIAKKVKAALKAGLTPILCVGENLANREEGKAFAIVRGQVEKDLTDLAPDDLKRVVIAYEPIWAIGTGKTASSEDAQEMCAMIRSTLAGIAGVVADEVNILYGGSVKADNIGELMSQPDVDGALVGGASLEAEGFAQLVQNAVAVL

SEQ ID NO: 33935 - protein, 511 aa, Desulfitobacterium hafniense DCB-2
MKPLLLMILDGWGYNPQSAGNAVAKAPKPHFDRLLEEYPHTLIVASGEEVGLPPGQMGNSEVGHLNIGAGRVVYQEFTRISQAIRTGEFARNTVLQEAMERVKDGPNALHLMGLLSDGGVHSHSEHLFALLAMAKTMGVKKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGRPLQLHYVCMTEYDDKLKGAAVAFPAQNLDNTLGEVLAKHQKKQLRIAETEKYAHVTFFFNGGVEEPCPGETRCLIPSPQVPTYNLLPEMSAYGITEELLKRLEREEDEVIILNFANADMVGHTGEFEATVKAIAAVDQCIGQIVPQVLERQGTVIITADHGNAEAKVDLQTGQPLTAHTTNPVPLILVNDQLKGKTLREGGALRDVAPTMLRLLEIPQPQEMTGKSLIC

SEQ ID NO: 33936 - protein, 425 aa, Desulfitobacterium hafniense DCB-2
MSYIEEIYGREILDSRGNPTVEVEVLLEDGSMGRAAVPSGASTGAFEAVELRDGDKGRFLGKGVLQAVANVNEVIAPELEGLNPFDQPAIDRELIALDGTENKGKLGANAILGVSLANAKAAAECVGLPLYQYLGGVNAKELPVPMMNILNGGQHADNNVDIQEFMIMPVGAKSFAEALQMGTEVYHSLKAVLKEKSLATAIGDEGGFAPSLESNADALLAIMDAIQRAGYTPGKDIALALDVAATELYRDGKYHLEGEGLTKTADEMIAYYEELVEKYPIVSIEDGLSEEDWEGWKKLTEKLGSKIQLVGDDLFVTNPARLARGIKEKCANSILIKLNQIGTLTETLDAIEMAKRAGYTTVISHRSGETEDVTMAHVAVAVNAGQIKTGAPARTERVAKYNELLRIEEELGETGVYPGHEALGR

SEQ ID NO: 33937 - protein, 291 aa, Vibrio fischeri ES114
MNLTQLPIISVLSDNVTVAQLDDVKVIRVIHDKANAAISLHGGHVLSFTPKGQDDLIWMSKEAIFNPEKAIRGGVPVCWPWFGRIADPAHGFARNNEWTLIEHRENDNGVIIVLGLEASEATKAIWPFEFEARLTVEIGDELRITLDAKNTDSKAWNCSGALHTYLNVADIASTTITGMGPTYIDGLQNAKLCTGEDTLSISAAVDRVYTQPENTVSVSDSQRTLTVTNSGHNAAVIWNPWIEGAESMADMNNDGYKTMVCVESTYHATSLEEAQTVEPGNAFTLTTTIKA

SEQ ID NO: 33938 - protein, 553 aa, Ralstonia solanacearum GMI1000
MYQYDAYDHRLVADRVAQFRDQVRRRISGELTEEEFLPLRLQNGLYMQRHAYMLRVAIPYGHLRAKQLRMLSHIAAEHDRGYGHFSTRQNIQYNWIKLEDVPDILGKLASVEMHAIQTSGNCIRNITTDQFAGVAPDEFVDPRPLAEILRQWSTFIPEFAFLPRKFKIAVSATREDRAVTQLHDIGVYAYEKDGRTLLRVLAGGGMGRTPILGAIIKEDLPWQHMLSYIEAAIRVYNRYGRRDNKYKARIKILVKAIGAEEFARQVEEEWQHIKDGPSTIPQAEFDRVAKDFAPPAYEKLADTDAAYEKALLENKAFARWVSRNVHPHRVPGYAAVTLSLKPGVALPPGDATAEQMALVADWSERFGFGELRVAHEQNLILPDVKKHDLFALWQLAKEHGMATANIGLLTDIIACPGGDFCSLANAKSIPIAQAIQARFDNLDYVHDLGEISLNISGCINSCGHHHVGNIGILGVDKADEEWYQVSLGGAQGNDSALGKVIGPSFKAEEMPDVIERIIDTFVANRIEDERFIETYNRIGMTPFKERVYAREAA

SEQ ID NO: 33939 - protein, 1173 aa, Aspergillus nidulans FGSC A4
MVLAARCGQATSSLLRQRCLAETRRSALALRSFTSPSTTRSTASALRLQQKTPSPWRSQQLRNFSSALCRLAAESSSVGDSLFSSGIVNPGANLVDVKKVLVIGSGGLSIGQAGEFDYSGSQALKALKEAGVQSVLINPNIATIQTDHKLADEVYYLPVTPEYVTYVIERERPDGIFLSFGGQTALNLGVQMNRMGTFERYGVRVLGTSIKTLETSEDRDLFAKALNEINIPIAESIAVGTVDEALKAADEVGYPIIVRSAYALGGLGSGFANNPEELKNLASRSLTLSPQILVEKSLRGWKEVEYEVVRDASNNCITVCNMENFDPLGIHTGDSIVVAPSQTLSDEEYHMLRTAAIKIVRHLGVVGECNVQYALQPDGLDYRVIEVNARLSRSSALASKATGYPLAYTAAKIGLGHTLPELPNAVTKTTTANFEPSLDYIVTKIPRWDLSKFQHVNRDIGSAMKSVGEVMAIGRTFEESFQKAIRQVDPRFVGFQGDKFENLDEVLKNPTDRRWLAVGQAMLHENYSVDKVHELTKIDKWFLYKLQNIVDNHNELKEIGSLFGVNKELMLKSKKLGFSDKQIAQLVGASEDDVRARRKGFGIRPWVKKIDTLAAEFPADTNYLYTTYNATSHDVTFDDHGTIILGSGVYRIGSSVEFDWCAVNATLSLRNMGKKTVMINYNPETYSTDFDTADKLYFEELSYERVMDIYELESASGVVVSVGGQLPQNIALRLQETGGANVLGTNPKDIDNAEDRHKFSQILDSIGVDQPAWKELTSVAEAERFAEAVGYPVLVRPSYVLSGAAMSVIHSQDELKEKLLNASAVSPDHPVVITKFIEGAQEIDVDAVASNGKLLLHAISEHVEPAGVHSGDATLVLPPASLEKPVMSRVKEIAEKVAKAWNITGPFNMQIIKADQEGAEPQLKVIECNLRASRSFPFVSKVLGTNFIDVATKALVGRDVPEPVDLMEVKRDYLATKVPQFSWTRLAGADPFLGVEMASTGEIACFGKDVVEAYWASLQSTMNFRVPEPGEGILLGGDITNPALAQIVDLLHPLGFKFFAASPEVKAHIESATKEHTPVQVIEFPKKDKRALREVFQKYDIRGCFNLAKTRGKTLLDEDYVMRRNAVDFGVPLFMETKTAQLFAQAMNQKLPRPEGIPSEVRTWSNFVGGKLL

SEQ ID NO: 33940 - protein, 453 aa, Geobacter sulfurreducens PCA
MPDYDTQTLRDWDRRHIWHPFTQMKEWEESEPVVIVEGEGSWIIDSEGKRYLDGVAAIWTNVHGHCRREINEALKAQVDRLEHSTLLGLTNDRAVVLAKRLAEIAPPGLCKVFYSDNGSTAVEVGVKMAFQFWRHEGKPEKSRFISFTSAYHGDTLGAVSVGGIDLFHGVFRPLLFPTIQAPAPYCYRCPMGRDTPAACGMECLTELERIMESHAGEVAGLVIEPLVQGAGGMIVQPEGFLKGVRELCDRHDILMIADEVAVGFGRTGAMFACGREGITPDIMALSKGITAGYMPLAATLATQQVYDAFLGEYREMKTFFHGHTFTGNPLGCAVALASLDLFESDRLLGKLPNKIKLLQEKLKGLIELEHVGDVRQCGMIAAVELVRDRATKEPFDWEERVGVRVCLEARTHGVFLRPLGNVIVIFPPLAITAEEIDFLVDGLEKSIHTVTGG

SEQ ID NO: 33941 - protein, 490 aa, Yersinia pestis CO92
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPQALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELGSFNSVF

SEQ ID NO: 33942 - protein, 263 aa, Methanopyrus kandleri AV19
MGELYLVGGGLSDVRDLTLRALEVLASVELVLVDTYTSVYDVSEGDLKRLLNGFGGDPEVRMCSRRDLEERFFDLCEGYDRVALLSPGDPMAATTHVALVVEAADRGWDVEIINGVSVFTAAPSKSGLEMYRFGRTATIPLNVRSVYPYDVLESNRQAGLHTLFLLEVAEDGEFVSVADAARYLLEIEREEGRGVLDPSDLAIAVVRLGFEDELVAWGTLEELSDWEPGEPPQALILPASRLREAEREYIRRVLPHIRDVRGV

SEQ ID NO: 33943 - protein, 90 aa, Triticum aestivum
MSADECEGDRQAMIKECAKYQQWPANPKLDPSDACCAVWKNANIPCLCAGVTKEKEKIYCMEKVGYVANFCKKPFPHGYKCGSYTFPPLA

SEQ ID NO: 33944 - protein, 301 aa, Corynebacterium diphtheriae NCTC 13129
MSTGLTANNGIEEFGTIAVAMVTPFDANGALDIKAGQKLAAHLVSNGIDSLVLAGTTGESPTTSLEEKIDLLKAVKAEVGDSAKLIAGAGTNNTAASVEMARASAEAGADALLVVTPYYSKPSQEGIYQHFRTVSEATDLPICAYDIPPRSVVPIAPDTLCRLAALPMIKAVKDAKGDITAATTLIAETGLAWYSGDDPLNLPWLSVGATGFISVIGHLAPQLLREMYTNFNQGNLEKAREINAQLAPLVAAQARLGGVSLAKAGLRLQGIEVGDPRLPIVAPSESEIEDLRRDMNKTGVL

SEQ ID NO: 33945 - protein, 504 aa, Sphingomonas sp. LB126
MMESTGNAAIFEQARARIARPFGHFINGLWEAGSGEPIAVVNPATEQPIGSIAAGGEAEVDRAVAAARQRFESAEWTRMPAAERERLLLRLADLVERDRDELAAIETLDNGMPFAPARMMAVGSAISAIRYNAGWARRMTGEEAPVSVPGRWHGYTSREPLGVAALIVPWNAPFAITCNKVSAALAAGCTVVLKPAELAPMSGLRLAELVQEAGFPDGCLNVVTGLGAQAGAALVRHPGVDKISFTGSTATGQSILRETAGRLTRVSLELGGKSAVLVFPDADLEKAIPAVAMGIFGNSGQVCAAGSRLFLHDSVFDRFVTGLVDFAEKLMVGPGDQPGVALGPLISAGQKERVMGYIAAGEAEGAQIATRGSAPDEPGYFVKPTIFVDTRPDMRIVREEIFGPVLSVMRFSDDNLENLARQANDSIYGLSAYVWTRDLSTAHAMARYLRAGSVKVNGSGMEFALPFGGFKQSGIGRENGPRGGGSLYRKEVGNDRLVMVWTAL

SEQ ID NO: 33946 - protein, 331 aa, Vibrio fischeri ES114
MTIKVGINGFGRIGRFVFRASVERNDIEVVGINDLIDVEYMAYMLKYDSTHGRFNGTVEVVDGNLVVNGKTVRVTAERNPEDRKWDAINVDVVAEATGLFLDDATARKHITAGAKKVVLTGPSKDATPMFVMGVNHESYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDAVVSQDFIGEVQTSVFDAAAGVALTDKFVKVVSWYDNEIGYSNKVLDLIAHVSK

SEQ ID NO: 33947 - protein, 337 aa, Glycine max
MGLYEHPDVVQWGINLFDSDPAYSPGYYSDIIQHDTGDVYNGHYYHSHYDTESNQIQNDEIIARALQEEFSRLDIAECSGYSQTDEEQFHASEPTCDWNNTSMMNYCSGHDYAYNGVGDIEPSSSSCCSPCEVEESSLELTDNYPLDGEIGRRLSQMVPIPHVPKINGEIPSIDEATSDHQRLLDRLQLYDFVEHMVQGDGNCQFRALSDQLYNTPDHHKYVRRQVVNKLKSHPEIYEGYVPMEYAEYLEKMSKSGEWGDHVTLQAAADSYGVRIFVMTSFKDTCCIEILPHFEKPKGVIFLSFWAEVHYNSIYPQGDIPSSESRKKKRWWNFGTKH

SEQ ID NO: 33948 - protein, 1125 aa, Thermococcus kodakarensis KOD1
MKVDELPIDERIKRVIKERGIEELYPPQAEALKSGVLEGKNLVLAIPTASGKTLVSEIVMVNKLLSEGGKAVYLVPLKALAEEKYREFKEWEVLGLRVAATTGDYDSTDEWLGRYDIIVATAEKFDSLLRHGASWIKDVKLVVADEVHLIGSYDRGATLEMILTHMLGKAQILALSATVGNAEELAEWLDASLVVSDWRPVELRKGVFHLGQLFWEDGKIDHYPENWESLVLDAVKKGKQALVFVNTRRSAEKEAISLSSKVSKLLTKPETRRLEELISSIEDNPTTEKLKRALKGGVAFHHAGLSRAERTLIEDAFRNGLIKVITATPTLCMHPDTYVVTKSGAKKVSELTEGDEVLTHTGTFKKVIQPLRREHKGRLLVIKAYGTVPVKITPEHMVWVVKQIRHKSHYSDGRQVIWWEFEGPEWMTAQELKERLESETDPKVSYMLLQPIPEPSVDADKIPLRKEVYVVNQHGKTDKLHPSVKRTPEYLPLNFETARLIGLWIAEGSTSKNGVIKFDISSNEEDLTEFITGTIRKYFPHAKIVVKDHERNRRTVRFCNKRFAEWLRENIGHGADNKSIPPLLLLNKNREVRLGLLRGLIEGDGYVRRESQRRANYISYSTVSPSLAYQLQLLVASLGYTSSIHRSIRTEGIGKTRKPIYDVKVSGKSYYSLLEELGFEVPQRGNRTYNVNRTWKNYLLLKVRSIEEEEYEGDVYNLEVEGDESYSVGFIVHNSAGINLPAFRVIIRDTKRYANFGWTDIPVLEIQQMMGRAGRPKYDKVGEAIIVARTEDPKKLIDRYIHGKPEKLFSMLANEQAFRSQVLALITNFGVEDFRELVDFLSRTFYAHQRGDTSSLEYKAKDIVYFLIENEFIDMDVENRFIALPFGRRTSQLYIDPLTAKKFKDAFPAIERNPNPFGIFQLLASTPDMATLTARRREMEDYLDLAYEMEEHLYSSIPYYEDSRFQGFLGQVKTAKVLLDWINEVPEARIYETYNIDPGDLYRILELADWLMYSLIELYKLFEPKEDVLQYLRDLHLRLRHGVREELLELVKLPNIGRRRARALYNAGFRSVEDILRAKPKDLLQVEGIGLKIIEGIYRHLGVEYTISEKEKPKKRKGNLYDFLK

SEQ ID NO: 33949 - protein, 252 aa, Exiguobacterium sibiricum 255-15
MNLINKTVVLTGASSGLGEALAYELNRHGANLILVARREDRLQQMAKTLQAEYIVYDLEHSPERLADQIADRYGMIDVLINNAGFGEFSFLKDTTIETIESMNRVNVLAPIRLTKACLPLFRPHGIIVNVASQAGKLPTPKSSIYCMTKAALYQFSNALRLELKPQGLHVMTVNPGPIATEFFVRADLSRKYEKNVANIVLSKEKLARTVTRAMVREKREVNAPFWMEGSAKAYGLFPRVIEWLGKSGFDKK

SEQ ID NO: 33950 - protein, 255 aa, Euglena gracilis
MPRKFFVGGNWKCNGTRESISKIIEEFNKGPSVADADVEVVIGCPFVYADYTREKLRQDWALSVQNCWIGKGGAFTGEISAEMIKDAGIPWVILGHSERRHLPELKESDETVAIKVAYALANGLKVMACIGELLEEREGGQTQAVNERQLKAIAAKLKEEDWKNVVIAYEPVWAIGTGKVATPEQAQEVHEQVRAWVASNVSPSVAAEVRILYGGSVTAKNSAELAGKPDVDGFLVGGASLKPEFLDIVAAYKHK

SEQ ID NO: 33951 - protein, 479 aa, Exiguobacterium sibiricum 255-15
MTTATTYTYLLDGQWQESESNETIEISSPYKEDTVGRVQAMTKTEVDRAIASAKAAQAEWAKVPANKRAELLHAWATELEKRANEIGEVIMREVGKGLADGIKEVKRTAEIIRYTAEEGLRFDGQMMQGDSFPGGSAKKIAIIKKAPLGVVLAISPFNYPVNLAAAKLAPALMTGNAVVFKPATQGSISGTLMVEALVAAGLPSGLVNLVTGRGSVIGDYLTAHPGINMITFTGGTATGQHLSRQSAMIPLVLELGGKDPALVLEDADLSLAADHIISGAFSYSGQRCTAIKRVFVLEPQADALVEELSARIAKLTVGSPEDESVVVPLIDTKSADFVEGLITDAKEKGATLVTGGNRTANLIEPTLFDHVTRDMRIAWEEPFGPVLPVIRVNSVEEMIAYANESEYGLQASVFTENIDAAFSVADALETGSVQINGRTERGPDHFPFIGVKSSGLGVQGVGRSLASMTRDKLTVLNLK

SEQ ID NO: 33952 - protein, 111 aa, Vibrio fischeri ES114
METIDKIKQQISENHILLYMKGSPKLPSCGFSSQAAQALMNCGEKFAYVDILQNPDIRAELPAYAQWPTFPQLWVEGELVGGCDIIIEMFQKGELQPLIKEAAERNAPAAE

SEQ ID NO: 33953 - protein, 530 aa, Aspergillus niger
MAEGFVDASRVEAPVTLKTYLMCAFAAFGGIFFGYDSGYISGVMGMRYFIEEFEGLDYNTTPTDSFVLPSWKKSLITSILSAGTFFGALIAGDLADWFGRRTTIVSGCVVFIVGVILQTASTSLGLLVAGRLVAGFGVGFVSAIIILYMSEIAPRKVRGAIVSGYQFCITIGLMLASCVDYGTENRLDSGSYRIPIGLQLAWALILGGGLLCLPESPRYFVKKGDLAKAAEVLARVRGQPQDSDYIKDELAEIVANHEYEMQVIPEGGYFVSWMNCFRGSIFSPNSNLRRTVLGTSLQMMQQWTGVNFVFYFGTTFFQSLGTIDDPFLISMITTIVNVCSTPVSFYTIEKFGRRSLLLWGALGMVICQFIVAIVGTVDGSNKHAVSAEISFICIYIFFFASTWGPGAWVVIGEIFPLPIRSRGVALSTASNWLWNCIIAVITPYMVDKDKGDLKAKVFFIWGSLCACAFVYTYFLIPETKGLTLEQVDKMMEETTPRTSAKWTPHGTFTAEMGLTANAVAEKATAVHQEV

SEQ ID NO: 33954 - protein, 495 aa, Coprinopsis cinerea okayama7#130
MSDLDADLYGDLYGNDETDFNEQNNEEQQQDVTATDAGTKDSEATTTPATETKPASNGTTAQSSTTNGQTSTTTTTKPATSTPIATYTSQQPQLQQIPTYEEPQPVQSISRPDSGALNKIPSGERTVRPSEMKDEGKMFIGGLNWDTTDEGLRDYFSQFGKVDACTIMRDAAGRSRCFAFLTFEDPASVNAVMVREHILDGKIIDPKRAIPRQEHQRATKLFIGGLPGSVTSESMREFFSQFGKVIDSTVMLDRETGRSKGFGFISFEDTDVRPFLGFGNLEIDGKLIDVKLAQPRYQRDNMNNEDGQNQDGYGGGSGGRFNAQGSSGAGAAGNFGGAAGGAMGGAAGGAGGAGAAGGATFDPQALAALYTRMIQMAGGGAMNPAMMGNMAGMNPMMGAMGAGGFAGGMRPGMGMGMNMGMGMGNPAMGGMGRGGPGMMGGAQGGAGGGAGGVPRGPRGGAPGAQGGPPAAGMGNAGVGPQRSQRGTHNFHPYAR

SEQ ID NO: 33955 - protein, 265 aa, Oryza sativa
LPCQRPSNFFLRLPSICFCLLAPFLVADSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNCEGGEWFHYTCVGLTPETRFKGKWFCPTCRNL

SEQ ID NO: 33956 - protein, 1161 aa, Glycine max
  misc_feature (527)..(527): Xaa can be any naturally occurring amino acid
  misc_feature (539)..(539): Xaa can be any naturally occurring amino acid
  misc_feature (567)..(567): Xaa can be any naturally occurring amino acid
  misc_feature (576)..(576): Xaa can be any naturally occurring amino acid
MLQQAERRIPPFRRRKSTPHEQRLSHHSSNNNNNIDSMSKAIAQYTEDGVHAVFEQSGESGRSFNYSESIRIASESVPEQQITAYLVKIQRGGFIQPFGSMIAVDEPSFRILGYSDNARDMLGITPQSVPSLDDKNDAAFALGPQSVPSLDDKNDAAFALGTDVRALFTHSSALLLEKAFSAREISLMNPIWIHSRTSGKPFYGILHRIDVGIVIDLEPARTEDPALSIAGAVQSQEALVRAISQLQSLPSADVKLLCDTVVESVRELTGYDRVMVYKFHEDEHGEVVSESKRPDLEPYIGLHYPATDIPQASRFLFKQNRVRMIVDCHASAVRVVQDEALVQPLCLVGSTLGAPHGCHAQYMANMGSIASLVMAVIINGNDEEGVGGRSSMRLWGLVVCHHTSARCIPFPLRYACEFLMQAFGLQLNMELQLAAQSLEKRVLRTQTLLCDMLLRDSPTGIVTQSPSIMDLVKCDGAALYFQGNYYPLGVTPTEAQIRDIIEWLLAFHGDSTGLSTDSLGDAGYPGXLPRLGMQFVGWXVAYITEKDFLFWFRSHTAKEIKWGGAKXILRTRMMGXRMHPRSSFKAFLEVVKSRSLPWENAEMDAIHSLQLILRDSFKDAEHRNSKAVVDPHVSEQELQGVDELSSVAREMVRLIETATAPIFAVDVDGHVNGWNAKVSELTGLPVEEAMGKSLVHDLVFKESEETMNKLLSRALKGEEDKNVEIKMRTFGPEHQNKAVFLVVNACSSKDFTNNVVGVCFVGQDVTGQKIVMDKFINIQGDYKAIVHSPNPLIPPIFASDDNTCCLEWNTAMEKLDPSNENVTVGRVDVIGKMLVGEVFGSCCQLKGSDSITKFMIVLHNALGGQDTDKFPFSFLDRHGKYVQTFLTANKRVNMEGQIIGAFCFLQIMSPELQQALKAQRQQEKNSFGRMKELAYICQGVKNPLSGIRFTNSLLEATSLTNEQKQFLETSVACEKQMLKIIRDVDLESIEDGSLELEKGEFLLGNVINAVVSQVMLLLRERNLQLIRDIPEEIKTLAVYGDQLRIQQVLSDFLLNIVRYAPSPDGWVEIHVRPRIKQISDGLTLLHAEFRMVCPGEGLPPELIQDMFNNSRWGTQEGLGLSMSRKILKLMNGEVQYIREAERCYFYVLLELPVTRRSSKKC

SEQ ID NO: 33957 - protein, 421 aa, Brassica napus
  misc_feature (19)..(19): Xaa can be any naturally occurring amino acid
EGSFAKVKYARNTVTVDIXSAAIKILDRDKILRHKMVEQLKREISTMKLIKHPNVVEIIEVMASKTKIYIVLELVNGGELFDKIAQQGKLKEDEARRYVHQLINAVDYCHSRGVYHSDLKPENLIPDANGILKVSDFGLSAFSLQVRGDGLLHTACGTPNYVAPEVLSDKGYDGAAADVWSYGIILFVLMAGYLPFDEPNLMTLYKRICKAEFSCPSWFSPGAKEVIKRILDPSPITRISIAELLEDEWFKQGYKPPSFGQDDEDITIDDVDAAFSNSKESLVTEKKAKPESMNAFELISSSNSLENLFEKQAQLVKKETRFTSQRPASEIMSKMEETAKPLGFNVRKDKYKIKMKGDKSGRKGQLSVATEVFEVAPSLHVVELRKTGGDTLEFHKFYKNFSSGLKDVVWNTDGAPEEHKA

SEQ ID NO: 33958 - protein, 576 aa, Desulfitobacterium hafniense DCB-2
MPIIIRFFKDKRFRVIITMFLRFVFQLWWLSKKRRFYGEEAYQKQLKAVYQKQARIFAEIAMGMGGLLIKLGQFFSSRVDILPEEYTRELALLQDAVKPVPTADIIRRIEAEYGRPLGEIYLNFSPEPIASASLGQVHTAEIKGHDQVAVKILRPGIEEIISSDFDALRFVVTFAKRYPRIRAAVDLEQIYAEFTETTLDELDYLKEGRHADQFRENFAGEPGIAVPKVYWEYTTRRVLTMEYITGYKINDFAALDKAELDRVKLADTLITAYVQQFLSDAFFHADPHPGNLLVKEDGTLVFLDFGMVGRIDEGMREELISFVMALFKKDTEQMVEVFANLGFLRPHAEKGTLAKGLKLILANIFAEKDLKKVNSEEFLWELREFMYSQPFQIPARTLFLGKALLSIIGICGGLNPRLDLIKTLRPYAEELLAGKEQADGAQGFAQKFILDQAKKTFTDVVGLPERINHLITGLEGGSIRLHPARSFEQNLLQSQREQGNRIVQAIVSSGFLIAGTILLEGPYLKIGIGLIAFSALSFLSLLKSNAGRARSERRGRGNRAMRNASATGFKKPRFHP

SEQ ID NO: 33959 - protein, 906 aa, Arabidopsis thaliana
  misc_feature (859)..(859): Xaa can be any naturally occurring amino acid
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVDSDHLWYRLPTGCQWFSWRPIHESSFAKDIASSRTFCVYEEVERMREAGLIKGGSLDNAIVCSAEHGWMNPPLRMRRRRCDLQPKRTRMCDLPPKRTSMCDLPPKLVGEKILTRIPITSLRAVRSTCKLWNALTKDRVLVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGXVAPNVGEPCPRTGHIPTTYRPPLVCSSTYLPSLVQVNQQRKRKERHV

SEQ ID NO: 33960 - protein, 583 aa, Aspergillus niger
MGVSNMMSRFKPQADHSESSTEAPTPARSNSAVEKDNVLLDDSPVKYLTWRSFILGIVVSMGGFIFGYSTGQISGFETMDDFLQRFGQEQADGSYAFSNVRSGLIVGLLCIGTMIGALVAAPIADRMGRKLSICLWSVIHIVGIIIQIATDSNWVQVAMGRWVAGLGVGALSSIVPMYQSESAPRQVRGAMVSAFQLFVAFGIFISYIINFGTERIQSTASWRITMGIGFAWPLILAVGSLFLPESPRFAYRQGRIDEAREVMCKLYGVSPNHRVIAQEMKDMKDKLDEEKAAGQAAWHELFTGPRMLYRTLLGIALQSLQQLTGANFIFYYGNSIFTSTGLSNSYVTQIILGAVNFGMTLPGLYVVEHFGRRNSLMVGAAWMFICFMIWASVGHFALDLADPQATPAAGKAMIIFTCFFIVGFATTWGPIVWAICGEMYPARYRALCIGIATAANWTWNFLISFFTPFISSSIDFAYGYVFAGCCFAAIFVVFFFVNETQGRTLEEVDTMYVLHVKPWQSASWVPPEGIVQDMPAPLPLPSRRVRLRWLSTPSPLSSASKPLALARTHFASCSCTLNLHLKL

SEQ ID NO: 33961 - protein, 514 aa, Aspergillus niger
MRLPKIKMPRKRPQDELNGDVLQQEAQATGPNGQKSEEGIVDTPIPLLTWRSFLMGIFVSMGGFLFGYDTGQISGFLEMPNFLQRYGQQQADGTYYFSNARSGLIVALLSIGTLIGALIAAPIADRVGRKWSISGWSAMVCVGITIQISSPFGKWYQVAMGRWVAGLGVGALSLLVPMYQAETGPRHIRGSLVSTYQLFITLGIFVANCINFGTEARNDTGSWRIPMGITYIWAMILGFGIALFPESARYDYRHGREAKAARTLSRISSWKEQERGEITWSHLFHAPRMKYRVAVGVALQALQQLTGANYFFYYGTTIFRGAGISNSYVTQMILGGVNFGTTFLGLYLIENYGRRRSLITGALWMFVCFMVFASVGHFSLDHENPERTHTAGVVMVVFACLFILGFASTWGPMVWTIIAELYPSEFRARAMSLATASNWLWNFLLAFFTPFITSAIDFRLGYVFAGCLFLAAGLVYVAVIEGRGRTLEEIDTMYVMKVPPWKELQVCISGHRSI

SEQ ID NO: 33962 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 33963 - protein, 398 aa, Ralstonia solanacearum GMI1000
MNLIDSFLSFLANGTLNWAWWQILIFTLVVTHMTIASVTIFLHRCQAHRALDLHPAAAHVFRFWLWLTTGMVTKEWAAIHRKHHAKCETEEDPHSPQTRGIRKVLLEGAELYRAEAKNRETIQKFGHGTPNDWIEQNLYSKYTWQGVGLMLILDVLMFGTLGLTVWAVQMLWIPIHAAGIINGLGHYWGYRNFDCEDASTNVFPWGLIIGGEELHNNHHTYATSAKFSIKWYEFDVGWGYIRALEMVGLAKVKKVAPKARFGDVKPVDQNTLEAIIANRYDVMARYAKTVKVAYRQELAKLKDARDVEYRALKPARKWFHRDEAKLGAPQREQLSQIVSDHSALHTFVEMRRDLGALWGRSNATREQLLHQLQEWCKRAEESGIHALQEFAVRLRRYA

SEQ ID NO: 33964 - protein, 1178 aa, Sorghum bicolor
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEEQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFTYPGEGLPADIVQDMFSNSQWSTQEGVGLSTCRKILKLMGGEVQYIRESERSFFLIVLELPQPRPAADREIS

SEQ ID NO: 33965 - protein, 346 aa, Corynebacterium glutamicum ATCC 13032
MEDMRIATLTSGGDCPGLNAVIRGIVRTASNEFGSTVVGYQDGWEGLLGDRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHVRLGHDVRTTVLGHIQRGGTPTAFDRVLATRYGVRAARACHEGSFDKVVALKGESIEMITFEEAVGTLKEVPFERWVTAQAMFG

SEQ ID NO: 33966 - protein, 854 aa, Burkholderia mallei ATCC 23344
MLVAPLTGPVVPLADVPDPVFSGGMFGDGIGIDPLEGRLLAPCAGVVSHVARTGHAVTIAADGGAEILLHIGIDTVELNGLGFTAKIAEGARVAAGDLLIEFDQDAIARAAHSLVSVIAIANSDAFEVVERAGAGVVKAGETPLLALRARGADASADASASASAGAAADASCAQPAAEARKSITLTQPGGLHARPAARAREAARGLDAHVDVHFEGRKAALQSVVGLLGLGAGEHATIELVATGRDAAKALERVAHELLREAHGEAEEKPARIVSPAPAAAGIARAPLEPNTLAGVCAAPGIAVGTLVRWDDAQIVPPELASGTPAAESRLLDRALAEVDAQLETTVREASRRGAIGEAGIFAVHRVLLEDPALVDAARDLISLGKSAGYAWRETIRAQTAVLADVDDTLLAERAADLRDIDKRVLRALGYASASARELPAEAVLAAEEFTPSDLASLDRERVAALVMARGGATSHAAIIARQLGIPALVAVGDALYAIAQRTQVVVDASAGRLEYAPSALDVERARHERQRLAGVREANRRMSGEAALTRDGHRIEVAANIATLDDARVALDNGADAVGLLRTELMFIHRQAAPTASEHQQSYQSIVDALQGRTAIIRTLDVGADKEVDYLTLPPEPNPALGLRGIRLAQVRPDLLDDQLRGLLAVKPYGSVRILLPMVTDVGELVRIRKRIDDFARAMGRAQAVEVGVMIEVPSAALLADQLAQHADFLSIGTNDLTQYTLAMDRCQADLAAQADGLHPAVLRLVDATVRGAEKHGKWVGVCGALGGDPVAVPVLVGLGVTELSVDPVSVPGIKAQVRRLDYQLCRQRAQDLLALESAQAVRAASREIWPAE

SEQ ID NO: 33967 - protein, 249 aa, Leifsonia xyli subsp. xyli str. CTCB07
MSASHALILLRHGNSEWNRQNLFTGWVDVRLSEQGVAEAKRAGELLAESGLVPDILYTSLLTRAIQTANHALDAADRLWIPVVRSWRLNERHYGALQGLDKAETLEKYGPEQFQLWRRSFDVPPPPLADDSEWSQADDPRYADLGADLPRTECLKDVIARMLPFWESDITTSLSAGKTVLVTAHGNSLRALVKHLDGISDDDIAELNIPTGVPLVYKLDDSFKPVEPAAYLDPEAAAVGAAAVAAQGKK

SEQ ID NO: 33968 - protein, 537 aa, Glycine max
YNTLIAGLMRCSRIEDSRQLFYDMQEKDSISWTAMIAGFTQNGLDREAIDLFREMRLENLEMDQYTFGSVLTACGGVMALQEGKQVHAYIIRTDYQDNIFVGSALVDMYCKCKSIKSAETVFRKMNCKNVVSWTAMLVGYGQNGYSEEAVKIFCDMQNNGIEPDDFTLGSVISSCANLASLEEGAQFHCRALVSGLISFITVSNALVTLYGKCGSIEDSHRLFSEMSYVDEVSWTALVSGYAQFGKANETLRLFESMLAHGFKPDKVTFIGVLSACSRAGLVQKGNQIFESMIKEHRIIPIEDHYTCMIDLFSRAGRLEEARKFINKMPFSPDAIGWASLLSSCRFHRNMEIGKWAAESLLKLEPHNTASYILLSSIYAAKGKWEEVANLRKGMRDKGLRKEPGCSWIKYKNQVHIFSADDQSNPFSDQIYSELEKLNYKMVQEGYVPDMNSVLHDVDDSEKIKMLNHHSEKLAIAFGLIFIPPGLPIRVVKNLRVCGDCHNATKYISKITQREILVRDAARFHLFKDGRCSCGDFW

SEQ ID NO: 33969 - protein, 601 aa, Solanum lycopersicum
MDVRRRSEEPVYPSKVFAADEKPLKPHKKQQQQQEDKNTLLIDASDALPLPLYLTNGLFFTMFFSVMYFLLSRWREKIRNSTPLHVVTLSELGAIVSLIASVIYLLGFFGIGFVQTFVSRGNNDSWDENDEEFLLKEDSRCGPATTLGCAVPAPPARQIAPMAPPQPSMSMVEKPAPLITSASSEEDEEIIKSVVQGKIPSYSLESKLGDCKRAASIRKEVMQRITGKSLEGLPLEGFNYESILGQCCEMPIGYVQIPVGIAGPLLLNGKEFSVPMATTEGCLVASTNRGCKAIYASGGATCILLRDGMTRAPCVRFGTAKRAAELKFFVEDPIKFETLANVFNQSSRFARLQRIQCAIAGKNLYMRFVCSTGDAMGMNMVSKGVQNVLDYLQNEYPDMDVIGISGNFCSDKKPAAVNWIEGRGKSVVCEAIITEEVVKKVLKTEVAALVELNMLKNLTGSAMAGALGGFNAHASNIVSAVFIATGQDPAQNIESSHCITMMEAVNDGKDLHISVTMPSIEVGTVGGGTQLASQSACLNLLGVKGANREAPGSNARLLATVVAGSVLAGELSLMSAISSGQLVNSHMKYNRSTKDVTKASS

SEQ ID NO: 33970 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPRKGQSVAIFGLGAVGLAAAEGARIAGASRIIGVDLNSQRFAQAKEFGVTEFVNPRDHGKPVQQVIAEMTNGGVDRSVECTGSVQAMIQAFECVHDGWGVAVLVGVPSKDDAFETHPMNFLNERTLKGTFFGNYKPKTDIPGVVEKYMNKELELEKFITHTVPFSEINKAFDYMLKGESIRCIITMGA

SEQ ID NO: 33971 - protein, 391 aa, Chaetosphaeridium globosum
MLTKKTDPMIVSMGPHHPSMHGVLRLVVSLDGENVIDCDPVLGYLHRGMEKIAENRSIVQYLPYVTRWDYLATMFTEAITVNAPEKLANIQVPKRASYIRVIMLELSRIASHLLWLGPFMADIGAQTPFFYIFREREMVYDLFESATGMRMMHNYFRIGGVAVDLPYGWLDKCLDFCDYFLPKIAEYENLITNNPIFRKRVEGIGIISREDAINWGLSGAMLRGSGVQWDLRKVDHYECYDELDWSIQWQSDGDCLARYLVRMGEMRESIKIIQQALKAIPGGPYENLEARRLNEGPKSEWNDFEYQFISKKSSPTFKLPKNEHYVRVEAPKGELGIYLIGDDTVFPWRCKIRPPGFVNLQILPQLVKGMKLADIMTILGSIDIIMGEVDR

SEQ ID NO: 33972 - protein, 220 aa, Zea mays
  misc_feature (135)..(135): Xaa can be any naturally occurring amino acid
MDSNSWINHPSVFSSRRCQSRSGGGYEDLKGEDDSKSEFICPFCADVFDIVGLCCHIDEEHPVEAKNGVCPVCTKRVGLDIVGHITTQHANFFKVQRRTRLRKGGYSSAYLALKKELREANLQSLLGGSSRFTSXPNIDSDPLLSSFIFSSPSANEPPKKSATSVAEGTLAIKLSLKESLKREIQEAPLSGEDQQKAKKSEFVRGLLLSTILRDDLMMHA

SEQ ID NO: 33973 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESHMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAIECVHDGWGVAVLVGVPSKDDAFKTHPMNFLNERTLKGTFFGNYKPKTDIPGVEEKYMNKELELEKFITHTVPFSEINKAFDYMLKGESIRCIITMGA

SEQ ID NO: 33974 - protein, 182 aa, Chaetosphaeridium globosum
MFTGVQNYTQEVIKAAKYIGQGFTITLDHMNRLPVTIQYPYEKLIPSERFRGRIHFEFDKCIACEVCVRVCPINLPVVDWEFQKSIKKKQLKSYSIDFGVCIFCGNCVEYCPTNCLSMTEEYELSVYDRHELNYDHIALGRLPISSIKDPMVYGVNGLSYLEKNIIQDNTNKDTVTGPYNKE

SEQ ID NO: 33975 - protein, 524 aa, Coprinopsis cinerea okayama7#130
MAMQIFGENATEEKAENARLSSFVGALALGDLVKSTLGPKGMNKILQSGSTGDINVTNDGATILKAIQLDNAAAKILVNISKVQDDEVGDGTTSVTVLASELLREAEKLIQQKIHPQTIVEGYRIASRAALKALEAAAVDNRGDQQKFREDLFNIARTTLSSKVLSQDKDYFANLAVDAVLRLKGSVELEHIQIIKKVGGKLTDSYLDEGFILDKTIAVNSPKRIENAKILIANTSMDTDKIKIFGARLKVDGTGKLAELERAEREKMKAKVDAIASHGINVFVNRQLIYNYPESLLAEKGIMVIEHADFEGVERLSLVTGGEIASTFDRPDLVKLGQCELIEEIMIGEDKLIKFSGVSAGEACTVVLRGSTNQMVDEAERSLHDALSVLSQTVKETRTVLGGGCSEMLMSCAIEEEARGIKGKKALAVEAFAKALREIPTILADNAGFDSSELVSKLRAAHFEGQNETGLDMEHGTIGSMRQLGVTESYKLKRQVVLSATEAAEMIIRVDNILRAAPRKREAV

SEQ ID NO: 33976 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 33977 - protein, 224 aa, Brassica napus
  misc_feature (203)..(203): Xaa can be any naturally occurring amino acid
MGHNRKGAAKDKNPKGEVSEKRGTVENLVDLRHGAAAAKDKNLKAKKKTKKPGTSENLVNDKILKAEETEKPRVSLAEAAAKMDPSDLADHLDGMKLPDLDVMRFYYYFQKAFAQVSWKWVKMLNESPLSAIIDVPVSHISKPIYELSVDWIKPREVKYISEIVLWICDRILYNLVDKGGDNAPASVWPKSQAAHFVVLAMVXRARPDSLIEVLPSLRHKHTYQ

SEQ ID NO: 33978 - protein, 417 aa, Ralstonia solanacearum GMI1000
MHVSHLEHLDKVLARLLHFAAPADMIVSQYFREHHELGHRERGIIAEAAFAVLRRKVEFGQFAESGSGPARRRLVLLGLLQTAGREAIAPFLTPQEAEWLDRWAIIDRTALAPRVRANLPDWLFDALVAQHGQAFTETLAQAWLAPAPLDLRVNTLKGERDAVLATLAQAGIEGAPAPLSPVGIRLAGKPALNKLDIFTNGTVEVQDEGSQLLCQLLAPKRSEMVVDFCAGAGGKTLAIGAAMRSTGRLYAFDISEKRLANLGPRLARSGLSNVHPARIDSEHDAKVKRLAGKIDRVLVDAPCSGLGTLRRNPDLKWRQSAQAVEEMSAKQLSILASAARLLKAGGRLVYATCSVLARENQQVVEQFLAQHADFVLVPAGEALAAQKIPLEMGPYLELYPHVHQTDGFFAAVLERRA

SEQ ID NO: 33979 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFSGNYKPKTDMPGVVEKYMNKELELEKFITHTVPFSEINKAFDYMLKGESIRCIITMGA

SEQ ID NO: 33980 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLWDMLLRDAPVGIFTQSPNVMDLVKCDGVALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 33981 - protein, 391 aa, Pseudoalteromonas tunicata D2
MSVIKMADLDLAGKRVLIREDLNVPVKNGKVTSDARIRASLPTIKLALEKGAKVMVMSHLGRPTEGEYNEEFSLAPVVDYLNDALDCAVRLEKDYLNGVTVNDNEVVVFENVRFNKGEGKDDETLAKQLAALCDVYVMDAFGTAHRAQASTHGVGVFAPIACAGPLLAAELEALGKALDNPARPLVAIVGGSKVSTKLTVLDSLSKIVDQLVTGGGIANTFIAAAGHPVGKSLYEPDLIAEAQKLTADAKANNGDIPVPTDVVVAKEFSESAVATLKDVSEVTDDDMIFDIGPDSAQQLATIIKNAGTVVWNGPVGVFEFDQFGNGTEAIAKAIAESNAFSIAGGGDTLAAIDKYGVADQISYISTGGGAFLEFLEGKVLPAVAMLEARAK

SEQ ID NO: 33982 - protein, 663 aa, Pseudoalteromonas tunicata D2
MPSRKELANAIRVLSMDAVQKANSGHPGAPMGMADIAEVLWRDYLNHNPTNPEWVDRDRFILSNGHGSMLIYSLLHLSGYELSIDDLKNFRQMHSKTPGHPEYGYAPGIETTTGPLGQGITNAVGMAIAEKALAAQFNRDEHDIVNHYTYTFLGDGCLMEGISHEACSLAGTLGLGKLVAFWDDNGISIDGEVEGWFTDDTPARFEAYGWHVVRNVDGHDSEAVRAAIDEARAQTNKPTLICCKTIIGFGSPNKSGSHDCHGAPLGDAEIAAAREFLGWEHGPFEIPADIYDAWDNKAKGSDLEASWNSKFAAYKAAYPELAAEFVRRNNSELPADWAEKSQAYIEQLQANPANIASRKASQNALEAFGPLLPEFMGGSADLAGSNLTLWSGSKGLTAEDASGNYIFYGVREFGMSAIMNGITLHKGFVPYGATFLMFMEYARNAVRMAALMKQPAIFVYTHDSIGLGEDGPTHQPVEQIASMRLTPNLDNWRPCDQVESAVAWKAAIERKDGPTTLIFSRQNLAQQTRSAEQLANVAKGGYVLSCDGNPEIILIATGSEVQLAQDSAAALRAQGKKVRVVSMPSTDVFEAQDAAYKESVLPKAVSRRVAIEAGIADYWYKYVGLNGAVIGMTTFGESAPAGELFQHFGFTVENIVEKSIALF

SEQ ID NO: 33983 - protein, 118 aa, Triticum aestivum
  misc_feature (60)..(60): Xaa can be any naturally occurring amino acid
  misc_feature (72)..(72): Xaa can be any naturally occurring amino acid
MAPAVMASSATTVAPFQGLKSTAGLPVSRRSSGSLGSVSNGGRIRCMQVWPIEGIKKFEXTLSYLPPLSTEXALLKQVDYLIRSKVGACLQFSKGLLRPLSKKPPGLLVEYWDKCWLP

SEQ ID NO: 33984 - protein, 550 aa, Methylococcus capsulatus str. Bath
MRGPLLLNYPLFNKGPAFPEQERRELGLLGLLPPHVDTLETQVERAYEAFRAKPTDLERHIYLRALQDENEVLFYRLMQDYIGETMPVVYTPTVGEACQRFSHIYRHPRGLFIAYPEREHIDELLANTAQREVDVIVVTDGERILGLGDQGAGGMGIPIGKLALYTLCGGIHPARTLPVLLDVGTDNPDLLNDPLYMGWRHPRVRGTEYDEFVERFVQAVMRRYPNVLLQWEDFAQANAGPLLERYRDRLCTFNDDIQGTAAVATGTVLAAVKVTGTRLRDQVVAVFGAGSAGCGIAEQICAAMVRDGLSETEARSRCFLIDRSGLLREGLSGLPPFQQAFAQPAARLAGWRVDRAGTIGLAEVVNNARPSVLIGVSGAAGAFTESIVKAMADYTPRPIILPLSNPTSRCEALPAQILAWTEGRALVATGSPFADVAWEGRTIPIPQCNNSYIFPGLGLGILAIGARRVTPGMFMAAAQALANASPAATDPHGPLLPPLTAIRNVSRLIALAVAKEAVAAGVAAPASDADLERMVDERMWTPAYARLTGC

SEQ ID NO: 33985 - protein, 391 aa, Methylococcus capsulatus str. Bath
MTSNIMPTYARQPVTFTHGEGAWLFDTEGKRYLDAVSGVAVCSLGHAHPAVAKALCDQAGRLVHCSNLYRIGLQEDLAKQLCDLSGMDNAFFCNSGAEANEAALKIARRYGHHRGIDTPKIVVMEGSFHGRTLATLSATGNPKVQEGFAPLVGGFVRLPYGDAEAVAAVDDPDVVAVLVEPVQGEGGVRIPPDDYLARLKSLCERRGWLLMLDEVQTGMGRTGRMFGHQHTGVTPDVMALAKALGNGVPIGACLARGVAAEMLTAGKHGSTFGGNPLACAAALAVIDTLTRQSLAQRAEILGQRLLDGFRTRLSGRPGVIEIRGLGLMIGLELERPCTRLVGMALEQGLLINVTAERTVRLLPPLILTDAQADDLVERLCSLVEAHLDAAG

SEQ ID NO: 33986 - protein, 650 aa, Zea mays
MSRDLDCPVQTQMAVAVLDRSFSSEYPGGSRIEGRQLSWKRVFVQTDNGSVLGIELERGENVQTVKKKLQIALNVPTDESSLTFGDLVLNNDLSSIRNDSPLFLKRNQIHRSNSTPCLSPTGKNVLQRDRSGPIEILGCSSPSSRMKQLAKDVIKAIMNDVDPVAVNSGMGGAYYFKNIWGERVAIVKPTDEEPFAPNNPKGFVGKALGQPGLKRSVRVGETGFREVAAYLLDYGHFANVPPTMLVKITHTIFNVNDCVGCKSKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIARLDPVKDAEMLRMELPMIRDACLRVLVLSTVFLKEAAASGLCLSEIGDMMSRQFTAKEEEPSQLELLCMEARKWVEERESFLPNEAGVEDDDDDFTQFLIDGEDDYPDALEPSAFCKFGSMKASSRNPLSKLDERDEEDGDGTEEDDDDDILTGALPQRISSISKLSSSMKGLGFIGKPKPYRTCLRKGKATGRTKYTGKASEHQSGSRSANELLPPSASFVKLSDMSPKQWSAFLDKFQELLPGALSARKHAAGVVGQRSMPRLGTSCQF

SEQ ID NO: 33987 - protein, 110 aa, Methylococcus capsulatus str. Bath
MDVIENIKRQIADNPVILYMKGTPDFPQCGFSGRAVQILDKCGVEYAFVNVFEAPEVRENLKLVSHWPTFPQLFVRGELVGGSDIMMELYESGELQKLLAGATKAGERQD

SEQ ID NO: 33988 - protein, 390 aa, Oryza sativa (japonica cultivar-group)
MEVEAATTQRQPCKNAITTKQQQQQQQQLSTGRLFRSPLLVVNFVLMVVGSACGPLLLRAYFLRGGNRKWLSSLLQTAGWPLLLAPLCFSYSSRRRRREVEDDGAGAGAAATPLFLMTPRLLVASAVVGLMTGVDDLLYAYGLAYLPVSTSSILISTQLAFTAAFALLLVRQRFTAFSVNAVVLLSVGAAMLGMNAGGDRPAGVSRAQYCAGFAMTLAAAALYGLVLPVMELSQAHHAAARGAVTYTLVMEMQLVIGFVATAFSAVGMLVNNDFHAIPGEAHEFGLGQAGYYLLLAGSAAMYQCFFLGTIGAIFYGSALLAGVIMTVLIPVTEVLAVMFFHEPFNGTKGVALALSLWGFVSYFYGEVRAAKAAHRRRHSDEPPKPDHLDP

SEQ ID NO: 33989 - protein, 331 aa, Yersinia pseudotuberculosis IP 32953
MTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 33990 - protein, 389 aa, Campylobacter jejuni subsp. jejuni NCTC 11168
MLTKRSQVLEESITLAITALANELKAKGEDIISFSAGEPDFDTPQTIKNAAISAIEKGCGKYTAVAGIPEVLKAIQTKFKKDNNLDYETNEIITNVGAKHSLFECIECLVEKDDEVIIPSPYWVSYPEMVKFAGGKPVFIEGLEENGFKITAEQLKKAITAKTKVLMLNSPSNPVGSIYSKEELTQIAKVLEGTQITVLSDEMYEKLRYDGFDFVAFASVSKDALKRTVTINGLSKCGAMPGWRFGYMASKNKALISAVKRLQGQSTSNICSITQHAAIPALNGECDKDIEKMRQAFEKRRNLALDILKQIPNISVYKPEGAFYLFVNIQKIEKDSMKFCQKLLEQEKVAVVPGVGFGMDGYFRLSYATSDELIKKGLERIANFIKNYK

SEQ ID NO: 33991 - protein, 528 aa, Oryza sativa
MVLGAWLMSPASVPWSLLAYGVLGLVLLWQAGRLLHSLWWRPRRLELALRAQGLRGTRYRFLTGDLGEHGRLNREAWARPLPLRCHDIAPRVAPFLHNAVREHGSACFTWFGPTPKVTITDPDLAKDVLSNKFGHFEKPKFPTLTKLFSDSLANHEGEKWVKHRRILNPAFHLEKLKLMLPAFSACCEELVSKWMESLGSDGSYEVDVWPEMQILTGDVISRTAFGSSYLEGRRIFQLQAEQTERLLKCMQKIVIPGYMSLPTKNNRKMHQIKKETDSILRGLVDKRMQAMKEGECTKDDLLGLLLESNMRHMEEDGQSNHGLTIEEVIEECKLFYFAGMETTSVLLTWTILLLSMHPEWQDRARKEILGLFGKNKPEYEGLSRLKIVTMILYEVLRLYPPAVTFTRKSYKQMEIGGVTYPAGVIVELPVLLIHHDPNIWGSDAHEFKPDRFAEGISKASKNPGAFLPFGWGPRICIGQNFALLETKMALCMILQCFKLELMPSYTHAPYSMVTLRPMHGAQIKLRAI

SEQ ID NO: 33992 - protein, 326 aa, Chaetosphaeridium globosum
MAEVLLFEALRDALDEEMQRDPSVLVMGEDVGHYGGSYKVTKGFHEKYGDLRLLDTPIAENSFTGMAIGAAMTGLRPIVEGMNMGFLLLAFNQIANNAGMLHYTSGGNFKIPIVIRGPGGVGRQLGAEHSQRLESYFQSVPGLQMVACSTPYNGKGLLKSAIRNDNPVIFFEHVLLYNLNENLIEQEYLLCLEKAEVVRPGNDITILTYSRMRHHVLQAAKVLVNKGYDPEIIDILSLKPLDMGTISLSVRKTHKVLIVEECMRTGGIGASLRAAILEDLFDYLDAPIQCLSSQDVPTPYSGPLEELTVIQPNQIIQAVEEMCKIE

SEQ ID NO: 33993 - protein, 810 aa, Thermococcus kodakarensis KOD1
MLTKVTDVTGEISENKDNSGVTNEMYRNVTEVTEKYRNVIEFLNLIQKAFNLQRTVEALPYYVLWTNGRLSLTKLKEIMEEYNSHLPKPYTHSSLKVALSVLRRDKTNVLEVKDKELGITYYELKPEAVEEILNVLQVEAKLRELEEAKAKDHEDLVNLAREFFREFYRDRIAEALTGSRDRFIVVDWMELNAVLPQLAEAVVERPVVAIKAFNDALRRFVEEDLMVEVRGEWSVHFTNLRDKLKPEDVRAEHVGKLVEIKGLVTGVSNVRSFYRKAVFVCLDCGARMARLQQPLKPLVRPKRCEACGSRNVELLEEESDKLDFQFFKVQDSPEDLSGGEPSERLAYVIGPQAGILKGGMRVRLSAIVRERVYKKDDLPVYERVLEVNHVEVLDKAMSVEELSEEDLRRVRELARVHGDKLPFVVASSIAPNLYGLEREKLGAAVSIVGGVPTQAKPRGHIHLLLVGDPGCGKTELLGAVERVAPKAIFTSGPGSSGVGLTATVKRNEVSKGDWMIVGGALVLASGGVCLIDELEKMKEDERKALHTAMEQQLIPINKAGINVVLKIDTTIMATANPKGGKFDRDKTVIEQIDFPPTLLNRFDLAFVVLDDYQEGDDVLDYVMEVNDAGAAGPIPEDLLRKFFVYARSLRPRFSEEAKEAIKAGFKELRKKYKSGKIALNLRYFNGLMRIAEAFAKLRLSETVEPVDVERAVNLFESSIRMIAYDPETDQYDLAILEVGVPSDVLDLQERVIGFLREASSWFPNGVPWGTVVDAMVEKGYPKEKVVQVLRDLMTHGRVAEVEANRLKLVG

SEQ ID NO: 33994 - protein, 379 aa, Arabidopsis halleri subsp. gemmifera
MSTTGQIIRCKAAVAWEAGKPLVMEEVEVAPPKKHEVRIKILFTSLCHTDVYFWEAKGQTPLFPRIFGHEAGGIVESVGGGVTDLQPGDHVLPIFTGECGDCPHCHSEESNMCDLLRINTERGGMIHDGESRFSINGKPIHHFLGTSTFSEYTVVHSSQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 33995 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPDCHSEESTMCDLLRINTERGGMIHDGESRFSINGKPIHHFLGTSTFSEYTVVHSGQVAKINPDAPLDKVCIVSCGLSTGLGATLNVAKPKKGQGVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEIKKAFDYMLKGESIRCIITMGA

SEQ ID NO: 33996 - protein, 498 aa, Coprinopsis cinerea okayama7#130
MATDFWASSHYTRWIVNRAVLKQARADDLVYVSDPEHLDFLAIYFANIITRLGKKLQLRQRVIATATVFFRRFYLKNAYCETEPFLVISACIYVAAKAEESPVHIKNVIAESRSLFSHHYGVKNFPSDNSKLAEMEFYLVDDLESDLVVYHPYRTLLALCRTSSGEDSDGEEGEEGEEEEAGELGGNHGAGVGIDKGSRYWGTGEGKLVLSKEALQIAWSIINDTYRSELCLLYPPHLIAIAALYLTFILHPPDRTSSTDTADSHEDEKRQPRRSSRQAHHHHAPKPPAKNPDPITFLAQLNVSLPLVATIAQEIISLYTLWERYKEDGAADAPVAGLASSSSKKSIASRSSSHTDLKAGLLSSKGKPRSGVHVTSVSSETTIPVRSSLERESQSALALPSAPAPAPITTAFLSQILLDMRESRLLDLAYGGEGELLGLPPSMASSVALPGPGGVPLGGLHAHDQGSGTSSAASSVMTGVSMNQQYHLNRVLGMNAYG

SEQ ID NO: 33997 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKGFDYMLKGESIRCIITMGA

SEQ ID NO: 33998 - protein, 1268 aa, Pseudoalteromonas tunicata D2
MLYNEDLTTQCPIRQKIRDFYRIDENEVIDYILPLAEVGVTARSRAWERARQIVVNIREDQAGQGGVDALLNEFSLSSEEGVVLMCLAEALLRVPDKETQESLIRDKLAHGDWSSHLGNSDSLFVNASSWGLLFTGKMVNYSDRNKDEQFGVLKKTLGRLGEPVIRKSVQFAMKIMGKQFVMGRTIDEAIERAVDKEEKGYVYSYDMLGEGARTMADADRYYQSYVNAIHAIGKAAKGRGPIKSPGISVKLSAIHPRYEFTHKERVMNELVPKLKALALTAKDYDIGFTVDAEEAERLDISLDVIEAVFSDPALGNWNGFGLAVQAYQKRATFVIEWLVDLAHRVGRKMMVRLVKGAYWDSEIKNTQKEGLDHFPVFTRKATTDVSYKACAIKLMAARDVIFPQFATHNAYTAATILEVAQGDSQGFEFQRLHGMGESLYDQIVTQDKVQCRVYAPVGQHEDLLAYLVRRLLENGANSSFVNAIVDDSKPVESLLPDPVETLQGLSNKYNSQIMLPLDIFGAERANSKGLDLTDINHITPFKANLDKWLADNLISETHVPEGAQAVKNPSNHNEVIGHISLQNEEQMRQLIEKSETALTTWSTTPVKARADILRKTADILERHRDELIALCIKEAGKIAKDGVDEVREAVDFCRYYAARAEELAKDERFEARGVILCISPWNFPLAIFLGQVAAAIVTGNTVIAKPAEQTSLIALRAIELMQTVGLPKDVVQAVIARGSDVGKVIVPDPRIQAVMFTGSTETGTRISQTLAQREDIQVPLIAETGGQNCMIVDSTALPEQVVDDVVSSGFQSAGQRCSALRVLFIQEDIADKVIRMIKGAMAELHLGDPALLSTDIGPVIDQKALNALNEHVEYLKGRSTLHYQCELPQMGDTGHYFFAPRLYEISDLSVLKKEVFGPCVHVIRFKADQLDNVIDQVNATGFGLTMGIHTRIEARAEYLAKMSRAGNVYINRNMIGAVVGVQPFGGRGLSGTGPKAGGPNYLTRLVKEKASPINVQMTNLSADELETHNFPGAAEQVNQLMAKSMRDEKIWRKTPLNDRISVVRQLLAKVATVDIVNELADDLALTLSDARSQLNRVEKRMKKAIVLPGPTGESNILYLEPRGCVVCYADKSTSFNFWVLSIITALAAGNTVITVASELFYDEAQAFRDKFISTGVAEGVFQVAKPNQLQAILAHTHLAGAVVAARSSRLGYFSKQLAARSGAILPVISSEYYDTLISRLITEKTISIDTTASGGNTSLMTLAVDDDQ

SEQ ID NO: 33999 - protein, 254 aa, Spinacia oleracea
MAYEEAIAALKKLLSEKGELENEAASKVAQITSELADGGTPSASYPVQRIKEGFIKFKKEKYEKNPALYGELSKGQAPKFMVFACSDSRVCPSHVLDFQPGEAFMVRNIANMVPVFDKDKYAGVGAAIEYAVLHLKVENIVVIGHSACGGIKGLMSSPDAGPTTTDFIEDWVKICLPAKHKVLAEHGNATFAEQCTHCEKEAVNVSLGNLLTYPFVRDGLVKKTLALQGGYYDFVNGSFELWGLEFGLSPSQSV

SEQ ID NO: 34000 - protein, 394 aa, Nicotiana sylvestris
MTTKNRQIKNFTSNFGPQHPAAHGVSRSVLEMNGEVVERAEPHIGLLQRGTEKLIEYKTYLQALPYSDRSEYVSMMAQEHAHSSAVERLLNCEVPLRAQYIRVLFREITRISNHSLALTTHAMDVGASTPFLWAFEEREKLLEFYERVSGARMHASFIRPGGVAQDLPLGLCIDIDSFTQQFASRIDELEEMSTGNRIWKQRLVDIGTVTAQQAKDWGFSGVMLRGSGVCWDLRKAAPYDVHDQLDPDIPVGTRGDRYDRYCIRIEEMRQSVRIIVQCLNQMPSGMIKADDRKLCPPSRSRMKLSMESSIHHFEPYTEGFSVPAPSTYTAVEAPKGEFGVFLVSNGSNRPYRRKIRAPCFAHSQGLDSMSKHHMPADVVTIIGTQDIVSGEVDR

SEQ ID NO: 34001 - protein, 317 aa, Debaryomyces hansenii CBS767
MASNSPILEKSNFEELRTKKFTFRLFGLHIGHSKSPLLQNYLFEKLGLSWRYELYESSDIDAFKKVLQGEDCIGSAVTMPNKVVMAEHVDFVDNDAKAVGAINTIYTRKEKDTGKTLYIGTNTDTYGIRDSFLYNAPEVVKKSRDSNNPGLVYGGGGACRSAVYALNEFLGCSKVYVINRFAEEVEAVREGMVKGGFKGEIIHVSSPEQAVSLEKPSMIVCTVPDFAPLTEEEKTARATLEVFIGSQERGAVLEMCYHPKPLTRLYNEFKASNWQVIGGMEAMIYQGFAQQSLWTGYSLDEMPVKDVIEYVYKNANN

SEQ ID NO: 34002 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKTQ

SEQ ID NO: 34003 - protein, 373 aa, Sulfolobus tokodaii str. 7
MEIKKGLEDVYVKETEITYIDGELGRLYYRGYSIYDLAEFSNFEEVSYLILYGKLPNREELNWFQEKLREERYLPDFIIKFLREVRKDAQPMDILRTAVSLLGIEDSKNDERTDIKGIKLISKFPTIVANYARLRKGLDIIEPDPKLSHSENFLYMLYGDRPNEIKSKAMDVTLILHIDHEMNASTFASLVVASTFSDLYSSIVAGISALKGPLHGGANYEALKMFKEIGSPEKVNDYILNRLSNKQRIMGFGHRVYKTYDPRARILKQYAKLLAEKEGGEIYTLYQIAEKVEEIGIKYLGPKGIYPNVDFFSSIVFYSLGFEPDFFPAVFASARVVGWVAHIMEYIKDNKIIRPKAYYKGEIGKKYIPIDSR

SEQ ID NO: 34004 - protein, 368 aa, Corynebacterium diphtheriae NCTC 13129
MTNPTKPIPLNFDKPRRFMPPKHFADLSADERIDALKELGLPKFRANQIARHYYGRLEADPSTMTDLPAAAREKVKDALFPQLMQPVRAVQADDGETQKTLWKLHDGTLLESVLMRYPNRATLCISSQAGCGMACPFCATGQGGLDRNLSTGEIVDQVRAASATMQAEGGRLSNIVFMGMGEPLANYKRVVSAVRQITAPVPEGFGISQRNVTVSTVGLAPAIRKLADEDLSVTLAVSLHTPDDELRNTLVPTNNRWEVAEVLDAARYYADRSGRRVSIEYALIRDVNDQGWRADMLGKKLHKALGPLVHVNLIPLNPTPGSKWDASPMDRQKEFVQRVIAQGVTCTVRDTRGQEIAAACGQLAAEER

SEQ ID NO: 34005 - protein, 301 aa, Aspergillus flavus
SAVKAARYGKDNVRVYKVHKDEKTGVQTVYEMTVCVLLEGEIETSYTKADNSVIVATDSIKNTIYITAKQNPVTPPELFGSILGTHFIEKYNHIHAAHVNIVCHRWTRMDIDGKPHPHSFIRDSEEKRNVQVDVVEGKGIDIKSSLSGLTVLKSTNSQFWGFLRDEYTTLKETWDRILSTDVDATWQWKNFSGLQEVRSHVPKFDATWATAREVTLKTFAEDNSASVQATMYKMAEQILARQQLIETVEYSLPNKHYFEIDLSWHKGLQNTGKNAEVFAPQSDPNGLIKCTVGRSSLKSKL

SEQ ID NO: 34006 - protein, 475 aa, Idiomarina baltica OS145
MSDKIKAQVVVLGSGPGGYSAAFRAADLGLETVLVERYSTLGGVCLNVGCIPSKALLHLAKHIEDAKVLANEGVEFGEPKIDLDKIRKHKEKVVGQLTGGLGQMSKMRKVKVVNGYGKFTSSNTLNVEGEDGNTEIEFENAIIAAGSQPIKLPFIPHDDERIWDSTDALELKEIPEKMLLLGGGIIALEMGQVYSSLGSKVDVVEMTDQLVPPADADIMKSFNKQVKGRFENVMLSTKATKVEAKKDGIYVTFEGKGAPEKPVKYDVVLTAVGRAPNGKKIDADKAGVKVTEQGFIEVDSQMRTNVDNIFAIGDIVGQPMLAHKAVHESHVAAEVIAGKKHFFEPKVIPSIMYTDPEVAWAGVTEKEAKEKGIEYEAVTFPWSASGRAIASNAQQGMTKLIFDKNNRIIGGSMCGSNAGELLGEVCLAIEMGCDAEDIALTVHAHPTLHESVGLAAEIQEGSITDMPNPKAKKKK

SEQ ID NO: 34007 - protein, 471 aa, Coccidioides immitis RS
MASTLTFLARHAPKRLCVSSSIPNTAARLAAPRLFSNSSAARQYDESAYQATRLIPTGPDFRPHSPTAVGEASGLESDAGHNRKIRHYTVNFGPQHPAAHGVLRLILELNGEEIVRADPHVGLLHRGTEKLIEYKTYLQALPYFDRLDYVSMMTNEQCYSLAVEKLLNIEIPERAKWIRTLFGEITRILNHLMSVLSHAMDVGALTPFLWGFEEREKLMEFYERVSGARLHAAYVRPGGVHQDIPLGLLDDIYQWATQFGDRIDETEELLTDNRIWKARTQGIGVVSAADALNFGFTGVMLRGSGVPWDIRKSQPYDAYDQVEFDVPVGVNGDCYDRYLCRMEEFRQSLRIIHQCLNKMPAGPVRVEDYKINPPPRAAMKENMEALIHHFLLFTKGYAVPPGETYSAIEAPKGEMGVYIVSDGSERPYRCKIRAPGFAHLGCFDQISRGHLLADAVAIIGTMDLVFGEVDR

SEQ ID NO: 34008 - protein, 473 aa, Kluyveromyces lactis NRRL Y-1140
MMLKNFTQTRLFHSSRHLLNLKAAIADVIPKRREELLHIKKNFSDVKVGDITIGSVINGMRGNQSMYWESTTLDPNEGIRFHGKTIAECQKLLPGAPEDNGKGEFLPESMLWLLMTGEVPSEEQVRKLTQELAERGAKLPPHTEKLLTSLPRDMHPMTQLAIALASMNKGSIFAEKYQEGSIGKMDYWEYVYEDVLNLIAALPKITGKIYSNIVNDGEPLGHYNVEKDWSYNIASLLGMTVSDSVNMHSLTQERSNDFVNLVRLYCGIHVDHEGGNVSAHTTHLVGSALSDPYLSYSSGIMGLAGPLHGLAAQEVVRFLVEMEKDVDSVENVKQVEEYLWKVLNSSRVIPGYGHAVLRKPDPRFDAMLNFAEKRPKEFKSDAKVQLMKQLSQIAPKVLKEHGKTKNPYPNVDSASGILFYHYGIDQLLFFTVIFGCSRAMGPLSQLVWDRILGLPIERPKSIDLNTIKKICKI

SEQ ID NO: 34009 - protein, 315 aa, Oryza sativa (indica cultivar-group)
MSPPSGGGKRGRDPEEDVYVDNLHSHKRYLSEIMASSLNGLSVGDSLVDNIMESPARSENTSYFRPCGRSTLFDDRTLAQVTFFNMPMNTHLDTHADDTSTLQDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVGYQMPENSYGRPEHDIDYIEDCTPHGCLSDLKFKQEDKDCSKLTSMDKNR

SEQ ID NO: 34010 - protein, 382 aa, Coccidioides immitis RS
MAPRIASAEEVRKRKIIGINPETVTHISATDFPGHWPGEDHSWSVNKFKENFQVTFHKNDPFEATFSLIGVDAAVANAFRRILIAEIPSLAIEFVFIHNNTSVLHDEVLSHRLGLVPLKGSLEGINWMSWFRMPKEGEPDSGSPASDSNTIVLKLNVECTKNQNARPDEDDPTKLYNNAHVYAKDIVFEPVGRQAAFFSGPHGVIQPAYPDILLAKLRPGQKIDIEMHCIKGIGQDHAKFSPVATASYRLLPDIQITRPILGNDAVKFANCFPKGVIGIEQVTAEDAAQAGSGYEGQEGQKKAVVVDPFKDTVSRECLRHEEFKGKVKLGRVRDHFIFNIESVGQFNSDLLFLESVKVLKLKCARLKRNVAALADMTDTHLA

SEQ ID NO: 34011 - protein, 379 aa, Arabidopsis thaliana
MSTTGQIIRCKAAVAWEAGKPLVIEEVEVAPPQKHEVRIKILYTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 34012 - protein, 80 aa, Zea mays
MPATPTIIGALLGLGTQMYSNALRKLPYMRHPWEHLLGMGLGAVFVNQLVKFDEKLKEDLDKMLERARLANEQRYIDDDE

SEQ ID NO: 34013 - protein, 347 aa, Schizosaccharomyces pombe 972h-
MKGSHPNAGSLLEPLHKLNPFSENSTSGHRKNASDHSADGETRPIAIEMKDSKGNTVPVGNSRPSKASNWLAGLMEDKNQRWRRSMEDTHICLYDFGGNQDDGFVAVYDGHAGIQASDYCQKNLHKVLLEKVRNEPDRLVTDLMDETFVEVNSKIAKATHNDICGCTAAVAFFRYEKNRTRRVLYTANAGDARIVLCRDGKAIRLSYDHKGSDANESRRVTQLGGLMVQNRINGVLAVTRALGDTYLKELVSAHPFTTETRIWNGHDEFFIIACDGLWDVVSDQEAVDFVRNFVSPREAAVRLVEFALKRLSTDNITCIVVNLTRNPGDLDDSGLTADNDSYSNDYY

SEQ ID NO: 34014 - protein, 560 aa, Artemisia annua
MDLRRKLPPKPPSSTTTKQPSHRSHSPTPIPKASDALPLPLYLTNTFFFTLFFSVAYYLLHRWRDKIRSGTPLHVVTLTELSAIVLLIASFIYLLGFFGIDFVQSFISRENEQLNNDDHNVISTNNVLSDRRLVYDYDGFDNDDDVIVKSVVSGEVNSYSLEASLGDCYRAAKIRRRAVERIVGREVLGLGFEGFDYESILGQCCEMPIGYVQVPVGVAGPLLLNGGEFMVPMATTEGCLVASTNRGCKAICLSGGATAILLKDGMTRAPVVRFATAERASQLKFYLEDGVNFDTLSVVFNKSSRFARLQNIQCSIAGKNLYIRFTCSTGDAMGMNMVSKGVQNVLDFLQNDFPDMDVIGISGNFCSDKKPAAVNWIEGRGKSVVCEAVITEEVVRKVLKTTVPALVELNMLKNLTGSAIAGSLGGFNAHAANIVSAVFIATGQDPAQNIESSHCITMMEAVNNGKDLHVSVTMPSIEVGTVGGGTQLASQSACLNLLGVKGACIESPGSNAQLLARIVAGSVLAGELSLMSAISAGQLVKSHMKYNRSSRDMSAIASKV

SEQ ID NO: 34015 - protein, 408 aa, Sinorhizobium meliloti
MSRIVIVGAGECGARAAFALREKGFDGGITLIGAEPDLPYERPPLSKEGLAAAAPPKYLADAMRYQEARITVLTNAPVARIDRDEKAVELADGRSVAYDRLLLATGAPPRVFPGAPENSERIRMLRTHADALAIRAALAPGRKLAVIGGGFIGLELAATARKLGAEVGVIEGLPRILSRGVPKEIAAIVDERHRREGVKILCGARIATIGHQGDGANILLADGGSIAADLLVVGIGATPNTELAEAAGLAVEDGIPVDETLRTSDPDIFAAGDCCSFPLSHYHGRRVRLEAWRNAQEQGTLVAANLMGAAKLVASVPWFWSDQYELTLQIAGLADDAAVTVRRDLSDDASFLFHLDGEGRLIAASAIGPGNAVARDIRLAEMLIATGSRPDPAALASPETKLKKLLGV

SEQ ID NO: 34016 - protein, 561 aa, Prosthecochloris aestuarii DSM 271
MTTSSDNLFCPEQNFYGPASKKIYVDGSLYPLKVGMRKITLSKTYTLQESSFSELPMYDTSGPYSDPSAKIDLQKGLPCIRDTWQTQQKETRPSNQSSHKPLNGRTPIRAAEGGSVTQMHLARKGIVTPEMEYVAIRENQMLEEWIERFSIGGNTFSPVTAEFVRDEVARGRAIIPANINHPELEPMVIGKNFRVKINANIGNSALGSSIQEEVEKAVWACRWGADTVMDLSTGSNIHQTREWILRNAPVPIGTVPIYQALEKVGGVAEELTWEIYRDTLLEQAEQGVDYFTIHSGILKDFLPVAARRMTGIVSRGGSIIAKWCRAHKRENFLYTHFDEICEILRAYDIAISIGDALRPGSIADANDEAQFAELKTLGDLTLKAWEYDVQVMIEGPGHVPLNLVAENMTRQLEYCHEAPFYTLGPLVTDIGAGYDHINSAIGGTLLASLGCAMLCYVTPKEHLGLPGKEDVREGVIVHKLAAHAADLAKGNPTAWLHDNIMSTARYSFAWEDQFNLSLDPVKARKWRKESSPEQGENIEEERFCTMCGPDLLFDEKVTGSN

SEQ ID NO: 34017 - protein, 304 aa, Debaryomyces hansenii CBS767
MSFSISNFIGDPFAISTLSFGLIAWIISIAGAGASNQDKFPHFSWWGIMYQLVIMVVITVLYLYNTIELYKFTLVGLLSIAFVYSTNSTNHLIYKTGDSGMLCCAAGCILLSMLNLIWILYFGGHPESPTNQFIDSFSLKTHSHNHGHLPSADNKAADGDIDDEVEYKRYSSSQGNTQFQDNNLRQSQLTTNNKSVNTPYMSSSQLNGLENFSSSDVHQSRDLTSNKRQTVYNDTNSVNDTGNVFRYKAKALYSYDANPEDINEISFAKDELLEVDDIDGKWWQAKRSNGQVGICPSNYVKLMD

SEQ ID NO: 34018 - protein, 252 aa, Prosthecochloris aestuarii DSM 271
MRKKIVVGNWKMNKTIAEAVELSSAIIDQLGEVSASCEVGIAPAFPALSGVHGVISGTGIHLAAQNCHYEDDGAFTGEVSVRMLDEAGCSYVIVGHSERRQYFGDTNPVVNLKVKKALSAGLNVILCVGETLDEREKGITTEVVTCQVKEGLEGVADIGDIVIAYEPVWAIGTGKTASSLQAQEVHASIRATVAGLYSEPAAAGVRIQYGGSVKPSNAEELFAMPDIDGGLIGGASLNAEDFVAIVKAAEKS

SEQ ID NO: 34019 - protein, 551 aa, Pseudomonas syringae pv. phaseolicola 1448A
MTEPEDPSRDRLKHHFAQRVIHQARQILETWQRLQKAEWSAGDMAELKESTLRLLRFAERFEQVEHISLAHDINQALEAVEANRGRLNSSVITDLNRLMQRLSRTGLRHGDQLEQTSLPPLRKPVYVVLQDHERAERLAKQLEFFGLAALSLHSVAEFQRAMAQRHPAAIVMDVDFSGPGQGLKLASQAQEGLEQKLPLLFFSLNETDTPTRLAAVRAGGEEFLTGALEASSLLEKIEVLTCVAQYEPYKVLIIDDSRAQAMHTERILNAAGIVTRVLLDPIQAMSELAEFQPDLIILDMYMPGCTGTELAKVIRHNDRYVSVPIIYLSAEDDQDKQLDAMSEGGDDFLTKPIKPRHLITTVRNRAARARSLKARMVRDSLTGLYNHTHILQLLEDCSFRSRREGKPLCFAMLDIDHFKKVNDSHGHPMGDRVIKSLALFLKQRLRKTDFIGRYGGEEFAIVMPDTDIQSAHKVLDEIRHRFAEIHYPAQPTDLFCTFSAGVVSLGANDDSLSLASQADTALYCAKHAGRNQVHSALVDVPYHVVLTEIEA

SEQ ID NO: 34020 - protein, 96 aa, Zea mays
RGGYTNMAGVKECVGHERVKHYADKGITIFSGNDDECHDSKWKHGATGVISVTSNLVPGLMHSLMYLSLIIFTISSTLLMILGLIMSLACPMRVPS

SEQ ID NO: 34021 - protein, 319 aa, Debaryomyces hansenii CBS767
MRFNSSIPGTSAKQSPFKISTTLIKDSDREKHDDKQFITHPLFPHPEFNGEECERVRVEHREPQSRGDRIAFKGIQLVRGSFDFVTGYKKPANEQDIQDGFKGTRYEMTEPKWLTRCIFLESIAGVPGMVAAFIRHLHSLRLLRRDKAWIETLLDEAYNERMHLLTFIKLGRPSWFTRLIIYIGQGVFCNLFFMCYLINPKYCHRFVGYLEEEAVSTYTHLLEELKMGKLKEFDNIQIPAISWQYWPELDEKSSFTDLILRIRADEAKHREVNHTLANLNQKSDRNPFALEIKGTDKKQPTNGLETHKGTGWDRDDLIL

SEQ ID NO: 34022 - protein, 1317 aa, Pseudomonas syringae pv. phaseolicola 1448A
MATTTLGVKLDDPTRERLKAAAHSIDRTPHWLIKQAIFNYLEKLESGATLLELNGATGKDSEDRGEVAEDTGLQCFLDFAESIQPQSVLRAAITSVYRRPEQEVVPMLLEQARLTAPVAEATNKMAASIAEKLRNQKSAGGRAGIVQGLLQEFSLSSQEGVALMCLAEALLRIPDKGTRDALIRDKISNGNWQPHLGNSPSLFVNAATWGLLLTGKLVATHNEAGLTSSLSRIIGKSGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVSQIERMATQEGGFGLPHPRIPLPRDLYGTERANSSGIDMANEHRLASLSSALLATAHNDWKAAPMLGCPASAGTLTAALNPSDLRDVVGHIQEASLQDVENAIQCALSAGPIWQATPPAERAAILERAADLMESDIQPLMGLLVREAGKTFANAIAEVREAVDFLRYYAVQARNDFTNDAHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVAGRLDSQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQAMRDKGRTVYQVAIADSTELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPQDAIEKSFVRSDALSAPDTRLRDILNKPLQALKAWAASNQQSDLDALCSQYAEQSQSGITRQLAGPTGERNSYAILPREHVLCLADDENDLLIQLAAVLAVGSSAVWPETDISKPLRARLPKDVQARIKLIPDWTKDEVIFDAVLHHGDSDQLRAICQQIAQRSGAIVGVNGLSHGETNVPLERLVIERALSVNTAAAGGNASLMTIG

SEQ ID NO: 34023 - protein, 890 aa, Idiomarina baltica OS145
MSEENKQDVDQQETQEWLDALEGVLDAEGPDRAHFLLEQLIDKARRNGAYLPYRPTTSYLNTIPASQEPTMPGNQTMEARIRSAIRWNAAMMVLRASQKGEELGGHIASFASSAMLYDVGFNHFFRAPSEGDGGDFLFIQGHASPGIYGRAFIEGRLTQEQLDNFRQEVDGKGLPSYPHPNLMPDFWQFPTVSMGLGPIQAIYLARFLKYLTDRGIKDCSNQRVYCFMGDGETDEPESLGAISLASREGLDNLTFVINCNLQRLDGPVRGNGKIIQELEGTFRGAGWEVIKVIWGRYWDPLLYRDTEGKLRELMEETVDGDYQNFKAKGGAYTREHFFGKYPETEEMVANLSDEDIWRLNRGGHDPVKVYSAYHKAVNTKGRPQVILAKTVKGYGMGAAGEGKNIAHQVKKMDMDAIKHLRDRFNIPFKDEELQDLPYYKFEEDSEELKYMNERREALGGYMPTRRAESDVELELPSLKAFDAVLKGSGDREISSTMAFVRVLTALLKDKKIGKRVVPIIPDEARTFGMEGLFRQVGIYAHHGQKYTPQDADQVAYYREDKKGQVIQEGINELGAMASWVAAGTSYSLNNEPMIPFYIYYSMFGFQRVGDLVWAAGDSQTRGFLIGGTAGRTTLNGEGLQHQDGHSHILFGTVPNCITYDPTYGYEIAVIVHDGLKRMYEDQENVFYYLTVMNENYHQPEMPEGVEEGILRGIYKLDDVKAKKKAKADVQLLGSGTILEQVRKAADILAEDFDINSTVYSVTSFNELARDGLDVERHNMLNADKEPKEAFITKAMKDAKGPAVAATDYMKLYADQVRQWVPTSYRVLGTDGFGRSDSRANLRKHFEVDANHVVVAALKELVDAGDIDAKVLSKAIKDYGIDVDKLNPRNA

SEQ ID NO: 34024 - protein, 514 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNETAASPVGQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYKTREEKYLLDLQRIQGPQFLFLDLCAAFLAQLRVL

SEQ ID NO: 34025 - protein, 442 aa, Streptomyces coelicolor A3(2)
MYTALRLQRNLKGELRRGEAEITVVTPDAYMTYQPFLPEAAAGSISPRHVVVPLRRVLGQCDVVVGEARSIDHTTRTATVTTLATDEARTGARRLTYDELVLAPGSVSRTLPVPGLADHGVGFKTVEEAIGLRNHVLEQMDIASSTRDPAIRDAALTFVFVGGGYAGVEALGELEDMARYAARYYHNVTPEDMKWILVEASGRILPEVGEELGRYTVTELRRRNIDVRLDTRLESCADRVAVLSDGSRFPTRTVVWTAGVKPHPLLAATDLPLDDRGRLACTAHLSVDGAPHAWAAGDAAAVPDVTAAEPGRNCAPNAQHAVRQARVLGDNVTHALRGEPLDTYAHRYAGSVASLGFHKGVAHVYGRKLKGYPAWFMHRAYHLSRVPTVNRKARVLAEWVIAGLFKREIVSLGSLEHPRAEFELAAGGKPSQEPPHNPKGSS

SEQ ID NO: 34026 - protein, 542 aa, Zea mays
MASDSGPASSDPLLHGRRAPSTGGWKSALFIIWVEVAERFAYYGISSNLISYLTGPLGQTTAAAAAAVNAWSGAASMLPLLGAAVADSWLGRYRTIVASSVLYITGLGMLTLSSVFSSPQQCRDSADDGEGICPPSSLQTAFFYASLYLVAIAQSRHKPCVQAFGADQFDATDPDEAVSRASFFNWWYMGLCTSATVTIALMSYVQDNVGWALGFGVPSMAMLLALAIFLLGTRTYRFYGSRGGAGASASASASASSLFRNAFVAWRKRSREVELGHGELAQDDAVLAEEVKGLARLFPIWATCLLYGAVFAQPPTLFTKQAATLDRRIGRSFQVPPAALQCFLGASIVTCIVLYDRVLVPVTRRVSGAASGITMLQRIGTGIALSLVTLVVAVLVEMKRLRAARDAGGGGLVDGSGTGTAAVPMSLWWIVPQYVLLGAADVFTMVGMQEFFYDQVPGALKSLGLALYLSVLGVGSFISSFLITVIDAVTTRNGGTSWFADDLNRGHLDYFYQLLAALTALELLAFAYFSTSYVYKTKAGNL

SEQ ID NO: 34027 - protein, 990 aa, Frankia sp. EAN1pec
MSSAPGAVEEFAARYPFGLDPFQSEAVAALAQGEGVLVAAPTGAGKTVVGEFAAHLALATGTRCFYTTPIKALSNQKYADLVARYGAASIGLLTGDTSRNGDAPVVVMTTEVLRNMLYTEAAGSARLDSLGYVVMDEVHYLADRQRGAVWEEVIIHLPQHVRLVSLSATVSNAEEFAEWLVTVRGHTRVIVSEHRPVPLFQHVLADRTLHDLFVDQPSGLDPGVPAFSRRGPGPNGRGAAPGSVGGATPGSRPGARAAEARAGDIAGAGAAAGGRAVNPDLLRLAREESRAVYERGRGPRSSRPGRPGAGNGAGNGRRRSGPPNRPDVIVRLDRAGLLPAILFVFSRVGCDAAVASCIQAGLRLTSPDEQREIREHVRARTAGVPQADLAVLGYWQWLEGLERGIAAHHAGMLPTFKEVVEELFVRGLVRAVFATETLALGINMPARTVVLERLTKFNGQTRADITPGEYTQLTGRAGRRGIDVEGHAVVLWQPGLDPLALAGLASTRTYPLKSSFRPSYNMAVNLVGRLGAERARTVLESSFAQFQADKAVVGIARAVRRNQTAIEELTAALECDRGSVTEYDGLRRQIREREADLSRAGTVRRQSEVAAALAKLRSGDVVRVPVGRRGGLVVVLDAGVDGGSAEGPRPVVLTEDRQVRRLSMIDFPVAVEPLARVRIPKSFNPRSPQARRDLASSLRNIRLPEEPGRRERARSLAADDAELARLRRAMRAHPVHDCPEREAHLRSAERIDRLRRETAGLERKVEGRTNTVARTFDRVRDTLAELGYLAVGGDSVTDAGAMLARIYTEQDLQVAECLRTGVWEGLTPPALAAAVSTLVFEPRGDDIAAPTIPGGGALRDALADMAGVYTRLGAAEDHHRLGFLRPPDLGFVAVAHGWACGRGLEKVLEDAGADLTAGDFVRWMRQLIDLLDQIAQVAPVYAAKTSAGPASGGPTAQERAGTDGILGVGRAARAAIDAIRRGVVAYSMSV

SEQ ID NO: 34028 - protein, 336 aa, Glycine max
AGFAGDDAPRAVFPSIIGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTEYLVKILTERGYSFSTSAEKEIVRDVKEKLTYVALDFEQEMETTKSSSAVEKSYELPDGQVITIGSERFRCPEVLFQPSLIGMEATGIHETTYNSIMKCDVDIRKDLYGNIVLSGGSTMFPGIADRMSKEISALATSSMKIKVVAPPERKYSVWIGGSILASLSTFQQ

SEQ ID NO: 34029 - protein, 106 aa, Glycine max
MFRRLGWFVGLNQTNLSTKRLLNADQTASARPNHQLPMLDAVHEVAVYIHRFHNLDLFEQGWYRIKITLRWEDGDDSHPGVPARVVQYEASEVGADNLCGVWMIDD

SEQ ID NO: 34030 - protein, 329 aa, Monascus purpureus
MPISTKSSFYLPAVDISPYLQDPNSDAARKVIDDVRAACTSTGFFQLLGHGISPALQQSVFAAAAKFFALPSDVKSRCRNVGFRGYDPMASQSYELGVLPDLKEGFIAGKDIPLDDPRVASQRFFMGQNAWPPSELLPEANFRRPIEEYYQAMLKLCWVVLDLVAATLPYGPHVFDEFKENDPACPLRLLHYPPAPAPDVAKGRQLGSSAHTDFGAITLLLQDDHSGLEVQDCETGEWIGVPPNKDAYVVNLGDMMSRITRGHYKSSIHRVINQNLTDRYSVVFFFDGNLDYRLRPLDRVGQNWDEEDTLTVEEHMLERTTTTYNLKVK

SEQ ID NO: 34031 - protein, 473 aa, Debaryomyces hansenii CBS767
MGTASIKSGTINLLNTIVGAGILAMPFGLKSNGLLFGCLLIVWSSLTSSFGLYLQNKVAKYTQQQEAVSYFSLAQLTYPQLSIIFDSAIAIKCFGVGVSYLVVIGDLMPKIMESLHVSPDSVLMARNLWISVFMVCIVIPFSYLKKLDSLKYTSIVALFSVVYLICLVISHFVARDIPVESIQVDWVGPVSVKSTLASFPIFVFAYTCHQNMFAIINELKPNEKQGSQTRQSNVIIRNAISTACISYLIVGVSGYLTFGNSVGGNIISMYPKDSILSLIGRLCIVIMVSLSYPLQCHPCRGSINHVIFFIKNGFKAHLKAKRSANAPEYTSLASDAESQTDSQLETLADETFISTTPVEGAQDSDGHYPIVVKLSTKMFYIITTAILVLSYLVAITVTSLEHVLAFVGSTGSTSISFILPGLFGYLLIKPINGATELDRVERICKFGGLALAIWGVTVMIVCLSATIFLGATE

SEQ ID NO: 34032 - protein, 500 aa, Triticum aestivum
  misc_feature (419)..(419): Xaa can be any naturally occurring amino acid
MRIPRRKAGVPLGVPSRRAQIAAVFALAVLLGVSVLYDSAHIAASLRRHSGYNRLSPTREAPAGAGPRATPAQAVESAGAATDRTDPPPRLGAEGVSKSNPGTAADGSSPETGVLKEVVAEGGEATCDMYKGRWVHDEENAPMYKESDCEFLTEQVTCMRNGRRSDEYQKWRWQPDACDLPRFDAKLLLEKLRNKRMMFVGDSLNRNQWESMVCLVQSVAPWDKKKLVKNGSLNVFRLNEYNATIEFYWAPFLVESNSDDPDIHSITDRMITPTSIAKHAANWIGVDYLIFNTYIWWMNTPKMKIVPDGSFTRKPVKYDELDRVVAYRQILETWSGWVEENVDPKRTMVLFMSVSPVHMQSEGWGSPDNIKCFSETQPVLNYTKTLDVGTDWDLFTESHEVTKATKKVPVHFINITALXEIRKDPHTCVHTLRRGKILRNEQNANHASIASESNGASMAGGHREGLPCTGTLRGPVERGRSRMTGTSDHDHIRAPKPAAG

SEQ ID NO: 34033 - protein, 243 aa, Synechococcus sp. CC9311
MRKPVIAGNWKMHMTCAQARAWIGTFLPLIAELPNDRHLVVAPPFTAISTLAELSEGTRLELSSQNVHWEGEGAYTAEISPSMLKEHNVQYAIVGHSEPRKYFSESDEQINHRARSAQTNGLIPIVCVGESDEQRSRGEAERVIRRQVEQGLEGLDPSQLVVAYEPIWAIGTGKTCEASEANRICGLIRSWVGSPDLIIQYGGSVKPGNIDQLMGMSDIDGVLVGGASLDPEGFGRIANYVKS

SEQ ID NO: 34034 - protein, 449 aa, Oceanobacillus iheyensis HTE831
MEDLFELDKKHFIHPTSSIIQQQTDGAKSIMAKGDGIYVTDTNNKEYIDAVSSLWNVNIGHGRTELAEVASEQMKKLAFSSAFSTFSHEPAIRLAKKISELTPQGLNAVFFTSGGSESNDSAVKLSRHYWKIQNKASKRKIISLKRGYHGVAAASTSITGIPEFWDMAGHLMNDFLHAETPYRSTTEKAIESLQSMIEQETADTIAAIFVEPVQGAGGVLIPPADYLEAVREICDFYNILFIADEVITGFGRTGTMFGMENWNVVPDAMTFAKGVTSGYIPMGGVVVSDHIHTVLKEKSKGTLFHGFTYSGHPTAAAVALKNIEIIEKESLVTNAKERGLELQNGFQKIKKESSIVGEVRAIGLIGAIELMQDSATGQPFTPDVGVTPAVINALHERGVISRGVTYDGSNILCFAPPLIITKQEVNELISRISDAILFVQHQLGVSQNY

SEQ ID NO: 34035 - protein, 484 aa, Oceanobacillus iheyensis HTE831
MAELKAITTYQMYINGEFVNASNNETLEVTNPATEEIVSTVPKASLEDTRRAIDGSAKAQKDWANLPSSKRASYLFAISKEIRSNIDEYAKIISEEMGKPLDQAVVEVSVTADYFEYIAGWARKYEGEIVPSDREKENILVFKQPIGVVAGILPWNFPFFLIARKAAPAILTGNTIVLKPSSVSPNNALAFAKILDKVGLPKGVINIVTGAGSIVGEELSKNEKIGMISLTGSTEAGSRVMEKASKNITKVSLELGGKAPSIVMEDADIDLAVKSVLDSRIINTGQVCNCTERVYVHEDVADEFIEKITKAMSNVSYGNPLGNEQIDMGPLSNEAGLKNVEDMVKRAVENGATVLTGGNRVNTEAGYYYEPTVLSNVDNSFEIMKEEVFGPVLPIATFTSLDEAIELANDCQYGLTSAIFTNNVNYMMRASNELEFGETYVNRESFEAIQGFHAGWKKSGIGGADGKHGLGEFLQTHVVYIQYK

SEQ ID NO: 34036 - protein, 135 aa, Zea mays
MRVHRIVSLLAALLVLLALAAVSSTRSAQEESVADNAGMLAGGIKDVPANENDLQLQELARFAVNEHNKKANALLGFEKLVKAKTQVVAGTMYYLTIEAKDGEVKKLYEAKVWEKPWENFKQLQEFKPVEEGASA

SEQ ID NO: 34037 - protein, 640 aa, Corynebacterium efficiens YS-314
MCGLLGILSANGNAADYVPALQRALPCLHHRGPDEAGTWQDGDLAFGFNRLAIIDIAHSHQPLRWGPEGEPERYAMTFNGEIYNYIELREELTALGYAFETEGDGEPIMVGFHHWGADVVNHLRGMFAIAIWDTVDRSLFLARDQFGIKPLFYATTGVGTVFSSEKKAILEMAEELNLDLSLDRRAIEHYVDLQYVPEPETLHTGIRRLESGCTATIIPGGELVEKRYFTPRFPVKSVPKGREQDLFDRIARVLEDSVEKHMRADVTVGSFLSGGIDSTAIATLAKRHNPNLLTFTTGFEREGYSEVDVAAESAAAIGVEHIVKIVSPEEYANAIPKIMWYLDDPVADPSLVPLYFVAAEARKHVKVVLSGEGADELFGGYTIYREPLSLAPFEKIPTPLRRGLGRLSRVLPEGMKGKSLLERGSMTMEERYYGNARSFNFEQMQRVIPWARREWDHREVTAPIYAQSRDMDPVARMQHLDLFTWMRGDILVKADKINMANSLELRVPFLDKEVFKVAETIPYDLKIANGTTKYALRKAMEQIVPPHVLHRKKLGFPVPMRHWLAGDELFGWAQDTINESQTDEIFNKKAVLEMLNEHRAGVSDHSRRLWTVLAFMVWHGIFVENRIDPQIEQRDYPVEL

SEQ ID NO: 34038 - protein, 567 aa, Bacillus licheniformis ATCC 14580
MNNMRRTKEGHLETSLRGKDVLSIPTLNKGVAFSLEERKNLGLEGLLPPTVLSLDQQAERAYEQFSRQPDRLRQNVYLNDLQNRNEVLFYKLLQNHLREMLPVVYTPTVGEAIQEYSHEYRRPHGVYLSIDDMDGIETAFKNLQASADDIDLIVATDSESILGIGDWGVGGINIAIGKLAVYTAAAGIDPSRVIPVVLDVGTNNEKLLNDPLYIGNRHPRVEGERYEQFIDAYVETALKLFPNALLHWEDFGNKNARNIMSKYNHKIATFNDDIQGTGAITLAAILAAVKKTGTSLKDHRVVIFGPGSAGIGIADQIRDTMVLEGLSEEEANRAFWTVDYRGLLTTGMDQIMDFQEPYLRDTEEVKDWKRNEKGEISFEEVIRQVKPTILIGTSGVAGAFSEEIIKEMAAHTERPVILPMSNPTHLAEAVPEDLFKWTDGKALVATGSPFEAVEYNGVKHEIGQSNNAFVFPGLGLGTIVAKAKVITNGMFAASANAVANMVDHEKPGAGLLPKIDDLQDVSVQVAIDVVKAAIKDGVAQVQPEDVEKAVREAMWRPEYKTIVAKQD

SEQ ID NO: 34039 - protein, 339 aa, Glycine max
PPPQKKKKKGLTRRKNLPLTVYNKLSIAVAFSLPLRIFFFFFSSNPKSWPRKLTTKVIELNTLKAMAQSHGSILTRSVWSSNLESEFDLIRSVIDSFPLISMDTEFPGVVVRPDAGDPSFRHRQPVAHYAVLKANVDRLHLIQIGLTLSDNAGNLPTLGTSNAFIWEFNFKDFDVARDAHAHDSVELLRRQGIDFEKNRDFGIDSFRFAELMMSSGLVCDDAVSWVTFHSAYDFGYLVKLMTHRTLPEELREFLRLVRVFFGDRVFDVKHLMRFCSNLHGGLDRVCQSLKVERVIGKSHQAGSDSLLTLHAFQNIRENYFDKADGLVQYAGVLYGLEVF

SEQ ID NO: 34040 - protein, 81 aa, Triticum aestivum
  misc_feature (59)..(59): Xaa can be any naturally occurring amino acid
  misc_feature (77)..(78): Xaa can be any naturally occurring amino acid
MTIYLAREASKVWRKVCAETTTELPMLREKWPLLLAGIVFQYIHGLAARGVHYLHRAGXCSKNWELRALQNLGKAKXXLRE

SEQ ID NO: 34041 - protein, 312 aa, Pseudomonas fluorescens Pf-5
MYLVCGEALFDFFSADEAGAPASKVAFQAIAGGSPFNVAVGLRRLGVDVALLAGVSRDYLGQRLRRVLENEGVDTRYLREFDAPTTLAMVAVGADGSPHYSFRGEGCADRQLQEEHLPQLDAQVRGLHIGSFALVVQPIADTLLALVRRERGQRLISLDPNVRLNPQPDIQLWRQRIAELAGHADLIKVSDEDLAQLYPGQAPETLIRGWLQGNARLVFLTRGSQGATVFSRGHGSWSVDAPRVEVADTVGAGDTFQAALITWLTEQGLDSPQGLEQLDREQTDALLRFAVNAAAQTCTRTGPDLPYRHQLP

SEQ ID NO: 34042 - protein, 113 aa, Zea mays
  misc_feature (101)..(101): Xaa can be any naturally occurring amino acid
GADQAVRQPFQSRFDLLLLLAGPNTTRLASKLARGPTVIMASSETAVAPFKGLKSAAGFPVSRRRTRSLGNLRNGGGIRSMQVWPAYGTKKFKTLSYLPPXLSTDNLLKQVDY

SEQ ID NO: 34043 - protein, 96 aa, Solanum melongena
SGGGGGGNGGNGQGRCPRDALKLGICANVLNLVNVTVGAPPTLPCCSLLQGLVNLEVAACLCTAIRGNILGLNLNVPVAISIILNNCGMNNSGFTC

SEQ ID NO: 34044 - protein, 145 aa, Prosthecochloris aestuarii DSM 271
MDKTPASLPENIVIFDGVCNLCEFSVNFIFERDAAGQFYFTPAQSPLGASLLKRFDINTSRLDTVVLVRGDRAFTRSAAAIEIASRLDMPWNLLAVFLAVPEPLRDMIYDLIAQNRYQLFGKKETCMLPSEELRKRFLEQIPEAS

SEQ ID NO: 34045 - protein, 497 aa, Oryza sativa (japonica cultivar-group)
MGKAARWFRNMWGGGRKEQKGEAPASGGKRWSFGKSSRDSAEAAAAAAAAAAEASGGNAAIARAAEAAWLRSVYADTEREQSKHAIAVAAATAAAADAAVAAAQAAVAVVRLTSKGRSAPVLAATVAGDTRSLAAAAVRIQTAFRGFLAKKALRALKALVKLQALVRGYLVRRQAAATLQSMQALVRAQATVRAHRSGAGAAANLPHLHHAPFWPRRSLVRRWLNLADDIAMYMFDVDVVCWRWMQQERCAGDDTRSEHGVAAYSRRLSASIESSSYGYDRSPKIVEVDTGRPKSRSSSSRRASSPLLLDAAGCASGGEDWCANSMSSPLPCYLPGGAPPPRIAVPTSRHFPDYDWCALEKARPATAQSTPRYAHAPPTPTKSVCGGGGGGGIHSSPLNCPNYMSNTQSFEAKVRSQSAPKQRPETGGAGAGGGRKRVPLSEVVVVESRASLSGVGMQRSCNRVQEAFNFKTAVVGRLDRSSESGENDRHAFLQRRW

SEQ ID NO: 34046 - protein, 430 aa, Staphylococcus aureus subsp. aureus MW2
MAFEFRLPDIGEGIHEGEIVKWFVKAGDTIEEDDVLAEVQNDKSVVEIPSPVSGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVTLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 34047 - protein, 313 aa, Glycine max
  misc_feature (95)..(95): Xaa can be any naturally occurring amino acid
  misc_feature (170)..(170): Xaa can be any naturally occurring amino acid
  misc_feature (269)..(269): Xaa can be any naturally occurring amino acid
MNLLSLTLPLPLFCSSLSVTRLPSFPSSYKCTSGAVLRRCVKEEKEEEQLLEGMPKEYYDDEWQAQQREKTKELHRLRIQEEEEEERKIGEYREXIGMRLKEYPEDDVIKARKLVSSFLRAAEEVEERIEEAAEKGELTELVLMVIWNRLDLARRDEKKDAIRSLDLLYXRVETEILKREATPAMRLLNDLLIMYDGYNFEEWLKKCKKVMIDTFPREDPFSILVPPGFESFDIDKHHGPLRPSLEVDNTLLRVDFVREVDELLQEVRXEESEVHNEPGFDAESVANRLKQQEKQQTIRQVEALLDLAIGLNW

SEQ ID NO: 34048 - protein, 525 aa, Oryza sativa (indica cultivar-group)
MASLARRRAAEAALLRRAPAAAWAWRGYAAAAAGEESDVVVIGGGPGGYVAAIKAAQLGLKTTCIEKRGTLGGTCLNVGCIPSKEVMNHFDPFYLAVPSIYYELRSTMGALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIGLEMGSVWNRLGSEVTVVEFASDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 34049 - protein, 420 aa, Bordetella bronchiseptica RB50
MDEIQSIVIVGAGQAGAVAAASLRQLGYRGGLTLIGQEAHPPYERPPLSKAVLQGTATHAEAAVHPAGFYAENDIALLTETAVAALDPIARTVRLADGRTLPYDRCLLATGGHARELPALPRGRAGVHYIRTLNDALDLRAALRPGVRAAVIGGGFLGLEVASTARELGAEVTVIENGSRLLERALPAIVSDWLAERVRASGVDLRLGGAIAAIGDGPPYAITLADGTQVNADLIVVSIGLAPEVTLARQAGLPLDDNGGICVDAQARTADPHVYAAGDCASQPRACLGTAARFESWQNANEQARAAAAAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAVAVA

SEQ ID NO: 34050 - protein, 453 aa, Synechococcus sp. CC9311
MEQSFDLVVLGAGSGGLAAAKRAASYGAKVAIVEGDRVGGTCVIRGCVPKKLLVYGSLLSEQLEGASSYGVSVEGARFDTSVLLRNVRHEVDRLNARHIEFLAKAGVELVTGWGRFLDPHRIGVSREREGEIDQVLQAKRVMISVGGRPVRPDVPGAELAWVSDDMFLQERFPDQVVVVGAGFIACEFAGILRGLGVGVTQLVRGEQLLRGFDSELSGVVLEGMQEKGINLRFGQGLAAIEGRPKDLTVVTKSGDRLPCGGVLLATGRQPFLSGLGLDAAGVVVEGRRIPVDADLATNHSHIFAVGDVTDRICLTPVAVDEGRAFADSVFGSTPRQVNYDLVASAVFSQPELATVGLSEEEAIAKLGADQVVVHRARFRSMAQALPQQGPRCLLKLVLEASSKKVLGCHMVGEHAAEIIQMAAIAVGMGATKADFDRTMALHPTVSEEFVTMA

SEQ ID NO: 34051 - protein, 328 aa, Oryza sativa (japonica cultivar-group)
MGSDFKAIPLIDISPLVGKIDDPSMVNDEDLLQVVQMLDDACREAGFFYVKGHGIADSLMKQVRDVTQKFFQLPYEEKLKIKMTPQSGYRGYQRVGENITKGKPDMHEAIDCYTPIEPGKYGDLAKPMVGSNLWPKYPSNFDVLLENYISLLRDLSRKIMRGIALALGAPVDAFEGTTAGDPFWVCRLIGYPVSTDIPEEQRTDTGCGAHTDYGLLTLVNQDDDICALEVRNQSGEWIYAKPIPGTFVCNIGDMLKVWSNGIYQPTLHRVVNNSPRYRVSVAFFYESNFDAAVEPVEFCRERTGGVAKYEKVVYGEHLVQKVLTNFVM

SEQ ID NO: 34052 - protein, 298 aa, Campylobacter jejuni subsp. jejuni NCTC 11168
MDKNIIIGAMTALITPFKNGKVDEQSYARLIKRQIENGIDAVVPVGTTGESATLTHEEHRTCIEIAVETCKGTKVKVLAGAGSNATHEAVGLAKFAKEHGADGILSVAPYYNKPTQQGLYEHYKAIAQSVDIPVLLYNVPGRTGCEISTDTIIKLFRDCENIYGVKEASGNIDKCVDLLAHEPRMMLISGEDAINYPILSNGGKGVISVTSNLLPDMISALTHFALDENYKEAKKINDELYNINKILFCESNPIPIKTAMYLAGLIESLEFRLPLCSPSKENFAKIEEVMKKYKIKGF

SEQ ID NO: 34053 - protein, 187 aa, uncultured archaeon GZfos37B2
MAQMVNKHDVKKRMRQLAAEYIHEPQQEAYKLDDTEMMLHIGPQNPIQPGPFLIDLKISGETVRDSKLYMGYGHKGIEKILESMTYIQGLPVTDRICYLASLSNNEAYVSSVERLLDIEPPERSQYIRVIMQELSRIQSHLLGTGEYATDLGFVTMFLFMIREREYVLGLIEDITGARITHCFPRFG

SEQ ID NO: 34054 - protein, 411 aa, Corynebacterium efficiens YS-314
MAPPDFYAPSLAIIPLPETTPPVNPPALRDHLLKLVGSRCNLNSMTSIEFTVTRTENPTSPDRLKEILTAPKFGKFFTDHMVTIDWTEDGGWHNAQVVPYAPIPMDPATTVFHYGQAIFEGIKAYRHADGTIKTFRPEENALRMQRSAARMAMPELPVETFIKSLELLVDIDQDWVPAAGGEASLYLRPFMISTEVSLGVSPANAYKFIVIASPVAAYFSGGIKPVSVWLSEDYVRAAPGGTGAAKFAGNYAASLLAQAQAQEKGCDQVVWLDAIEHRYIEEMGGMNLGFIYRNGDNVKLVTPELSGSLLPGITRDSLLQVARDLGYEVEERRISTTEWEEDATSGAMAEAFACGTAAVITPVGTVKSNHGEFVVNNNEAGEITMKLRETLTGIQQGKVDDTHDWLYTLVK

SEQ ID NO: 34055 - protein, 357 aa, Medicago truncatula
MDLDDFRSILHTAGVDVWMFIDTAISVAAQDNAGELKRRRDGIVERLYAASTEGIPMCQNCDGGQRLVTNDNQIKKENSPSLSPERQPRRGGASSPPTPQSEGNEDGEDEEIDPYGGLFDDEQKKILEIKELLEDPHQSEDTLMELLQNLVDIDITFQELKETDIGRNVNQLRKHPSSDVRRLVKLLVKKWKEIVDDWVKQNPQRGKSTLMADGDSPLQKTTPNGHNHQIPDFAYSPNPHNGSSGSDRNTSEAEPKPKPKSVPRKDPPPKPRPSPPVTAPTSAPQNRQREQKESNFDAERLAAARKRLQANYKEADNAKKQRTIQVMDIHELPKSKAKSGYFAKHKGGGSSQGRQHW

SEQ ID NO: 34056 - protein, 567 aa, Corynebacterium efficiens YS-314
MAFSVEMPELGESVTEGTITQWLKAVGDTVEVDEPLLEVSTDKVDTEIPSPVAGVILEIKAEEDDTVDVGGIIAIIGEEGEEGAESTEAPAEQEEAPAEEAPKEEPKKQAPASSGAATDVEMPELGESVTEGTITQWLKAVGDTIEVDEPLLEVSTDKVDTEIPSPVAGTIVEILAEEDDTVDVGAVIARIGDANAAPAEDAPAEEEAPAQNEAPVEETPDVTKDEAKKVEQDEPKAEKAEKKSEPKAAPQKTNTDNVPYVTPLVRKLAEKHGVDLNSVKGTGIGGRIRKQDVLAAASGESAPAEKEAASAAPASAASTKSVDPEKAKLRGTTQKVNRIREITARKTVEALQISAQLTQLHEVDMTRVAELRKSNKPAFQEKHGVNLTYLPFFVKAVVEALVAHPNVNASYNAETKEMTYHASVNMSIAVDTPAGLLTPVIHNAQDLSLPEIAKAIVDLADRARNNKLKPNDLSGGTFTITNIGSEGALSDTPILIPPQAGILGTGAIVKRPVVITEDGIDSIAIRQMVHLPLTYDHQVVDGADAGRFMTTIKDRLETANFEGDLEL

SEQ ID NO: 34057 - protein, 170 aa, Glycine max
  misc_feature (142)..(142): Xaa can be any naturally occurring amino acid
  misc_feature (146)..(146): Xaa can be any naturally occurring amino acid
  misc_feature (156)..(156): Xaa can be any naturally occurring amino acid
  misc_feature (163)..(163): Xaa can be any naturally occurring amino acid
MKRHWRNWSHDDEGEGLPDSDSDTRSSRRFSLTRLMAIFLFSLFLFSLIFLLPHPPIQSASTAKTLHQFKQTQQGNVADSVELHKDKLLGGLIADGFDEQSCLSRYHSVTYSKGLSGNPSSYLISRLRKYEALHKECGPYTXTYNXTVKDLRSGHXSESPALXYVVWISY

SEQ ID NO: 34058 - protein, 366 aa, Brassica juncea
LQAVCYVLVRPMSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLQSGLQRLNDFPRPFWLALFVEGTRFTEAKLKAAQEYAASSELPVPRNVLIPRTKGFVPAVSNMRSFVPAIYDMTVAIPKTSPPPTMLRLFKGQPSVVHVHIKCHSMKDLPEPEDEIAQWCRDQFVAKDALLDKHIAADTFPGQKEQNIGRPVKSLAVVVSWACLLTLGAMKFLHWSNLFSSWKGIALSAFGLGIITLCMQILIRSSQSERSTPAKVAPAKPKDNHQSGPSSQTEVEEKQK

SEQ ID NO: 34059 - protein, 687 aa, Aspergillus oryzae
MARSYWKIGKNQSDKVLIDLDKNPDRFGKSSRQSKLLWGWCLRPGVVTTNQRPADVKKLVEGQGAKFCTTVTGDCTHFVTTQREVDNNNSKYKQACNVYDCNIVSIDWLLESIDAKKPIPEKPYLLNRKDAKSDDKKDDEKNDKKEKKKRTLEEALDVSEESSNKKAKDAQKLGSKTLNVPVDEGCYLSGFAVYIDPAGLIWDATLNQTVSANNANKFYRIQLLVDRSGTNFKTWTRWGRVGETGQHGLLGSGALSEAQLQFQKKFKDKSGLSWDDRLDPPKKGKYTFIERNYEEDSDEEDGDDKGTAKKNDEEKPEVKSELPEQVQDLMSFIFNPSHFMNTMASMDYDAKKLPLGKLSKRTLRQGFLKLKELSELIADPNLAATQYGTTYNAAAEDLSNQYFTTIPHVFGRNRPPVLNSDQHIKKEIELLEALTDMEVANGIMKESKDADTIHQLDRQFQSLKMQEMTPLDHSSTEFIELENYLNQSRASTHHFRYNVVNIFRIERDGENDRFNSSKYGKIKNSDRRLLWHGSRSTNFGGILSQGLRIAPPEAPVSGYMFGKGVYFADMSSKSANYCCSYNSGGMALLLLCDVELGDPMLELDHSNYNAGEDAKRDGKIATLGKGRTVPAAWKDAGSVNPQLQGVKMPDVSASSKSANAQSLMYNEYIVYDVAQIRQKYLFQVHMR

SEQ ID NO: 34060 - protein, 814 aa, Mesorhizobium sp. BNC1
MTQKLVVVGAGMASGRMLEHLFEAAPGAFDVTLFGAEPRGNYNRIMLSPVLAGEKTYDQIVTHDAEWYAANDVHCRFGETVTKIDRKAKVVFSRSGETPYDKLVVATGSAPFIIPIAGKDLPGVRAFRDLDDVDAMVAAAGRPGAKAVVIGGGLLGLEAAAALRLRGMDVVVLHLMGHLMERQLDPAAGYLLQKELEGRGIKIHCKAQTKAILGDAQVEAVLLEDGTIYPADIVVMAVGIRPEVRIAVDAGLYVERGIVVNDQMVTSDPDILAIGECVEHESICYGLVAPLYEMAKVAAKTLVKQDAAFRPVETATQLKVTGVTLYSAGDFADAEDREEIVLRDASAGVYKRLVLKENRILGAVLYGETSDGAWFFDMLRKGTDVSEMRETLIFGQAYQGGGQLDPMAAVAALPDDAEICGCNGVCKSKITGTIQEKGLTTLDAVRAHTKASASCGTCTGLVEQLMKLTLGDAFNPAAVTPMCGCTDLGHDDVRRLIKASRLKTIPAVMQELEWKTSCGCAKCRPALNYYLVCDWPDEYADDYQSRFINERVHANIQKDGTYSVVPRMWGGVTSAAELRAIADVVDKFNIPTVKVTGGQRIDMLGIKKEDLPEVWADLGKAGFVSGHAYAKGLRTVKTCVGSDWCRFGTQDSTGLGIRIEKFMWGSWTPAKVKMAVSGCPRNCAEATCKDVGVICVDSGFEIHFAGAAGLDIKGTEKLGLVRSEDEALEVIVALTQMYREQARYLERIYKWAKRIGYDEIRRQILDDPEKRKAYYDRFVFSQKFAQVDPWSERASGKDKHEFKPMATLTLEAAE

SEQ ID NO: 34061 - protein, 942 aa, Mesorhizobium sp. BNC1
MKVDNEQLAEVRTTCPYCGVGCGVIATPQPDGTVAIKGDPDHPANFGRLCSKGSALAETIGLEERLLYPDIHGRRAGWDEALTLVAQRFSDAIKEHGPDSVAFYVSGQLLTEDYYVANKLMKGFIGSANIDTNSRLCMASSVAGHRRAFGADTVPGTYEDLELADLVVLVGSNLAWCHPVLYQRLAAAKDKRPEMKVVLIDPRRTMTADIADLHLAVAPDGDAALFTGLLGYLDITGALSRDYIENHTNGFNEALAVARAFNTERVALESGLAASEVLAFFDLFVGNERTVTVYSQGVNQSVSGTDKVSAIINCHLATGRIGRPGMGPFSVTGQPNAMGGREVGGLANMLAAHMDLENSWHREIVRRFWRAPRLAEKSGFKAVELFRAVADGRIKALWIMATNPADSLPDADFVQAALKACPFVVVSDISAATDTLRHAHVKLPSAGWGEKNGTVTNSERRISRQRPFLPLPGEARPDWWQVVEVARRMGFAEGFAYSTPAEIFREHAALSAYENDGARDFDIGVYAGLSAPAFEALQPFQWPAPSLGSTPLWPAGHLPLKGGNQLSLGPSPIANVADEASELAAGIISPLEGEMAGRPEGGNIRFFADGGFYTPDRRARFIAVFPRVRNVADADFPLVLNTGRVRDHWHTMTRTGQSARLSAHLAEPYAELHPEDAARLGIGDADLVRVESQHGAVIVRALISARQRSGSVFVPMHWTDQFSAKGRVDALVAPITDPISGQPALKNVAVRVSRFEAALYGFAVLQSRPEWDGLDYWALARADGGWRIELAHGALSESPEILLRRLIKSTGKTQILAYHDPKRGDYRLAAFDGERMVGALYLSAHPVAVSRSFAVAQLGSAHPDPCSRYRVVAGRAEADRPEIGAIVCSCFGVGANQIAAAARGGCRTVEAIGRALSAGTNCGSCRGEIRGIVEAHVVEAAE

SEQ ID NO: 34062 - protein, 452 aa, Burkholderia thailandensis E264
MRKMTATHTGPRTSPMPLPTVPTAPFCPAEVKGSITIDAGVSGLAKLRRFAGPGLLVAIGYMDPGNWATDIQAGSQFGYALLWVVVFSSVAAIFLQMLAARLGLVAGRDLAQASYERYGPFGRIVQWVTAEVSIIACDIAEVLGCALAFKLLLGVPLAWGIVLTALDTMIVLGLQGKGFRQVEAIVLGLIGTMAFCFVAQVAMVPPDWRAVLHGLAPGLPGHDRKDAVVLALGIVGATIMPHNLYLHSSVVQTRRVVGGVGDVIKETLAMVRIDTWISLAVAMLVNAAILILAGAAFHASGQTGVVDIEQAYKLITPIVGGAAAWLLGIALLASGQSSTLTGTIAGQVIMDGFLRMKIPCYQRRLITRGLALMPALVGVLWLGDGAVGRLLVWSQVLLSLQLPFAMWPLIRSVGDRSVMRDYTIGRGAKIIAWALFVLISGTNLLLVAGFAG

SEQ ID NO: 34063 - protein, 178 aa, Zea mays
MAGATTPASGALVRLCLPSLLLFLYRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 34064 - protein, 492 aa, Mycobacterium avium subsp. paratuberculosis K-10
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATAIVADWPTNDARFLFHPAMKELTLDIASLVFMGHEPGTDHDLVTTVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESARLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 34065 - protein, 127 aa, Shewanella sp. ANA-3
MKSIIHAERAPAAIGPYSHGTSYGNLIFTSGQLPVCKEKGGVVEGGISEQSVQCLENLKYVIEAGGGSLETVLKTTCYLSEISDFAAFNEVYKTYFKTDCPARSCFAVKDLPLGVKVEVEAIAHVHA

SEQ ID NO: 34066 - protein, 514 aa, Triticum aestivum
MEITINSLTYKGSIPDAINQSRREKKLFVIYISGQDETSSSLEQSTLVDEHVAAVISRCCIFLQLKQGDVDALQFSAIYPQKSVPSISVVGLNGAMLWNHEGYISPEDLKESIDKAWAALQLQETAATLLAASLASRMSEPANTASTTMPGEDGSSTSENHSNSSGQSSESSAVRGFANSTALVAQPPSSTSHAELLKTSKIPKSDSAPCNITAEEKLDSACQALLPDFPASSNVDSSTDPNQTGSTPSPKRKNMVDGNSPKVPSKPASSIPTRSTPQLPVEQDKATTSRAIEVTTDSAKTDDIQLAIRMPDGPSLQIKLTKEDVLRKVKTFVDENQDSGIGSYNLAMLYPRKVFTEQDLETTLYELGIETRQALVVVPNRQSVKVARHQSSLPSSDLDRTGATDRSGGWGFLGAALSYVNPLSYLRGNPTPSNPDRLGNEGSQQYRPNSESQPLRSDGSQQTATHSSGNTLRRRPRQFGGNIHTLSSEEQDPSDNRNVFWNGNSTEFGGDEKK

SEQ ID NO: 34067 - protein, 477 aa, Corynebacterium efficiens YS-314
MAFNTPEEVTKFIKDENVEFVDVRFTDLPGIEQHFSIPASALDEDAIEEGLAFDGSSIRGFTTIDESDMNLLPDLATAKIDPFRKAKTLNIKFFVHDPFTREAFSRDPRNVARKAEQFLASTGIADTCNFGAEAEFYLFDSVRYSTDINSGFYHVDTNEGWWNRGRETNLDGTPNTGSKNRLKGGYFPVAPYDQTVDVRDEMVRNLRDAGFHLERFHHEVGGGQQEINYRFNTLLHAADDIQTFKYIVKNTAALHGKAATFMPKPLAGDNGSGMHAHQSLWKDGKPLFHDESGYAGLSDIARYYIGGILHHAGAVLAFTNPTLNSYHRLVPGFEAPINLVYSQRNRSAAVRIPITGSNPKAKRIEFRAPDPSGNPYLGFAAMMMAGLDGVKNRIEPHAPVDKDLYELPPEEAASIPQAPTSLEASLKALQEDSDFLTESDVFTEDLIEAYIQYKYDNEITPVRLRPTPQEFELYFDC

SEQ ID NO: 34068 - protein, 420 aa, Schizosaccharomyces pombe 972h-
MSGYSPLSSGPADVHIGKAGFFSSVINLANTILGAGILSLPNAFTKTGLLFGCLTIVFSAFASFLGLYFVSQCAARLPRGKASFAAVAKHTFPSLAVVFDASIAVKCFGVAVSYLVIVGDLMPQIAPSLGLSSPMFLRRQTWIVFALFVLTPLSFLKRLDSLRHTSVISLIALCYLVFIVLYHFIIGDTVKGEIRYFVPESGFGYLSVLPVFVFGFTCHQNAFSVINEVRNFSQGFVNFTMFTAIISSTLLYLLVAITGYLSFGSLASGNIIAMYDNTSIWIIGGKLAIVVLVLFSYPLQCHPCRNSVYQAIRRSYSAHDMSDGYHAVITLCILLFTHSLALLLSSLEMVLAFVGSTGSTFISFILPGSLYYFFSHKVASPGNSSPLQLRISRAFAAGLAIYGTVVMILCLNINIAKLSH

SEQ ID NO: 34069 - protein, 152 aa, Triticum aestivum
  misc_feature (86)..(86): Xaa can be any naturally occurring amino acid
ARVVWTISSLIAASARHYLLQPIIADHEMLDSLTLTDADGQGVLTMDKKQLQELRVRPVSVSGNSHRTLMPALIMRLWYAPHIELXPGGVLLKGATLVAIRPSDDVLREGGGVEAAGPAGASWISDAFEEPYRTAAKVLFKRRTYSLEMNSF

SEQ ID NO: 34070 - protein, 377 aa, Hypocrea jecorina
MSPSAVDDAPKATGAAISVKPNIGVFTNPKHDLWISEAEPSADAVKSGADLKPGEVTIAVRSTGICGSDVHFWHAGCIGPMIVEGDHILGHESAGEVIAVHPTVSSLQIGDRVAIEPNIICNACEPCLTGRYNGCEKVEFLSTPPVPGLLRRYVNHPAVWCHKIGNMSWENGALLEPLSVALAGMQRAKVQLGDPVLVCGAGPIGLVSMLCAAAAGACPLVITDISESRLAFAKEICPRVTTHRIEIGKSAEETAKSIVSSFGGVEPAVTLECTGVESSIAAAIWASKFGGKVFVIGVGKNEISIPFMRASVREVDIQLQYRYSNTWPRAIRLIESGVIDLSKFVTHRFPLEDAVKAFETSADPKSGAIKVMIQSLD

SEQ ID NO: 34071 - protein, 870 aa, Salinibacter ruber DSM 13855
MMPASGRPWVVCKFGGTSVSSRARWDTIVEVVRTHRAEGRAPFLVCSALQGISDQLEALCAQLASAEPGAPESTLNTIRERHRALGQDLGVEAEAVLSGEFARLERWVDEIQATDGPSPRQRAAVLATGELLSTRLGAAYLSAQGLPAEWLDAREFLRATDDPHLPPRRQYLAANCTSHADPGLQARLADAPETVYLTQGFIASNALDETVLLGRGGSDTSAAHFAAKLEAERTEVWTDVPGLFTANPGEVPSGRLLRRLDYDEAQELATMGARVLHPRCLDPARRHQIPLHVRSTEAPSLDGTIVSGEGPDVGPQVKAISAKTDITAVSMDTLGMWQEVGFLADVFQVFKHHGLSVDLMATSESNVTVTLDPVANALDPDILDRLLHDLNRYCDAELIDPCAIVSLVGRHIRSLLSELGPAFEVFDEQKVHLVTQAASDLNMSFVVDEDQASRLVRELHAQFFGHRAPDAVFGPRWQELVEDGTPEETPDVWWRERREALLRLADDESPRYVYDPEVVTARSDEVQGLGPIDQSFYAVKANPHPEVLRLLERRGLGFECVSPGELDRVFEACPGLDPARVLFQPNFAAPAEYADAFERGVHVTVDNVQPLAEHPDVFAGEELFVRVDPGQGEGHHRKVRTAGAQSKFGVVPDDLGRLRAAVDQAGATVVGLHAHVGSGITDESTWAGLVDLLASLAAEFPAVRALNVGGGLGVPNASGGRPLDLDALDAALGKAAARHPQYDLWMEPGRYLVAEAGVLLARVTQTKTKDAAAYVGLDTGMNSLLRPALYGAHHEIVNLSRLDEPPAMTADVVGPVCETGDVLGHDRRLPPTEPGDTLLVATTGAYGASMSNRYNLREPASEVMLAPEPA

SEQ ID NO: 34072 - protein, 349 aa, Triticum aestivum
MAPAIAAKPLLSDLVAQSKQVPSSHIRAVGDRPDLANVDHESGAGIPLIDLKQLDGPGRRRVVEAIGAACENDGFFMVTNHGIPEAVVEGMLRVAREFFHLPESERLKCYSDDPKKAIRLSTSFNVRTEKVSNWRDFLRLHCYPLESFVDQWPSNPPAFREVVGTYSTEARALALRLLEAISESLGLERGHMVKAMGRHAQHMAVNYYPPCPQPELTYGLPGHKDPNAVTLLLQDGVSGLQVRRDGRWVAVSPVPGALVINIGDQLQALSNDRYKSVLHRVIVNSESERISVPTFYCPSPDAVVAPAEALVDGGHPLAYRPFTYQEYYEEFWNMGLESASCLDRFRPIA

SEQ ID NO: 34073 - protein, 534 aa, Schizosaccharomyces pombe 972h-
MGRGGKRTWYNGDRREAKRNRPNSIYNGEGRPENLVVGEKKPKRKVACLVGYCGSGYHGMQLNPPSKTIEGDLFDAFVKAGAVSSYNADDPKKVALARAARTDKGVHAAGNVISLKLIMEDEKLIEKVNEHLPPSIRLWDVIRTINSFNPRTYCESRIYEYMVPTYAFVPPKPSSILGNCIMKNSPMPAEPINKENINQLSRSLFYEEGKEFWDDYDIAAKEILSLYEQDPEGFVNPYSKRGAAALANSENNKGSEAGVSAKTNPDMDSDSSAIVNEFLKPDSVEDESAGSKIDPSYRLERALKHIEVLKLKNYRISADRLSVIRETLNQYVGVHNFHNFTVGQAFHQKNSNRVIRSFTASDPFMIGDTEWISCKVHGQSFMLHQIRKMIALAILVVRTGCPVERIQDAFKKTKINIPKGPGFGLLLESPFFKGYNEHKAPENNRDPIDFTKYEQKITAFKHAHIYDKIFLEEARKQVFHCFLSFIDSYNEEDFSYLSDIGITEKTQEVSSKLPDVLSSDEEEDSAENKDDLEG

SEQ ID NO: 34074 - protein, 235 aa, Mesorhizobium sp. BNC1
MTDAKTLKIEAARVALGYVEDGMKLGIGTGSTAEEFVRLLATRVSSGMKIVGVPTSERTAALCRELSVPLSTLDETPELDLTVDGADEVGPDLTLIKGGGGALLREKIVAAASRRMIVIADESKVVDVLGTFPLPIEVNPFGLRATRIAIEAAAARLGLAGEMRTRMAGQEPFVTDGGHFIIDASFGRIQAPRALAEALNAIPGVVEHGLFIGLAGAAIIAGRNGVRTLDAGSRI

SEQ ID NO: 34075 - protein, 460 aa, Mesorhizobium sp. BNC1
MAKYDLDLFVIGGGSGGVRAGRVAASMGKRVAIAEEYRFGGTCVIRGCVPKKLFVYASQFPEHFEDAAGYGWAVGESRFDWATLIANKDKEIARLEGLYRKGLENAGARLIDGRAVLVDSHTVRVGGETFTAEHILVATGGRPNPHVALPGREHCITSNEAFHLEELPASIAIEGGGYIAVEFANIFHGLGVKTTLIYRGREILSRFDGDLRKGLHEAMEAKGIRILCQDIIEQVEKQPDGRLAAHLMSGGVETFDKIMLAIGRVPNTEGLGLEAAGVETGVRGEILVDGYSRTNVENIWAIGDVTDRVQLTPVAIHEAMCFIETAFKDNPTTVDHRDIATAVFSQPEIGTVGLAEEEAGKHFEELEIYRASFRPMRHTLAGRQDKMIMKLVVDAASKRVVGAHILGPDAGEMAQLLGIAIKGRLTKDVFDRTMAVHPTAAEELVTMYQPSYRVRNGERV

SEQ ID NO: 34076 - protein, 382 aa, Nostoc sp. PCC 7120
MNLPSILVIDDLPDNFDVIETLLSEQDYTLHYVASGQEAIASLNLFQPDLILLDVMMPGMDGIEVCQRIKAMPQWQPVPIIMVTALTAKEDLARCLQSGADDFISKPINALELRARLHSMLRIKQQYDKIQTLSNLQTSTIKVLESTLDELRGNLAATLPHELNTPLNGIVGSISILMANIENMDTAEIQELLGWVDLSARNLERLIKQLLTYLELELSTNQQQNIASESTHFSIAAIEAILQSHAPSVNRRDDLMFAIEEAEVSISARYLTIIIHELVDNALKFSRRGTTIKISSQIVAGMLNVYIHDFGRGMTAEQISKIGAFMQFERKTYEQQGIGMGLKLAKQTVESYGGLFSISSVYQQETTVHIALPIAYSRHSSW

SEQ ID NO: 34077 - protein, 103 aa, Oryza sativa
STAPSPFLQNLYHHHHTIIQEMSSRGGKLAPEVNRALFVKNLSYNVTPEELFDLFGKFGPIRQVRQGIANNTKGTAFVVYEDVADAKQACDKLNGFNFQNRYL

SEQ ID NO: 34078 - protein, 686 aa, Candida albicans SC5314
MTSQYNGDTNSTTIDPNNREGGSVIDQSNNLPSSSSSSLNHSHFQKPQVSNLTKNLLSSSGGQTTPVATNVNSNTASNQQNLFTNTPSSYTEPITNRVLPNLKASASQMSNSFSGSFHQSHVHNHNDSINYIPSSHNTPTAVSSSYTSHHSYPASLSSVNNFISQPSQQQQQQPIPLSFKPPGVVPNSIPTTNVHNDTANRFSSVSSTGSPFSNSPFATSTQFQSPASIAQPVHPSSLQQVQQQRFPNSFPNTTVTHFPNPPNLQQSAINRTQHNNNNYNHHHHHQQQPIVTDTSVSTSGSTTPVENQRPAVKSVQSTPSLPHGNQHDQSARSSASSQSFQTYVQPEPDHYMTYSEFLHNLSVKDSQDESAAYEEHLNIVEYPVNDLIVMLSCLLTKIIEANDKLHPNHFENTIAIRQRLKEEKRLKKLQRQNKLQSENDDAYDEDDIDVDRTDRSFHGNNDGMDQDDDSNANVQNNDNIDNDDEEEDDDEDDEMKNKYLANVLAFHGTNIPGISLQSYLGRVLKYCPVTNEVFLSLLVYFDRIAKKANNLNQKKKNSNSNGNSTGGTGSDNQSSEAEQLFVMDSYNIHRLIISGITVSSKFFSDIFYKNLRYAKVGGLPLEELNYLELQFLLLLDFKLMISVEDLQNYGDLLLRFWKREQIANELVPNNNDNETKEHQTQTQTQS

SEQ ID NO: 34079 - protein, 586 aa, Bacillus cereus ATCC 10987
MKQSVSAEQIELKSSLPGSKKVYVDGPREGMKVPMREIEQSDTNGVPNPPIRVYDTSGPYTDPEYKVELEKGLQAPRHSWILERGDVEAYEGREVKPEDDGVKVASKHTPVFPQMDRKPLRAKQGANVTQMHYARNGIITSEMEYVAIREGVEPEFVRKEIAEGRAILPANINHPEAEPMIIGRNFHVKVNANIGNSAVSSSIAEEVEKMTWATRWGADTIMDLSTGKNIHTTREWIIRNAPVPVGTVPIYQALEKVNGIAEDLTWEVYRDTLIEQAEQGVDYFTIHAGVLLRYIPITAKRTTGIVSRGGSIMAQWCLFHHKENFLYTHFEEICEIMKQYDVSFSLGDGLRPGSIADANDEAQFSELETLGELTKIAWKHDVQVMIEGPGHVPMHLIKENMEKELDICQGAPFYTLGPLTTDIAPGYDHITSAIGAAMIGWFGTAMLCYVTPKEHLGLPNKDDVREGVITYKIAAHAADLAKGHKTAHQRDDALSKARFEFRWRDQFNLSLDPERAMEYHDETLPAEGAKTAHFCSMCGPKFCSMRISHDIREYAKENDLETTEAIEKGMKEKAKEFKETGSHLYQ

SEQ ID NO: 34080 - protein, 284 aa, Sulfolobus tokodaii str. 7
MKIIQQFVISDNIFLHLSVLGKLIIFIFSKHLICMECDKVGDLLLTSTYAIAFTGAGISTASGIPDFRGPNGLWKKYSPELATIEYFKKDPKGFWEFYRLRMRGLFTALPNRAHYALAELEKMGLIRAIITQNIDGLHQLAGSRNVIELHGNMRKCYCVNCLKTYDSDTVLDKIDKEGLPPKCECGGVIRPDVVLFGEPVYNISSALEIAREADLVLAIGSSLTVYPANMIPLTVKEMGGKLIILNAEETPLDNIADIVVRERVEEFLPCVVDYIKSQTLHRSS

SEQ ID NO: 34081 - protein, 307 aa, Pseudomonas syringae pv. phaseolicola 1448A
MSFPRVALIGECMIELQQHADGSLRQSFGGDTLNTAVYLARLLGERAKVDYVTALGDDSFSDAMCRIWADEGIGLGKVQRLPGRLPGLYCIQTDANGERRFLYWRNEAAVRDCFMTPAAEPILAALASYDVLYFSGITLAVLGEQGRARLLEALDRARQRGVRVAFDNNYRPRLWASVEQAREAYQACLQHVDLALLTEDDEQALYGYADSEQLLAAYRGRGIGEIVVKRGAQSCLVEAGGERFDIASQKVEHVVDTTAAGDSFSAAYLAARLMGEHPRQAAEAGHRLASVVIQHPGALVPKSVMPV

SEQ ID NO: 34082 - protein, 200 aa, Zea mays
  misc_feature (123)..(123): Xaa can be any naturally occurring amino acid
MRRNLQHNADVHEVQGLPSDDVEVHSTSATKKVARRAKNFSHQEDEVICSAWINGSQDAIIGMNQTSGGYWKRFADYYDKYKPEGSQRTQIAIQHMWKTIQKEVNKFCAYLSKIEHRNESGKXAEDRCMTKNRELVEVKRDEQYRELLARRDRELDLKEQEREFKIAVNIDDVPEDKRAYYLNLQQRIMEKSHRNNNSST

SEQ ID NO: 34083 - protein, 276 aa, Bacillus licheniformis ATCC 14580
MSGLWYTEKQTKNFGITMKINRTLHTEQTDFQKLEMAETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVEVKVDDGFMHIAQSENEYDVIMVDSTEPVGPAVNLFTKGFYAGIAKALKEDGIFVAQTDNPWFTPELITNVQRDVKEIFPITKLYLANIPTYPSGLWTFTIGSKKYDPLEVEDSRFFDIETKYYTKEIHKAAFVLPKFVSDLIK

SEQ ID NO: 34084 - protein, 433 aa, Shewanella sp. ANA-3
MRFESFSFCPEILRAISDCGYQKMTPIQQQAIPAIRRGQDVLASAQTGTGKTAAFALPILQKMVENPSETLKSNARVLILTPTRELAAQVADNVEAYSKYLNFSVLTIYGGVKVETQAQKLKRGADIIVATPGRLLEHLTACNLSLSSIDFLVLDEADRMLDMGFNADIQKILQAVNKKRQNLLFSATFSSAVKKLANDMMVKPQVISADKQNTTADTVSQVVYPVEQRRKRELLSELIGKKNWQQVLVFTATRDAADTLVKELNLDGIPSEVVHGEKAQGSRRRALREFVSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRLDNVSEQIIAEKSMQGRRVKMKVGQAPSKAKKLK

SEQ ID NO: 34085 - protein, 801 aa, Schizosaccharomyces pombe 972h-
MFMLKSLGKYIWGNTNSTEIVQIPYGQLYSVHENYRECMFKDASASIRRTTAEFQYQLVIQRAYEEGEEELEDDGDEAEDEQSFLLDEKLHLRFDVNKDSITIMWDNPDFQDGTLYEFTCENCLQEGVAYTFEMVALQCMYERKYRQSHEKATLADLEQFSNPITRPSKEVDSLENIVTKLDLESEDLMRLKKQEQLDDEIAKKYLLGQQEAEEPLVQQQTSIVNPEKEEVTKTENIKSLEGELMGTISAELHLFDAVEEVFILQDPNVEASVFDLGDWNYWFTISTEEKTWLSQSVDADMNPVFSFEHLSFIWNYFDANSNAFSWLLRFDSQVRMEQFQELLMRALWESLNQQRWLKIDDEQRDYVMETFHEDEELEDSEDEEFARQQLLSRKEEEEEEDEEASDFEDSFADFSDGEADDLDESRWRKEAAKEHNSLLAVGYKNDRSYVVRNNKIGVFKHVDEKGLKFQTALNNLSTPKGKSLRPSKLMLHNQDSSILFQTENAPHSLYHMDIEYGKIVDEWKVHDDVPLVTFTPDNKFAQMTAEQTLIGLSNNSIFRIDPRVEGNKLVAEQFKQYATKNDFSSAATTENGYIAVASNKGDIRLFDRIGVNAKTALPALGEAIIGVDVTASGDFVLATCKTYILLIDTRIKEGRYAGRLGFERNFAKDKKPKPKRLQLSPQHIAMMQRELKGGASFTPAKFNTGIDAKETTIVSSIGPFLISWNLDRVKRGFTDSYKIRRYDANVQAEDFRFGTDRSLIVALPDDVAMVDKSSLRRPTRESICTPVKKLRSKHDIVNAPY

SEQ ID NO: 34086 - protein, 128 aa, Zea mays
  misc_feature (57)..(57): Xaa can be any naturally occurring amino acid
MTDYGEEQRNELEALESIYPDSFTVLSENPPSFTITVTSEAGENDETVQTTLKFTYXKYPDEAPLYEIFSQENLEDNDVSDILKLLALQAEENLGMVMIFTLVTAVQEKLNEIVDQIKTRREEEKKQK

SEQ ID NO: 34087 - protein, 942 aa, Salinibacter ruber DSM 13855
MPKRTDIETILLIGSGPIVIGQACEFDYSGSQSARALMDEGYRVVLVNSNPATIMTDPLMADEVYLRPLTPSSIAQIAREEEPDAVLPTMGGQTGLNVAQDLKKDGFWDEEGIDVIGVDIDTVQITEDRQEFRTLMDDIGLDQSRSDTAKSLLEAKEITQELGGLPVVIRPSYTLGGSGGGIVWKEDEFEEMVTRGLELSPAHQVLIDECLFGWKEYELELLRDPNDNVIIIASIENVTPMGVHTGDSVTVAPQQTLTDKQFQRMRDAAIKAMNSIGTFAGGCNIQFAFEPGTGRMIVIEINPRVSRSSALASKATGYPIAKVASKLAIGYTLDELPNEVTGDTSACFEPSLDYVVTKIPRFNFDKFEGVDEELTTQMKAVGEVMSIGRTFNESLQKAWQSLEIGYAGLGADRPDADRETVRERLTAPRWDNLLHVRHAFRYGASVEEVHDITQIDKWFLYQIKDLVALEEAVRSTPLREMDARFLREIKRAGFSDEQIAFLVPEDVTDREVRAHRTDEDVTPAYQLVDTCAGEFPAETPYYYSSYETVNESTVTDRPKVLILGSGPNRIGQGIEFDYCCVHGVKAAQEMGYEALMLNCNPETVSTDFDVADKLYFEPVFWERVQDVIDLEQPEGVILQLGGQTAIKLGERFEEDGIQVLGTSYSKMDLVEDRGKFTSILQKLDIPFPPYGVAHSVEEALETAGRLGYPTLIRPSYVLGGEGMRIAINEDEVAEYVGNVLETYPDNEILLDRFLEDAVELDVDAICDGDEVWIAGMMQHIEPAGVHSGDSTAVLPPFSLSDEVLDTIREYVRALAFELDVLGLVNVQLIVKDGTVYVIEANPRASRTVPFIAKAAGIPIPAIATKVMLGETLETFRERGDLQSDLEEYAIKEPVFSWDKFPEVPKELGPEMKSTGESIAFVESLDAEQFEQPYEMKDLYLSR

SEQ ID NO: 34088 - protein, 481 aa, Corynebacterium efficiens YS-314
MASSPTTNPDEILKFIRDNDINWVDVQFTDVPGTEQHLSVPAAAFDESAMENGLAFDGSSISGYTTVDDSDMMLLPDLSTAFIDPFRRSKTLNIKFFVHDPYTREPFSRDPRNIARKAEEYLASTGFADSCNFGAEAEFYIFDSVRFSSQSNAAFHEVDSVEGWWNSGSRENPDGSRNLGHKVRQKGGYFPVAPYDHFQDLRDTIGETLAEIGFTVERSHHEMGSGGQQEINYRFNTLLRAADDLQTFKYVVKNTAKAVGKSATFMPKPLADDGGSGMHIHQSLWKDGKPLFHDEAGYANLSEMARHYVGGLLKHAPAVLAFTNPTLNSYNRLVPGFEAPVSLAYSQQNRSAAIRIPASGPNPKATRIEFRTPDPSGNPYLAFTASMMAGLDGIRNRIEPDAPLDKDLYELPPEEAAKVAEAPTSLEQALKALEEDHEFLTEGDVFTDDLIEAYVAYKHEHEITPERLRPTALDFELYYDC

SEQ ID NO: 34089 - protein, 117 aa, Zea mays
  misc_feature (81)..(81): Xaa can be any naturally occurring amino acid
TPRRRALSSCPRRRALSSWSPSPPPQLAAAGVPKHCFRRSADGYLYCEGVRVEDAMAAAERSPFYLYSKLQILHNFAPSIXYNNLPVLRILRELGCGVVLVSSNELRLALEAGFDLA

SEQ ID NO: 34090 - protein, 328 aa, Oryza sativa (japonica cultivar-group)
MASDFKAIPLIDISPLVEKIDDPNMANDKDLLQVVRLLDDACREAGFFYVKGHGIAESLMKEVRDVTHKFFQLPYEEKLKIKMTPQNGYRGYQRLGENITNGKPDMQEAIDYYAPIEPGKYGDLAKPMEGTNLWPKYPSNFDALLKNYISLLRDLSRKIMQGIALALGGPVDAFEGRTAGDPFWVCRLIGYPVSTDILEEHRTDTGCGAHTDYGLLTLVNQDDDICALEVKNQSGEWIYAKPIPGTFVCNIGDMLKVWSNGIYQPTLHRVVNNSPRYRVSVAFFYESNFDAAIEPVEFCRERTGGVAKYEKVVYGEHLIKKVLNNFIK

SEQ ID NO: 34091 - protein, 455 aa, Legionella pneumophila subsp. pneumophila str. Philadelphia 1
MALLSFLKPAPYLDEIQDKNVVKRQYRYWRIRTFYAMYIGYALFYFTRKSFTFVMPALQSTLGMTKTELGMIASILSLSYGISKFLSGILGDKSNPRYLMAIGLILTGVFNILFGLSSTWWLFAIFWGLNGWFQGWGWPGCTKLLTHWYSQSERGRWWSLWNTSHNVGGALIPLIVAVCAQYFGWRSAMFVPGIICILGGVFLINRLRDTPQSLGLPAIEQYHEDFSGSTNHHQEKTELSVKEILWNYVLCNQYIWILSISYLFIYIVRTAINDWSMLYLTEVKEYSLITAGSCVIWFEVGGFFGNLVAGWSSDKIFQGKRNPINVLFTAGVFATLLLFTLTRAYTPFLDALFLFFFGFFIFGPQMMIGMACAELAHKKAAATATGFAGFFAYCLGAVLAGAPLGAIIKNYGWDNFFLTLFVCCLIPLLLMLPLWHVKVNPKYRQSEFSGKSEFA

SEQ ID NO: 34092 - protein, 418 aa, Schizosaccharomyces pombe 972h-
MTEMSIRLFLHLSKEFYDCCGLFLLTFFLLTTCQLRILSLSINAFCVFGASGIYLDKLVNKWFGYEVLDLANSDNALVTGLATSSGILLYSSWASVMQESFHFLEKISMFDTFLVRVFQFCAFFFGGIVFYIFNHFLHKWLHESSQTGFLHDHFSVSDPSPSTAQNHRSPPASCKRLSSCESSGSPSSRVVGSLQGSYCPSGTHLHEGSLLLEDSSARHSSDSVHEYLVKKPSNCDCECHAHFSSFPTHSGTPDDIEHIHSVYTMGIQTALLICLHKVPEGFITFLASTVDTGFMVLVAMSIHNIVEGFTIAYPLYLAWKSRPKAFLTAATLSSCSLPLGSLIAFLVMEAGGIGSSDFLNFLYGIIFAGTAGMMLILSLRVILPEALRHDHSENKRHSFICFTIGILFTLFLEIFDSH

SEQ ID NO: 34093 - protein, 637 aa, Arabidopsis thaliana
MVLPLLRRAAIARTSSLLRARLFAPASEFHSRFSNGLYHLDDKISSSNGVRSASIDLITRMDDSSPKPILRFGVQNFSSTGPISQTVLAMPALSPTMSHGNVVKWMKKEGDKVEVGDVLCEIETDKATVEFESQEEGFLAKILVTEGSKDIPVNEPIAIMVEEEDDIKNVPATIEGGRDGKEETSAHQVMKPDESTQQKSSIQPDASDLPPHVVLEMPALSPTMNQGNIAKWWKKEGDKIEVGDVIGEIETDKATLEFESLEEGYLAKILIPEGSKDVAVGKPIALIVEDAESIEAIKSSSAGSSEVDTVKEVPDSVVDKPTERKAGFTKISPAAKLLILEHGLEASSIEASGPYGTLLKSDVVAAIASGKASKSSASTKKKQPSKETPSKSSSTSKPSVTQSDNNYEDFPNSQIRKIIAKRLLESKQKIPHLYLQSDVVLDPLLAFRKELQENHGVKVSVNDIVIKAVAVALRNVRQANAFWDAEKGDIVMCDSVDISIAVATEKGLMTPIIKNADQKSISAISLEVKELAQKARSGKLAPHEFQGGTFSISNLGMYPVDNFCAIINPPQAGILAVGRGNKVVEPVIGLDGIEKPSVVTKMNVTLSADHRIFDGQVGASFMSELRSNFEDVRRLLL

SEQ ID NO: 34094 - protein, 772 aa, Oryza sativa
MAGGGGKSVAAALAMACFLLILAAFAPPAAAAPPDIMSIIRYNAEHGVRGLERTEAEARAAYDLWLARHRRGGGGGSRNGFIGEHERRFRVFWDNLKFVDAHNARADERGGFRLGMNRFADLTNGEFRATYLGTTPAGRGRRVGEAYRHDGVEALPDSVDWRDKGAVVAPVKNQGQCGSCWAFSAVAAVEGINKIVTGELVSLSEQELVECARNGQNSGCNGGIMDDAFAFIARNGGLDTEEDYPYTAMDGKCNLAKRSRKVVSIDGFEDVPENDELSLQKAVAHQPVSVAIDAGGREFQLYDSGVFTGRCGTNLDHGVVAVGYGTDAATGAAYWTVRNSWGPDWGENGYIRMERNVTARTGKCGIAMMASYPIKKGPNPKPSPPSPAPSPPQQCDRYSKCPAGTTCCCNYGIRNHCIVWGCCPVEGATCCKDHSTCCPKEYPVCNAKARTCSKSVYRMAAAARPVDVVRHFPCSSSVAASSSLLLSRSKSRLASPAAAAASSMRRRLVLGVGAAAAPAVAALAASATPAALRDCAATLLITAGAYSLVRAFDGLTARRLIEQNLSRKIVHVLSGVLFMSSWPLFSNSTEARFFAAIVPLLNCIRLLTYGLRLSTDEALVKSVTREGKPEELLRGPLYYVIVLLVSVLVFWRQSPIGIVSLSMMSGGDGFADIVGRRYGSAKLPFNENKSWIGSISMFISGFLLSALMLFYFSCLGYFTVCWDLALGKLALVALAATVVECIPVNDVVDDNISVPLATMLAAYLLFGYSSCC

SEQ ID NO: 34095 - protein, 537 aa, Mycobacterium leprae TN
MRPYYITTAIAYPNAAPHIGHAYEYIATDAIARFKRLDGLDVRFLTGTDEHGLKVAQAAEAAGVPTAQLARRNSGVFQRMQEALHISFDRFIRTTDADHYKAAKEIWRRMDAAGDIYLGTYSGWYSVRDERFFVDSETKLLDNGIRVAVETGTLVTWTEKEQTYFFRLSAYVDKLLAHYDANPDFIGPEVRRNEVISFVSGGLEDFSISRTSFDWGVQVPEHPDHVMYVWIDALTNYLTGAGFPDTDSELFGRYWPANLHMIGKDIIRFHAVYWPAFLMSAGIELPRRIFAHGFLHNHGEKMSKSVGNIVDPMALVQTFGVDQVRYFLLREIPFGQDGNYSEEAIITRMNTDLANEFGNLAQRSLSMVAKNLGGVVPEPSEFTSADTALLTTADGLLERVRGNFDGQAMNLALEAIWLMLGEANKYFSSQQPWILRKSESEADQARFRTVLYTTCEVVRIAALLVQPVMPESAGKMLDLLGQEEDQRAFTAVSVRLAPGTVLPPPTGVFPRYQPSEIEGADPVKSSSKRREHNKRRE

SEQ ID NO: 34096 - protein, 182 aa, Triticum aestivum
  misc_feature (21)..(21): Xaa can be any naturally occurring amino acid
LPYLDHPWPPTVMASWDTSLXPFQGVKSTAGLPVIPRSNGFILGSVSIGGRIRCMQVWPIEGIKKLETLYYLPPLSTEALLKQVDYLIRSKWVPSLEFSKVGFIFREHNAFPGYYGGLYWTMWKLPMFGCTDATQVINEVEEVNKEYPDAYVRIIGLDNMRQVQCVSFIAFKPPVSEESVKA

SEQ ID NO: 34097 - protein, 393 aa, Candida albicans SC5314
MPVNFLTSVVFDGPEVIPYWDQIKEYGPTVLPILLTLAGAKYYFHGATNTWERDMHGKVFMITGATSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRDVRVLIATCSSQNLGDVDLNDLLWSDKRYPATQPWKVYGTSKLLLGLFAKEYQRQLMGYERKDKAPCNVRINLINPGIVRTPSTRRFLSLGTVWGLIIYLILFPIWWLFFKSAEQGTQSFYFALFAPIFMKIEGGNVVQECKIMTKVRKEYTDDDLQQKVFHNTEELIKQIETKSAIERKKHENAKKTPEQKARKGKRN

SEQ ID NO: 34098 - protein, 166 aa, Synechococcus sp. CC9311
MQAGHHHGGGGHHGGGGHHGGGGHHGGGGHHGGGGHHGGGHHGGGHHGGGWHHGNGWHHNNWGWYPNRRAEWGIAGLATGAIITSAIANSRAQNSPTIIVPETNRNLDYDFQQSSPQPTSVDFTYYVNGIRVNAQANCQQGLINGNQPASAADVHTLNAVCHAASN

SEQ ID NO: 34099 - protein, 433 aa, Synechococcus sp. RS9916
MTAPTLNTSHSQAIFSAAQSLMPGGVSSPVRAFKSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLIRAYTGRDKVIKFEGCYHGHADMFLVKAGSGVATLGLPDSPGVPRSTTANTLTAPYNDLEAVKQLFAENPDAIAGVILEPIVGNAGFITPEPGFLEGLREITKEHGALLVFDEVMTGFRISYGGAQAHFGVTPDLTTMGKVIGGGLPVGAYGGRRDIMEMVAPAGPMYQAGTLSGNPLAMTAGIKTLELLKQPGSYDKLTASTERLINGVMAAAREAGLPITGGSVSAMFGFFLCEGPVRNFEEAKATDSERFGKLHRAMLERGVYLAPSAFEAGFTSLAHSDADIDATIQAFRESFAEIA

SEQ ID NO: 34100 - protein, 175 aa, Triticum aestivum
MAPTVMASSATSVVPFQGLKSTVGLPVSRRSNGASLGSVSNGGRIRCMHVWPIEGIKKFETLSYLPPISTEALLKQVDYLIRSKWVPCLEYSKVGFIFREHNASPGYYDGRYWTMWKLPMFGCTDATQVINEVEEVNKEYPDAYVRIIGFDNMRQVQCVSFIAFKPPGCEESGKA

SEQ ID NO: 34101 - protein, 321 aa, Citrus sinensis
MVIAEVPKLASAAEYFFKMGVEGKRFRPTVLLLMATALNVRVPEPLHDGVEDASATELRTRQQCIAEITEMIHVASLLHDDVLDDADTRRGIGSLNFVMGNKLAVLAGDFLLSRACVALASLKNTEVVTLLATVVEHLVTGETMQMTTSSDQRCSMDYYMQKTYYKTASLISNSCKAIALLAGQTAEVAILAFDYGKNLGLAYQLIDDVLDFTGTSASLGKGSLSDIRHGIITAPILFAMEEFPQLRTVVEQGFEDSSNVDIALEYLGKSRGIQKTRELAVKHANLAAAAIDSLPENNDEDVTKSRRALLDLTHRVITRNK

SEQ ID NO: 34102 - protein, 628 aa, Campylobacter jejuni subsp. jejuni NCTC 11168
MRYITTPIYYVNDVPHLGHAYTTIIADTLARFYRLQGHETRFLTGTDEHGQKIEEAAKLRNSTPQEYADKISFEFKKLWDEFEITYDIYARTTDTRHIEFIKAMFLKMWQKGDIYKDEYEGHYCISCESFFTQSQLINDCSCPDCGKQTRILKEESYFFKLSKYQDKILQWYEEKDPILPKNKKNELINFVQNGLKDLSITRTSFDWGIKLPQEINDDKHIIYVWLDALFIYVSSLDFQNKGENAKFWPAHVHLVGKDILRFHAIYWPAFLMSVDLPLPKFIGAHGWWTKEGEKMSKSKGNVVKPKEVVDAYGSEAFRYFLLREVPFGNDGDFSENMLINRINAELSNEFGNLLNRIIGMSTKYSQGNISKEGVLKFYNAELNQAKEHLNLAVEFLENLQCNRYLEELFKALSVANLAISKYEPWSLIKENKHEQANALVALCANILAKTSLLLSPTLPKSSQKVALALNFEISSANYTKMILDNELLDFKANPCEALFPKVEKALLKQEIKEEPKKEESPKIKIDDFAKIEIKVAKVLDCQNIEGSEKLLKFQLELDDKEIRQVLSGIAKYYKASDLIGKQVCVISNLKKAKIFGHESDGMILSAKSGDKLVLIAPEQLVQNGSLVG

SEQ ID NO: 34103 - protein, 516 aa, Corynebacterium efficiens YS-314
MRGHDRLLQLASVFYFSRCHRVNQAGRTPTTPTCTIDALTCCFVDHFHPRRGVGACNSPEQVRGLRKLVCMNSQQEFVLSTIEERDIKFVRLWFTDIVGQLKSVVVAPAELESAFEEGIGFDGSAIEGYARISEADTIARPDPSTFQILPKEVETSRLQAARMFCDVTMPDGQPSFSDPRQVLRRQVQLAADEGFICMISPEIEFFLVQSLRTDGRPPVPTDNGGYFDQATFNEAPNFRRHAMLALEEMGIPVEFSHHETAPGQQEIDLRHADALTMADNVMTFRYLIKQVARDQGVAATFMPKPFAEHAGSAIHTHMSLFEGGTNAFHDPDDEFMLSRTARQFIAGILRHAPEFCAVTNQWVNSYKRIVYGNEAPTAATWGMSNRSALVRVPTYRLNKADSRRVEIRIPDSACNPYLAFSVLLGAGLKGIKEGYELEDPAEDDISSLSLRERRAMGYKDLPSSFDHALRLMERSDLVADILGEHVFEYFLRNKWREWREYQAQITPWELRTNLDY

SEQ ID NO: 34104 - protein, 280 aa, Campylobacter jejuni subsp. jejuni NCTC 11168
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 34105 - protein, 491 aa, Bacillus licheniformis ATCC 14580
MNVQTPSEKLVKPFDCQHYINGRYFPSEKGSTFDNINPATQEIIGSVAEGGKKEVDLAVAAARRALNGRWKNMTADERIRIIRKVGDIILERKDELARLETLDTGKPLSLSSTLDIPRAAFNFHFFADFMRGAGTEAYQTDDLAINYAIRRPVGVVGLINPWNLPLLLLTWKLAPCLAAGNTAVIKPAELTPMTATLLGEICHDAGMPDGVVNIVHGFGPDSAGAALSEHPDVDAISFTGETTTGKVIMEAASKTLKKLSFELGGKNPNIIFADADMDEAVSTSLKSSFVNQGEVCMSGSRIYVEREAYDEFLNKFVEKTKKLKVGDPFDPDTNIGALISSEHTERVMNYIELAKREGGNILTGGKRHEGQESGCFLEPTIITGLSRNSRLIKEEIFGPVVTVIPFDDEEEVIAQANDTHYGLSATLWTNDLRRAHRVAGQIESGMVWVNSWFLRDLRTPFGGMKQSGLGREGGIHSLEFFSELTNICIKL

SEQ ID NO: 34106 - protein, 348 aa, Mycobacterium leprae
MQDEGMRIGILTGGGDCPGLNAVIRAIVRTCDARYGSSVVGFQDGWRGLLENRRMQLCNDDRNDRLLAKGGTMLGTAHVHPDKLRAGLHQIKQTLDDNGIDVLIPIGGEGTLTAAHWLSQEDVPVVGVPKTIDNDIDCTDVTFGHDTALTVATEAIDRLHSTAESHQRVMLVEVMGRHAGWIALSSGLASGAHMTLIPEQPFDVEEVCCLVKRRFQRGDSHFICVVAEGAKPVPGSITLRQGGMDEFGHERFTGVAAQLGAEVEKRINKDVRVTVLGHVQRGGTPTAFDRVLATRFGVNAADASHAGEYGQMVSLRGQDIGRVPLEDAVRQLKLVPESRYDDAAAFFG

SEQ ID NO: 34107 - protein, 335 aa, Schizosaccharomyces pombe 972h-
MAIPKVGINGFGRIGRIVLRNAILTGKIQVVAVNDPFIDLDYMAYMFKYDSTHGRFEGSVETKGGKLVIDGHSIDVHNERDPANIKWSASGAEYVIESTGVFTTKETASAHLKGGAKRVIISAPSKDAPMFVVGVNLEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDSVVSTDFCGDNHSSIFDASAGIQLSPQFVKLVSWYDNEWGYSHRVVDLVAYTASKD

SEQ ID NO: 34108 - protein, 345 aa, Medicago truncatula
MQGFPGENEHALSVVGSKPMEWSTVPYNAPRAPGPNGKQRTSSLESPIMLLTGHQSAVYTMKFNPTGSVVASGSHDKEIFLWNVHGDCKNFMVLKGHKNAVLDLHWTSDGTQIISASPDKTLRLWDTETGKQIKKMVEHLSYVNSCCPTRRGPPLVVSGSDDGTAKLWDMRQRGSIQTFPDKYQITAVSFSDASDKIYTGGIDNDVKIWDLRKGEVTMTLQGHQDMITSMQLSPDGSYLLTNGMDCKLCIWDMRPYAPQNRCVKILEGHQHNFEKNLLKCGWSPDGSKVTAGSSDRMVYIWDTTSRRILYKLPGHNGSVNECVFHPNEPIVGSCSSDKQIYLGEI

SEQ ID NO: 34109 - protein, 542 aa, Sinorhizobium meliloti 1021
MIRTVSTNPYGDQKPGTSGLRKKVPVFQQKNYAENFIQSIFDSLEGFEGQTLVIGGDGRYYNREVIQKAVKMAAANGFGRVLVGRGGILSTPAASNVIRKYKAFGGIVLSASHNPGGPTEDFGIKYNVGNGGPAPEKVTDAIYSRSKAIDSYKIADAPDVNLDVEGSQQVEDMTVTVIDPVADYAELMESLFDFDAIRKLIAGGFRVVFDAMSAVTGPYAKEIIEKRLGAPKGSVMNFIPLPDFGGHHPDPNLVHARALYETMMAPDAPDFGAASDGDGDRNLIIGKGIFVTPSDSLAMLAANAHLAPGYAKGLAGIARSMPTSGAADRVAEKLGVGIYETPTGWKFFGNLLDEGLATICGEESAGTGSNHVREKDGLWAVLLWLNILAARKESALEIARKHWATYGRNYYSRHDYEEVDTDAANGLIAALRDKLAALPGKSFGALTVETADDFSYHDPVDKSVSKNQGVRILFKGGSRVVFRLSGTGTSGATLRVYIERYEPDPTRHDLDTQEALADLIAVADEIAEIKANTGRDEPSVIT

SEQ ID NO: 34110 - protein, 662 aa, Sinorhizobium meliloti 1021
MPTTGIPPLGVTRTPDGTRFTVWSHNAARIDLCLFDEAGNTELSRLPMQRDGDVHSIALPDIAAGTRYGLRAEGVYSPDHGLWFDPSKLLVDPYAAQLDRPFRHDQRLTVFGEETADLVPKAILTEVKPLEPRPPLFQAGGLIYEIAVKPFTILHPGVPERKRGTVAALAEPVIIDHLTSLGVSAVELMPVVAWIDERHLPPLGLHNGWGYNPIAPMALDPRLVPGGIEELRRTVEVLHQAGIGVVLDLVFNHSGESDRFGATLSMRGLDNLTYYRHAAGRPGELINDTGCGNTIACDHPVVQRLILDSLRHFVLAAGVDGFRFDLASILGRDMGGFRRDAALFSAISADPILCGRVLIAEPWDTGPGGYQLGNFPHSFLEWNDRARDDIRRYWRGDRHAIGVLATALAGSSDSFSRWGETATRSVNFIAAHDGFTLMDLVSYARKHNEANGEGNRDGHDENFSWNNGAEGATGDPEIAAFRQRDVMALLGTLFTSRGAIMLTAGDEGGRSQGGNNNAYAQDNAVTWLDWSKLDGKLVEHTARLSAMRRRFSVFGDTGFFTGNGDVAWLRLDGEPLTVEDWEHPATDNLVVMLATEDRRQKRPTRLAVVINRSHAPHPFRLPLSLEGEWRDALSDLTVPSFAPARSVTFLVEVFESISRKRI

SEQ ID NO: 34111 - protein, 131 aa, Glycine max
MAMNHARSIRHILTTKEVVGVACQRTFATGKAKKGSKGGAAADAPKASTLSKEVKSSTVVGASILKEGTDPKIQPDSEYPDWLWHLLDKCPALSELRRRNIDTLSYEDLKRFVKLDTRARIKENNSVKAKN

SEQ ID NO: 34112 - protein, 505 aa, Picrophilus torridus DSM 9790
MSDEIKDVRKLEIKYVFELYPVFRRYIKDRKRSRSNDYNYDIERHGLRAVNTFIRLGPTFIKLGQVLSARPDLMPKEYLKAFEMLQDNVPPDPFEKAYEIIKRNIDVNELNDLNKNAISGASLGQVYRLKYHGRDAIIKVNRYNINYILKRDIIIIKRLLRIARHFMDNFLYISIYNVIEDFSTRIYEEANYEIEANNLERIKNNLSYRNDIIIPEVLYVTKEVMILEYRPGIKVTDVKRLKEKNIDLKDLAYRIDLIFLRMLLRDDIFHADPHPGNIAVSDDGNIILYDFGMVGKLDDDTRFELLKLYDGLVNKDPDAIIDSLLSLNALSPAANRGIIRKAIEISIANFSGRDVNEIDIRELLEVANNVIFEFPFHLPRELVLYIRMSSLLEGICKTLDPNFKFVRVLRTILYDEGMLDYLYNRELSEFIKRAVASIEKGLDVLPLMKRRLEEENTKRDKTPLIILAGSIFIAMAVFSARHPLISYIIMALDLILSFYYIRKMH

SEQ ID NO: 34113 - protein, 490 aa, Schizosaccharomyces pombe 972h-
MDSQETKVFENVKQENPDEKKPKVEEPDSQNNASTQSQQKFLDFQLSWCPESERKTTKYHLLKFHSNKAIDPSKSFVPPIKMQRRDPNAPSSSNGEQNAEQGSSSNVNIASIAPYGGAQNMKQNAFKRKTRQVVKVDPQARRLQEEELSPWIMEDFEGKNTWVSTMEGGQSSAYVLFMFSENGFKVIPTDRFYRFNQRNNFQTLSIDEAEAKMNKKTPIPRWFMKKESEENLAEAGSASPMYKLKTVPNARPVTGPRASGSDDELDYDEEFADDEEAPIMEGNEEDNKKLKDKIKKEMLTANLFGEADQDVDLEEENDRQMSREGKKLQRYLKLLEKNLAYESDEEDEDPYASSHDASSEEEVLQEEEELQKREEKLKSRFSANASKTNTPRPLERTPSSVSPVKASSQLQSPNTSIQIRPQEQLINKPGYIILRLSSEKLSRFANDFPRMVPSMGSTETSVGDQVEVVGDTTNVPIDGMLKFYIYQKIY

SEQ ID NO: 34114 - protein, 397 aa, Mesorhizobium sp. BNC1
MPDISKRITGIMPSGKDGWEVHFAALTRKLAGENILMLSVGDHDFDTPAGTVEACVEAVQSGHHHYIQLPGLPKLRQALARLSTECTGVDTAPEEVIVTQGGQGALYASCQAVLDPGSHAVIVSPYYATYPGTVRAAGASFTEIETRSEDGFEPRVEAIAAAIRPETRMILINSPNNPTGAVYSRATLEAIAEICRRHDLWLLSDEVYWTLRGEREHVSPRSLPGMKERTLVVNSLSKSHGMTGWRVGWLTAPAEVVKLLISLNIVSSYGMVDFVSRAAVAAVENGHGVQEIAARYGSRRKAFLDEIRGANDIVVRGSEGGMYVMLDISHINPDAEAFAWGLLEAEKVAVMPGPSFGAAAQGHIRISMCQEEPVLREAAMRIRRYIASEITRRDAAE

SEQ ID NO: 34115 - protein, 494 aa, Brassica napus
MGSASKEYEFLSEIGLSSSHNLGNYVGGKWLGNGPLVSTLNPANNQVLPIAQVVEASLEDYEIGLKACEEAAKTWMQVPAPKRGDIVRQIGDALRSKLDYLGRLLSLEMGKILAEGIGEVQEVIDMCDFAVGLSRQLNGSVIPSERPNHMMLEMWNPLGIVGVITAFNFPCAVLGWNACIALVCGNCVVWKGAPTTPLITIAMTKLVAEVLEKNHLPGAIFTAMCGGAEIGEAIAKDTRIPLVSFTGSSKVGLTVQQTVSARSGKTLLELSGNNAIIVMDDADIQLAARSVLFAAVGTAGQRCTTCRRLLLHESVYDKVLEQLLTSYKQVKIGDPLEKGTLLGPLHTPESKKNFEKGIEVIKSQGGKVLTGGKAVEGEGNFVEPTIIEISSDAAVVKEELFAPVLYALKFKTFEEAVAINNSVPQGLSSSIFTRSPDNIFKWIGPMGSDCGIVNVNIPTNGAEIGGAFGGEKATGGGREAGSDSWKQYMRRSTW

SEQ ID NO: 34116 - protein, 708 aa, Glycine max
  misc_feature (248)..(248): Xaa can be any naturally occurring amino acid
MGSGSRSYSANPADYKLLEEVGYGASATVYRAIYLPYNEEVAVKCLDLDRCNSNLDDIRREAQTMSLIEHPNVVRAFCSFVVERSLWVVMGFMAQGSCLHLMKAAYPEGFEEAAIGSILKETLKALEYLHRHGHIHRDVKAGNILLDDNGLVKLADFGVSACMFDTGDRQRSRNTFVGTPCWMAPEVLQPGTGYNFKADIWSFGITALELAHGHAPFSKYPPMKVLLMTIQNAPPGLDYDRDRKFSKXCDQSFKEMVAMCLVKDQTKRPSVEKLLKHSFFKQAKPPELSVKKLFADLPPLWNRVKSLQHKDAAELALKKMPSAEQEAISQSEYHRGVSAWNFDIDDLKAQAALMQDGDDIAEMREEDENKFFSSYKGTADSQFIVDEKNSNNLQQYEFTSQVGSNDIPQCEKRNGSVAEATPSTLENDVGTSKVKTQSVKLGKTQSGPLMPGLVLGHSSSERGRTFERFENENQLAGEKSNRDIRRAPSFSGPLMLPNRASANSLSAPIKSSGGFRDSLDDKSKANLVQIKGRFSVTSENLDLVKDIPVSSVSRRSSQGSPMRKSASVGDWMVDFKQMPIGQSSNDSANINIPASLLVPHLHNLFQQTSIQQDLIMNLLNSLQTAEAIDTSQNGKLPPLPRNSENNGSADTAVSEREQLLLGKISELQSRMINLTDELTYEKLRYVQLQQQLTGLYSQEQNGEREEFA

SEQ ID NO: 34117 - protein, 391 aa, Sinorhizobium meliloti 1021
MAKFCRSNRDSETGGASLKTPAAVLRKSPVERPYAHTRPLSIETIDLAPPGPDELLVKIGAAGLCHSDLSVINGDRPRPVPMALGHEAAGTVEAVGSGVRDISPGDRVVMSFMPSCGHCLPCAEGRPALCVPGAEANGKGTLLSGERRLSCGEVPVNHHLGVSGFADYAVVSRHSAVRIEADLPMVEAALFGCAVLTGVGAVVNTCRVRPGESIAVVGLGGVGLAALLGAIAAGAERIVAIDLAEDKLKLARALGATDTFLAADPDAAENIRQATRGGVDHAIEAAGSVRAFDLAYRITQRGGLTVSAGLAHPSSQISIPAVSLVAEERSVRGSYMGSCVPARDIPRFIALYERGRLPVDRLLSSTGPLEEINEAFDLLDQGRVIRHVITF

SEQ ID NO: 34118 - protein, 447 aa, Mycobacterium leprae TN
MSPPTGRPRLSHDYKENLVPVIEQVGAREILDSRGNPTVEVEVVLIDGTFARAAVPSGASTGEYEAVELRDGDGRYGGKGVKRAVDAVLDEIGPVVIGLNANDQRLIDQELLDLDGTPDKSRLGGNAILGVSLAVAKAAADSAELPLFRYIGGSNAHILPVPMMNILNGGAHADTAVDVQEFMVAPIGAPSFVEALRWGAEVYHALKSVLKKKGLSTGLGDEGGFAPEVAGTTAALDLVTLAIEAAGFKPGADVALALDAAATEFYTDGIGYHFEGMTHTADQMTEFYADLLGSYPLVSIEDPLSEDDWDGWAALTASIGEQVQIVGDDIFATNPERLEEGIGRGVANALLVKVNQIGTLTETLEAVALAHHSGYRTMISHRSGETEDTMIADLVVALGSGQIKTGAPARSERVAKYNQLLRIEEELGDAARYAGDLAFLRYVVETR

SEQ ID NO: 34119 - protein, 284 aa, Zea mays
  misc_feature (168)..(168): Xaa can be any naturally occurring amino acid
  misc_feature (180)..(180): Xaa can be any naturally occurring amino acid
  misc_feature (240)..(240): Xaa can be any naturally occurring amino acid
SESESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKXLPDGVSLEEGAXCEPLSVGVHACRRAGVGAPRRACSWSGAGPIGLGVAAGGRGPFCAPRVVVVDVDNHRLAXWSHSCAADPAVRVSPSAEDLPVEVERSRPPWASVFYVLLDCVRS

SEQ ID NO: 34120 - protein, 457 aa, Rhodobacter sphaeroides 2.4.1
MSADPPRTAGVAEDRLAAFLADETARFERENPRSKEALQRGAQSYLGGVPMHWMKDWPSPFPLVAAEAQGARLTDLDGHRLDDFCLGDTGSMFGHSPAPVARAIRRQARQGLTYMLPTEATFEAGQLLNRTFGDFRWQVALTATDANRFALRVARAVTGRRKVLVFNGCYHGTVDDTMVMLENGRTRARPGLVGMVADLASKAVAVEFNDVAGVEAALATGEIAAILTEPVMTNSCMVLPEAGFHDALRTLSRRYGAVLILDETHTLSSGLGGYGRVHSLSPDILVVGKCVAGGTPTAVWGLTPDLGARFAAYNATRPAGHSGMGTTLSANPMQFACLCATLSEVMTPEAYAHMERGAKRLAKGLAAAIARVGAPWHVVRVGARVEFICAPGPLRNGTEAAAAHQPRLEGAVHLGLLNRGSLIAPFHNMMLVSPMTRTRQIDRLIAAFDAILTDLFA

SEQ ID NO: 34121 - protein, 462 aa, Nicotiana sylvestris
MVASPDNNAADGRTVKNKRPIDEWLPITSSRNGQNGGYSAFHNVTAMVGAGVLGLPYAMSELGWGPGVTVMVVSWVITLYTLWQMVECKKCPGMLAGTCIDDHKLAVSNVFGNKLGLWIVVPQQLVVEVGIDIVYMVTGGKSFQKSIVLVCKDNCKDIKLTYYIMIFASVHFVLSHLPNFNAISGVSLVAAIMSLSYCTIAWGASIVLGVQPDVEYEYRAENTGEGIFNFFSGLGEVAFAYAGHNVVLEIQATIPSTPEKPSKGPMWKGVLVAYIIVALCYFPVAIIGYWIFGNSVSNNILISLEKPTWLIVLANAFVVITLLGAYQLYAIPVFDMLETYLVRKLKFKPTWYLRFMTRNLYVAFTMFVGIIFPFLWGLLGFLGGFAFAPTTYFLPCIMWLSIYKPKRWGLSWTSNWICIIVGVMLTVLAPIGGLRTIIIQAKDYNFFYWDSLSGSLAFGKKG

SEQ ID NO: 34122 - protein, 1327 aa, Mycobacterium tuberculosis CDC1551
MRCGIVVNVTGPPPTIDRRYHDAVIVGLDNVVDKATRVHAAAWTKFLDDYLTRRPQRTGEDHCPLTHDDYRRFLAGKPDGVADFLAARGIRLPPGSPTDLTDDTVYGLQNLERQTFLQLLNTGVPEGKSIASFARRLQVAGVRVAAHTSHRNYGHTLDATGLAEVFAVFVDGAVTAELGLPAEPNPAGLIETAKRLGANPGRCVVIDSCQTGLRAGRNGGFALVIAVDAHGDAENLLSSGADAVVADLAAVTVGSGDAAISTIPDALQVYSQLKRLLTGRRPAVFLDFDGTLSDIVERPEAATLVDGAAEALRALAAQCPVAVISGRDLADVRNRVKVDGLWLAGSHGFELVAPDGSHHQNAAATAAIDGLAEAAAQLADALREIAGAVVEHKRFAVAVHYRNVADDSVDNLIAAVRRLGHAAGLRVTTGRKVVELRPDIAWDKGKALDWIGERLGPAEVGPDLRLPIYIGDDLTDEDAFDAVRFTGVGIVVRHNEHGDRRSAATFRLECPYTVCQFLSQLACDLQEAVQHDDPWTLVFHGYDPGQERLREALCAVGNGYLGSRGCAPESAESEAHYPGTYVAGVYNQLTDHIEGCTVDNESLVNLPNWLSLTFRIDGGAWFNVDTVELLSYRQTFDLRRATLTRSLRFRDAGGRVTTMTQERFASMNRPNLVALQTRIESENWSGTVDFRSLVDGGVHNTLVDRYRQLSSQHLTTAEIEVLADSVLLRTQTSQSGIAIAVAARSTLWRDGQRVDAQYRVARDTNRGGHDIQVTLSAGQSVTLEKVATIFTSRDAATLTAAISAQRCLGEAGRYAELCQQHVRAWARLWERCAIDLTGNTEELRLVRLHLLHLLQTISPHTAELDAGVPARGLNGEAYRGHVFWDALFVAPVLSLRMPKVARSLLDYRYRRLPAARRAAHRAGHLGAMYPWQSGSDGSEVSQQLHLNPRSGRWTPDPSDRAHHVGLAVAYNAWHYYQVTGDRQYLVDCGAELLVEIARFWVGLAKLDDSRGRYLIRGVIGPDEFHSGYPGNEYDGIDNNAYTNVMAVWVILRAMEALDLLPLTDRRHLIEKLGLTTQERDQWDDVSRRMFVPFHDGVISQFEGYSELAELDWDHYRHRYGNIQRLDRILEAEGDSVNNYQASKQADALMLLYLLSSDELIGLLARLGYRFAPTQIPGTVDYYLARTSDGSTLSAVVHAWVLARANRSNAMEYFRQVLRSDIADVQGGTTQEGIHLAAMAGSIDLLQRCYSGLELRDDRLVLSPQWPEALGPLEFPFVYRRHQLSLRISGRSATLTAESGDAEPIEVECRGHVQRLRCGHTIEVGCSR

SEQ ID NO: 34123 - protein, 571 aa, Ginkgo biloba
MEKQKKDCSWNEMNSYKQLEIAGGKRMGIKASDALPLSLPLGLTNKVFFVMFFSAAYFLMTRWREKMAMSTPLHVVSLGELVAIVAQLASFVYLVGFFGIDYVQNAMVGIGDDDFERREELKSRACIDEVVPCSERERETKQVQVQLIKGVAVGENSDEDIAAAVCNGSVASYSLESSLGDCRRAASVRRRALELMTGICLDGLPLEGFDYDSILGQCCEMPVGVVQIPVGVAGPLLLNGLEYMVPMATTEGCLVASTNRGCKAIHMSGGATSILLRDGMTRAPLVRFASAKRAADLKFYLEHPNNAEALSHLFNRTSRFGRLQGIKCAIAGRNVYMRFSCSTGDAMGMNMVSKGVQNVLDYLQNEFPDMDVISVSGNFCADKKATAVNWIEGRGKSVVCEAVIREEVVSKVLKTTVGALLELNMVKNLTGSAMAGAVGGFNAHSSNIVSAVFIATGQDPAQNVESSQCITMMEAANDGKDLHVSVTMPSVQVGTVGGGTQLASQAACLNLLGVKGANAESAGANAQCLAKIVAGAVLAGELSLMSALAAGQLVNSHMKYNRSSKDVKTTT

SEQ ID NO: 34124 - protein, 1310 aa, Phytophthora sojae
MVSRYSTLRADNLETMLNGGLERFYKKYNHLSRKINLQLPTPEVRFENLSFSVQVPAEAGAYGTVGSHLASIFTPWQKVPMTTKHALHPMSGIIKPGSMTLILANPGAGKSTFLKALAGKLQDNKQTEISGQILYSGLRGEEIDLIKLVGLVDQTDNHIPTLTVRETFKFADLCVNGRPEDQPEEMREIAALRTELFLQILGLESCADTVVGNALLRGVSGGERKRVTVGEVLVGGQSLFLCDEISTGLDSAATFDIIKALRTWCKTLGGSVIVALLQPTPEVVEQFDDILMVNEGHMVYHGPRTEILDYFEERGFSCPPRVDPADFLIEVTSGRGHRYANGRVEKRDLAVTSEDFNNLFCQSSIYKKTHEAISKGFNEHQFENAEDFQKAKSVANLARSKQKSEFGLAFIPSTLLLLNRQKLIWLRDPPLLWGKLFEALIVGLVLGMIYFNVSSTYYLRMIFFSIALFQRQAWQQITISFQLRGVFYKQRPRNFFRTMSYAIAETVVQIPVNLSVSFILGTFFYFMSGLTRTFEKYIVFFLVLVCFQHAIGAYMTMLSSLSPSITVGQALAGISVSFFLLFSGNIILADLIPDYWIWMYWFNPLAWALRSNMLSEFSSDRYSPAQSQKFLDSFSISQGTEYVWFGIGILLAYYLFFTTLNGLALHFIRYEKYKGVSVKAMTDNSSEEDNVYVEVRTPGAGDVVQTKARGAGLPFTPSNLCIKDLEYFVTLPSGEEKQLLRGITAHFEPGRMVALMGATGAGKTTLMDVIAGRKTGGRIVGDIIVNGEPKNPANFSRITAYCEQMDIHSEAATIYEALVFSANLRLPPTFSEEERMNLVNETLELLELSPIAGEMVGRLSVEQKKRVTIGVEVVANPSILFLDEPTSGLDARSALIVMRGVQSIARTGRTVLCTIHQPSISIFELFDGLLLLQKGGYTAYFGDLGVDSVKMLEYFESIPGTEQIRPQYNPATYMLEVIGAGIGRDVKDYSVEYKNSELCRSNRERTLELAKASGDFVCHSTLNYTPIATGFWNQLGHLAKKQQLTYWRNPQYNFMRMFLFPLFAIIFGTTFYQLSAGSVKKINSHIGLIYNSMDFIGVINLMTVLEVTCAERAVFYRERMSNYYGPLPYSLSLWFAEVPYLIVVIVLFVTIEYWLVGWSSSPGDYFFFMFVFYLYTSACTYVGQWMSALMPNEKVANVAVGALSCLFNLFSGYLLPRTAMKAGYKWFTYLMPSSYSLAALVGVQFGDNQDIIAVTSGNITTNMTVAHYIEKTYDFRPERKYSFMAGLLVIWVVLQVAIYLTFKYVSHLKR

SEQ ID NO: 34125 - protein, 121 aa, Glycine max
  misc_feature (87)..(87): Xaa can be any naturally occurring amino acid
MLTPFFLFSDRTMQASILHYSLTETVGTNIATVTDAQAKGARGRGRAYVTLLAGNGDYVKGVGGLAKGVMKVKSVYPLVGAVLPDVXEHHRNMVTFQGRIAREGEPVYPAENQTHTAMAYY

SEQ ID NO: 34126 - protein, 329 aa, Cenchrus ciliaris
MAAPAPAGAAASPSPKPQLPSPFAELVKTPSGLEKVVLRGARNCCAEIYLYGGQVTSWKNDNGEELLFLSSKAIFKPPKAIRGGIPICLPQFGTHGNLEQHGFARNRFWSIDNDPPPLPVNPAIKAFVDLILRPAEEDLKIWPHSFEFRLRVALGPSGDLSLTSRIRNTNTDGRPFSYTFAYHTYFFVSDISEVRVEGLETMDYLDNLKAKERFTEQGDAIVFESEVDKVYLAAPSKIAIIDHEKKKTFVVTKEGLPDAVVWNPWDKKAKAMQDFGDAEYKNMLCVEPAAVEKPITLKPGEEWRGRIALSAVPSSYCSGQLDPLKVLHG

SEQ ID NO: 34127 - protein, 501 aa, uncultured archaeon GZfos37D1
MIRHITSEEMAALDENCKFYGLIPLQLMENAGANVANEIKKRFSGEGTSVTVVAGKGNNGGDAFAAARHLHGFDVKILLLGRSKDLRTEETSRNMRILKENGFDIVEITDSSELKTLYRSEVIIDAIFGTGISGKIREPEATAINLINDANAFVVAVDVPSGLDPDTGEAEKAVRADLTVTFHSAKRGLLNAKEYVGELMVADIGIPDGMERLTGPGDVRIVAKRKASSHKGDNGRVLIVGGGPFFGAPTLAALAALHAGADWVTIAAPKSVSSIIASISPNLIVQPLSSEILVEADVPVVSNLVNRHDVLVIGMGLGAEEATKKAARKIIEDAKDVVVDADGFYGLQLPLKDKHVIVTPHAGEFSKFGAMEGRVEVPPEANVGERIEFVKKVSKLNKVVTLMKGPTDIISDGVRVKLTRKGNAGMTVGGTGDALAGIAGAFFAIVSDPFKAATAAAFVNGTAGDLAFEEKGYGLLATDVVENIPKVMKDLDLFPLAKDSA

SEQ ID NO: 34128 - protein, 369 aa, Salinibacter ruber DSM 13855
MPDVKTASHTVGTAEDRVDLKTMGRAGLKDFVAEHGAPRYRGDQLFNWVYGKGVSDFDRMSNLPKRMRRGLQRDATVEDIEIVEQQQAADRTVKALFELPSGREAETVLIPAIDERGEARRLTVCVSSEVGCAMGCEFCATGRMGFRENLTPGAIFDQVWHMNEVAQEHFGRPVTNIVFMGMGEPLLNYDAVLDSISILTDEDSLNLSAQKITVSTVGLARRIKDLADDQLRTNLAVSLHAPDNETRSRIMPVNEAEKTSLPALKEALQYYFDKTGRQITYEYCLFKGVNDSETDARNLADVTRWAPSKVNLLMYNPVEGLNFERTSEAQLDRFVQVLVQEGVTVTVRRSRGQDIDAACGQLANEGEDA

SEQ ID NO: 34129 - protein, 171 aa, Zea mays
  misc_feature (67)..(67): Xaa can be any naturally occurring amino acid
  misc_feature (69)..(69): Xaa can be any naturally occurring amino acid
  misc_feature (74)..(74): Xaa can be any naturally occurring amino acid
  misc_feature (143)..(143): Xaa can be any naturally occurring amino acid
GTPFPLGPLALGLRFPRQRSTFGCLSSLGGILSKPCHTYATPLGHASFPQETLQHHLAHFLPLLRAXLXESYVXPANLTCVCYTKGPNMGDPLQVVTAARALSRLWRKPLMAVNHCVAHIKMGRAVTEAVDPVVLYVSSGNLXVIAYSEGRYMIFRVLIDIAIGNCLDRVA

SEQ ID NO: 34130 - protein, 933 aa, Corynebacterium efficiens YS-314
MKNIPTGGVEMADQAKLGGKPTDDTNFAMIRDGVASYLNDSDPEETKEWMDSLDGLLQDSSPERARYLMLRLLERASAKRVPLPPMTSTDYVNTIPTSMEPDFPGDEEMEKRYRRWMRWNAAIMVHRAQRPGIGVGGHISTYAGAAPLYEVGFNHFFRGKDHPGGGDQVFFQGHASPGMYARAFLEGRLTESDLDSFRQEVSYEGGGIPSYPHPHGMPDFWEFPTVSMGLGPMDAIYQARFNRYLHNRGIKDTSEQHVWAFLGDGEMDEPESRGLIHQAALNNLDNLTFVINCNLQRLDGPVRGNTKIIQELESFFRGAGWSVIKVIWGREWDELLEKDQDGALVEVMNNTSDGDYQTFKANDGAYVREHFFGRDPRTLKLVEDMTDEEIWKLPRGGHDYRKVYAAYKRALETKDRPTVILAHTIKGYGLGHNFEGRNATHQMKKLTLDDLKLFRDKQGLPITDEELEKDPYLPPYYHPGEDAPEIKYMKERRQALGGFLPERREKYEPLQVPPLDKLRSVRKGSGKQQVATTMATVRTFKELMRDKNLADRLVPIIPDEARTFGLDSWFPTLKIYNPHGQNYVPVDHDLMLSYREAKDGQILHEGINEAGSVASFIAAGTSYATHGEAMIPLYIFYSMFGFQRTGDGIWAAADQMTRGFLLGATAGRTTLTGEGLQHMDGHSPILASTNPGVETYDPAFSYEIAHLVHRGIDRMYGPGKGENVIYYLTIYNEPTPQPAEPEDLDVEGLHKGIYLYDKAAEGEGHEASILASGIGMQWALRARDILAEDYGIRANIFSATSWVELARDGARRNLEALRNPGADVGEAFVTTQLKKGSGPYVAVSDFATDLPNQIREWVPGDYIVLGADGFGFSDTRPAARRYFNIDAESIVVAVLRGLVREGVIDASVAAHAAEKYKLSDPTAPQVDPDAPIE

SEQ ID NO: 34131 - protein, 174 aa, Schizosaccharomyces pombe 972h-
MGQSQSQIFEDLISNSSFSNEEIERIRKRFIKIDANQSGSIDRNEFLSIPSVASNPLASRLFSVVDEDGGGDVDFQEFINSLSVFSVHGNKEEKLKFAFKIYDIDRDGYISNGELYLVLKMMVGTNLREDQLQQIVDKTIMEVDKDRDGKISFEEFKDIVSGSNVTSSMTLDSF

SEQ ID NO: 34132 - protein, 756 aa, Legionella pneumophila subsp. pneumophila str. Philadelphia 1
MVIAQFKQGVVMLDRASVVDEQFLKRVLQGDFPQLRSSMSPDTAELDKKTAIEFFDSQIKSRLLDIIARQLKEKGLSFYTIGSSGHEGNAVLGQVFRASDMAFLHYRSGAFFLQRAKQLPGIDGVKDILLSLVAAASDPISGGRHKVFGSVPLNIPPQTSTIASHLPKALGAALSITRARELGLPSKLTPDSVILCSFGDASTNHATSQATLNACSWITQQNYPLPIVFICEDNGIGISVPTPSSWIKSSVSSRPGIHYIECDGLNIADVFAKAQEADYLARVKKQPVFLHMRCVRLLGHAGSDIESQYNTQEEIEQREANDPLLHTAGILYREGWMSLQAMVELYQDNRALIEAKALEAIREPRMSSAEEIMASIVPRIDKKQKYSLPDDNRRAQVFAGAYNQLTLKRNLCQQINFALTDLMMQYPNMLIFGEDVGKKGGVYRVTADLQARFGQRRVFDTLLDETTIIGTAIGLAHNGFIPVPEIQFLAYLHNAEDQLRGEASTLSFFSSGQYQNPMVLRIASLAYQKGFGGHFHNDNSIAVLRDLPGVIVACPSNGPDAAKMLRTCMRLAYEEGRVVVFLEPIALYMTKDLYSPGDNGWLFEYPSPDEMISQGEVGVYGEGDTVILTYANGYYLSRQAEKVLREAHNISVKIIDLRWLSPLPKDAILKEIAKAKRILIVDEGRQSGSISEGLMTLLMEEASPRLKIKRITGKDCFIPLGTAWQYLLPSQESIIDAVIALQSDKREKESGRLVVS

SEQ ID NO: 34133 - protein, 182 aa, Schizosaccharomyces pombe 972h-
MSFQVRVKQNMQDLDNRLAAFPQLNSLEKNFGVSKLYVFLTAAGIYALFLFLNWGGFLLTNLLAFAMPAFFSINAIETTNKADDTQWLTYYLVTSFLNVIEYWSQLILYYVPVYWLLKAIFLIWLALPKFNGATIIYRHLIRPYITPHVIRICKSVSRQNAAPAPTASSFAHTTATDIPPSI

SEQ ID NO: 34134 - protein, 406 aa, Mycobacterium leprae TN
MTDDRSVRTPKALPDGVTAATVGVRGGLLRSRFEETAETMYLTSGYVYESAVVAEKSFTGELDHFVYSRYGNPTVTMFEERLRLIEGAPAAFVTASGMAAVFTSLGALLASGDRLVAARSLFGSCFVVCNEILPRWGVETVFVDGEDLVQWEQALSVPTQAVFFETPSNPMQSLVDIAAVTELAHAAGAKVVLDNAFATPLLQHGLPLGVDVVIYSGTKHIDGQGRVLGGAILGDRDYIDGPVQKLMRHTGPAMSAFNAWILLKGLETLAIRVDHCNSSAHRIAEFLEKHPAVSWVRYPFLVSHPQYDLAKRQMSGGGTVVTFALNSPEDAAKQRAFEVLDRLRLIDISNNFGDVKSLITHPATTTHRAMGPEGRAAIGLGDGVVRISIGLEDAADLIADIDQALS

SEQ ID NO: 34135 - protein, 354 aa, Aspergillus oryzae
MVQQLPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKANDLALDLLERLLAFNPAKRITVEEALRHPYLEPYHDPEDEPTAPPIPEGFFDFDKNKDALSKEQLKILIYEEIMR

SEQ ID NO: 34136 - protein, 800 aa, Staphylococcus aureus subsp. aureus MW2
MLISNEWLKEYVTIDDSVSNLAERITRTGIEVDDLIDYTKDIKNLVVGFVKSKDKHPDADKLNVCQVDIGEDEPVQIVCGAPNVDAGQYVIVAKVGGRLPGGIKIKRAKLRGERSEGMICSLQEIGISSNYIPKSFESGIYVFSESQVPGTDALQALYLDDQVMEFDLTPNRADALSMIGTAYEVAALYNTKMTKPDTTSNELELSANDELTVTIENEDKVPYYSARVVHDVTIEPSPIWMQARLIKAGIRPINNVVDISNYVLLEYGQPLHMFDQDAIGSQQIVVRQANEGEKMTTLDDTERELLTSDIVITNGQTPIALAGVMGGDFSEVKEQTSNIVIEGAIFDPVSIRHTSRRLNLRSESSSRFEKGIATEFVDEAVDRACYLLQTYANGKVLKDRVSSGELGAFITPIDITADKINRTIGFDLSQNDIVTIFNQLGFDTEINDDVITVLVPSRRKDITIKEDLIEEVARIYGYDDIPSTLPVFDKVTSGQLTDRQYKTRMVKEVLEGAGLDQAITYSLVSKEDATAFSMQQRQTIDLLMPMSEAHASLRQSLLPHLIEAASYNVARKNKDVKLFEIGNVFFANGEGELPDQVEYLSGILTGDYVVNQWQGKKETVDFYLAKGVVDRVSEKLNLEFSYRRADIDGLHPGRTAEILLENKVVGFIGELHPTLAADNDLKRTYVFELNFDALMSVSVGYINYQPIPRFPGMSRDIALEVDQNIPAADLLSTIHAHGGNILKDTLVFDVYQGEHLEKGKKSIAIRLNYLDTEETLTDERVSKVQAEIEAALIEQGAVIR

SEQ ID NO: 34137 - protein, 508 aa, Malus x domestica
MGFAKKEHEFLSAIGLAPENPGGFINGKWKASGPVISTVSPSNNQEIAKVTEVSMEEYEEGLRSCNDAAKTWKSLPAPKRGEIVRQIGDALREKLQHLGKLVSLEMGKILAEGIGEVQEVIYMCDFAVGLSRQLNGSIIPSERPDHMMFEVWNPLGIVGVITAFNFPCAVLGWNACIALVCGNCVVWKGAPTTPLVTIAVTKLIAEVLEKNNLPAAIFTAFCGGAEIGEAIAKDTRIPLVSFTGSSKVGAKVQQIVTERFGKCLLELSGNNALIVMDDADVGLAVRSIFFAAVGTAGQRCTTCRRLYLHESIYQNVLDKLVGLYNQVKIGDPLEEGTLVGPVHTKASRENFEKGISTIKSQGGKILTGGSVIESDGNFVQPTIVEIASNASVVKEELFGPVLYVMKFKTLEEAIALNNSVPQGLSSSIFTSKPNTIFKWIGPHGSDCGIVNVNIPTNGAEIGGAFGGEKATGGGREAGSDSWKQYMRRSTCTINYGTELPLAQGINFG

SEQ ID NO: 34138 - protein, 157 aa, Synechococcus sp. RS9916
MAADPKETSVKEEATEVANSDVAVADASAKAKSGAAAVKLSAQQLIHDFEAAQKKSELPDIYVGDTVRVGVRISEGNKERVQPYEGVVIAKRHGGINETITVRRIFQGIGVERVFMIHSPQVASIKVERRGKVRRAKLFYLRDRVGKATRVKQRFDR

SEQ ID NO: 34139 - protein, 343 aa, Oryza sativa (indica cultivar-group)
MVDLVNGVLNWVATPAMVASLLLFYPPYYLFKTVHSFLSYLFPDDLARKVVLITGASSGIGEQLAYQYALNRASLVLVARREWSLRKVADQAFELGAPDVIILRGDVANPEDCKRFVQTTIDHYGRCKSPTSLICSWTILYATLASQVLDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGERCLTVPPWFSTMYLWRVFAPEVVEFCYRLLYMQRHGGSQADAPSKKMAEASGKKLLYPTSLRSADIKDE

SEQ ID NO: 34140 - protein, 424 aa, Campylobacter jejuni subsp. jejuni NCTC 11168
MTNKKAFKETCKFIAGGVNSPVRAFANVQSEPKFISHGKGAYIFDIDGNSYIDYVQSWGPLLFGHCDKDIQKACQKALHKGSSFGAPTLLETELAKLVLSDFPHLEKIRFVSSGTEATMSAIRLARGFTKKDKILKFEGCYHGHSDSLLVSAGSGAATFNSPSSLGVLEDVAKHTLVAKYNDINSVKELFEKNKDIACVIIEPIAGNMGLVPAKQDFLEELAKICKNNQTLLIFDEVMSGYRASYLGSYGINHIQADIITFGKVIGGGLPAAAFASRAEIMDILSPLGGVYQAGTLSGNPLAMAAGIASLTKAKKKTKLYDKLGKLAKKLTQGMKKLADEKGLPLQACHVGSMFGYFFTKDPVSNYQDALKSDLALFSKFHKNMLENGIYLAPSQFETGFICSKMDDKIIDTTLEAVRESFKRI

SEQ ID NO: 34141 - protein, 404 aa, Zea mays
CIHVADTPTLDALKKAAPERWRLIKAHGTAVGLPTDDDMGNSEPVTTCSAKLVDLALGSGKIYEGEGFKYIQQSFQDGTLHLIGLLSDGGVHSRFDQLQLLLQGASERGAKRIRVHVLTDGRDVADGSSVRFVEMLEEDLARLREKGVDARIASGGGRMYVTMDRYENDWQVVKRGWDAHVLGEAPHRFRSALEALRKLREEDPKKASDQYLPPFVVVDGSGEPVGPVRDGRRPWFDRVRFPRTRYAGMLQYDGELKLPRHYLVAPPEIQRTSGEYLARNGVRTYACSETVKFGHVTFFWNGNRSGYFDQNLEKYEEIPSDAGIPFNVQPKMKALEIAQKARDAILSQKFDQIILDAVEQVGGVFVVTADHGNAEDMAKRDKSGEPLRDKDGKVQTLTSHTLNP

SEQ ID NO: 34142 - protein, 119 aa, Brassica napus
MQKSRESGFLFCNMCSTMLVLKSSKYAECPLCKTTRNAQEIIGKDISYVVSDEDIRRELGISLFGEKTQEDTELPKIKKACEKCQHPELVYTTRQTRSADEGQTTYYTCPNCGHRFTEG

SEQ ID NO: 34143 - protein, 62 aa, Triticum aestivum
  misc_feature (25)..(25): Xaa can be any naturally occurring amino acid
MDRAGGNQAGQVSKKGKMMHAKDEXDRQKQAEKKRRRLEKALANSAAIIRLRERASETRAAQ

SEQ ID NO: 34144 - protein, 523 aa, Aspergillus nidulans FGSC A4
MLVDLTIDSDPEEQPRIPNPLIKSLGRQTLAHRTLSPSPHTKNSTIPFKRKSDADSAESGSESSYASAVAYPQKAKTRTTNVSSRNPVGHDSLSGPFKRVGAGPGTGAARQARQIPASAPSLASSSGTDSAAGHYAPSPAPETLRVVIPSPSVQLKKEIDSAERLPDAEVKTPEITGMSEKYYPTDALERRAMRGAYPAARKTNRAGVPLVIGTPGPFLTEKNRRPVIDLLCKNLQKKLASIKGPAVTVAKADEKRLAKATTGFEFINEYKLREGVAPISKEFQSGCSCETICLPDRCQCLAQEEDSEERIIAYKRARDNPRFMVLRPEFMKRTSMIFECNSLCGCEEKCWNRVVQLGRTIRLEIFHTGARGFGLRSLDTIRAGQFIDLYLGEVITTSKADQREKIANTRNAPSYLFSLDFLVDDESSYVVDGANYGAATRFINHSCNPNCRMFPVSRTHGDDYLYDLAFFALREIKPGTELTFDYNPGMERVDKLDPNAVPCLCGEPNCRGQLWATERKKAR

SEQ ID NO: 34145 - protein, 937 aa, Schizosaccharomyces pombe 972h-
MALLLEGTSLARKVREELREQISSIKSVDPYFNVSLKIIQVGGREDSNVYVRMKTRAANEAGISCEHVNFPEDITEYDLLLAIKGFNEDPTVHGIIVQLPLPAHINEQIITEAVAPEKDVDGFCETNLGKLTKREGQPLFTACTPKGIMCILKHYGINVQGKHAVVIGRSNIVGRPMSILLEKANATVTLCHSKTESIADIVRTADIVVAAIGIPHFVKADWLKKGVVAIDVGINSIPDATKKSGYRLTGDIDFENAKEVASAITPVPGSVGPMTVAMLLQNVVESAVRFRKMSRKRKPTLLPLKLQTPVPSDIEIARSQTPKNIGDLASEIGIAKSELEFYGSHKAKVNLEILQRLAHRRDGHYVVVTGITPTPFGEGKSTLTAGLVQALSNLDKLAIACVRQPSQGPTFGIKGGAAGGGYSQFIPMEEFNLHLTGDIHAITAATNLLAAAIDTRMFHENTQSDAALYKRLTLVKGNKREFAPVMFRRLKKLGIDKTNPEELTEEEQRKFARLDIEPSTISWNRTLDVNDRFLRKITIGENPTEKGFTRQTGFDLSVASECMSVLALATDLKDMRERLGRMVVASNKSGEPVTADDLGVGGALTVLLKDAIKPTLMQTLEGTPALVHAGPFANISIGASSILADRIALKLAGTEVDEDAKKEAGYVVTEAGFASDIGMEKFFNIKCRTSGLKPDAIVIVATVQALKLHGGGPPVGPGKPIPEVYKREDVDLVRKGCANLAKHISNARKYGLPVVVAINKFSSDSPNEISAIREEALAAGATDAVDSNHWAEGGKGALGVARALINACENVDSEFRLLYDVHEPIEKKIEIIAKEMYGADGIELSPLAKERLETFTKQGYNNLPICIAKTQYSLSHDPDLKGAPTNFTVPIRDMRLSAGAGFIYPLAAAISTIPGLPTKPAYYNIDIAENGDIVGLS

SEQ ID NO: 34146 - protein, 427 aa, Legionella pneumophila subsp. pneumophila str. Philadelphia 1
MKVNDRFNALKILTALIESRKNLSYLMSPQEISPMTKEICYGFCRHYFRLQSIADTLINKRPKDNELWIVLLIGIYQLQYMNKPDYAVVKETVSLLGQVKKSWAKGLVNAVLRNFCRRKDHILEKLAAEPVFIYGQPNWLLQRLQKDWPNDWQFIAAANDRHPPMTLRVNVLKHSVDEYLDLLKKSGIEAFKHPVAPDGITLAIPCDVMTLPGFAQGSVSVQDAAPQLAAYLLSLKPGQRVLDACCAPGGKTCHILEKEPGLASCVALDLDPQRLQRVRDNLNRLDLQATVVQGDVLEPRSWWDGHPFDRILLDAPCSATGVIRRHSDIKLLRTDEEISAISQVQSSMLNSLWPLLAPGGLMVYATCSIMSDENELQIAQFVAEHSDCQVSDGKWSWGRWTGHGQQILPGEHSMDGFFYSVLRKDEK

SEQ ID NO: 34147 - protein, 547 aa, Mycobacterium leprae TN
MTETLSKTTEPSVTTGPIPGSSKAYREVANPDGGPSLRVPFRRVHLSTGAHFDLYDTSGPYTDPDAVINLTAGLPPRPGVIRDRGTQLQRARAGEITAEMAFIADREGMPAELVRVEVALGRAVIPANHNHPEIEPMIIGKAFAVKVNANIGNSAVTSSIAEEIDKMVWATRWGADTIMDLSTGKNIHETREWILRNSPVPVGTVPIYQALEKVKGDPTKLTWEIYRDTVIEQCEQGVDYMTVHAGVLLRYVLLTAKRVTGIVSRGGSIMASWCLANHRESFLYTNFAELCDIFARYDVTFSLGDGLRPGSIADANDTAQFAELRTLGELSKIAKVHGAQVMIEGPGHIPMHKIVENVRLEEELCEEAPFYTLGPLATDIAPAYDHITSAIGAAVIAQAGTAMLCYVTPKEHLGLPDRKDVKDGVIAYKIAAHAADLAKGYPRAQERDDALSTARFEFRWNDQFALSLDPPTAREFHDETLPAEPAKTAHFCSMCGPKFCSMRITADIRVYAAKHGLDTEEAIEMGMTEKSAEFAEHGNRVYLPLTQ

SEQ ID NO: 34148 - protein, 210 aa, Pinus pinaster
  misc_feature (83)..(83): Xaa can be any naturally occurring amino acid
  misc_feature (174)..(174): Xaa can be any naturally occurring amino acid
TSTLDSLVSQIHAACRDWGFFQVINHGVSPHFLQTILSEAANFFSLPMQEKCKVRRDFENPLGYYDTELTKNVRDWKEVFDFXMPSEFRLPASFEGESAEILTATNQWPENPPGLREACEKYAEAVEKLSFRLLELISLSLGLPARYFHSKFEDPTSRLRLNHYSPCPAPELAXGVGRHKDGGALTVLAQDEVGGLQVRRKDGEWIGVKP

SEQ ID NO: 34149 - protein, 259 aa, Thermotoga maritima MSB8
MRMNIQKHGEDWKGTVVIVHGLGEHSGRYRRLVREFVSEGVQVVTFDLPGHGKSPGRRGHLRFDDVFKILNEITKDLERFVLFGHSLGGLIAIRFTQIFQPENQKGLVVSAPAILLPDTHSPVLEFMVRFLSFFVPFLTMSNGINPSDLSRNREAVEAYIRDPLVHDRISFKLASDMLSHMKKVLKDAERIKVPVLIFHGTDDRVVSFEGSKKFFEALSTEKKLVSFPGGYHELFEDPEHQKEFFKTIVEWSLEKLGGK

SEQ ID NO: 34150 - protein, 158 aa, Glycine max
  misc_feature (46)..(46): Xaa can be any naturally occurring amino acid
  misc_feature (92)..(92): Xaa can be any naturally occurring amino acid
  misc_feature (108)..(108): Xaa can be any naturally occurring amino acid
FLILISKQRLPHDHFPTVTTVNRAGAGLDAPLTGLKSMAGFPTRKXTNNDITSLASNGGRLQCMRGWPPGGKNNLETLSYLPDLDDAQLPKXVEYLLRKGWIPCLEFXLEHGFESREHTRKPGYYHGRYWTMWKLPMFGCTDAPEVLKELQEANTAYP

SEQ ID NO: 34151 - protein, 393 aa, Ralstonia metallidurans CH34
MDLQRLATASRLANIDAFHVMELAKQAAELERAGRHIIHMGIGEPDFTAAAPVIHAAEAAMRRGVTQYTGALGIHALREAIAGYYKTSYGIDVPARRVIVTAGASGALLLACAVLVEIGAEVLMPDPSYPCNRHFVAAFDGHAKMIPSGPEERFQLTAAQVIEHWGENTRGVLLASPSNPTGTSILPDELKAILAEVRKRQGFAILDEIYQGLSYDAPPVSALSLDDNVVTVNSFSKYFNMTGWRLGWLVVPDSLVPAFEKVAQNLFICASAVAQHAALACFTPEALAIYDERKAEFRRRRDAIVPALEALGLRVPVKPDGAFYVYANCRHVNHPAAGNADRLTQAILHDAGVVMVPGTDFGPHTANDYIRISYATSMQNIEEAMQRLHHFLR

SEQ ID NO: 34152 - protein, 272 aa, Oryza sativa (indica cultivar-group)
  misc_feature (271)..(271): Xaa can be any naturally occurring amino acid
MARRRRSTPARSCSGLRESGHSSPRHAVGYMSGGQFYGAKASLNVWPAKVASPAEFSLSQIWLISGSFGNDLNTIEAGWQVSPQLYGDNNPRFFTYWTNDAYQETGCYNLHCSGFVQTNSRIAMGAAISPISSFAGRQFDITLLIWKDPKQGHWWLQLGSGALVGYWPSFLFSHLGARADMAQFGGEVVNTRPSGSHTPTQMGSGRFPGEGYGRAAYFRNVQVVDWDNNLIPAAALRLLADHPACYDIAGGQGAAWGRYFYYGGPGRNARXP

SEQ ID NO: 34153 - protein, 293 aa, Glycine max
MPIRNSEGRPAQVPARSKLPLSNGGKHVRASHEERNVGSAAGRLPPKSGSSYKTSKPSMASADSRKQLGNNSDNGPGWPVGPKGLPSKISVGTTGNKSSAPGIKNSVNGMRKSLPSKNHPSIPKQSVDQRISKQSVEQRIPKQSVEQRRDIRELNRPKMTPKQPVASSKPQINKPLKQNSVHTASQDRRPKHKVAKRPFDDDEDEVDFRNVIRNIFNYNPNKFVDDDDDDNMEAGFDEILREEKRSPSFPQKKKKNEMIAKKEDEEQLRLIEEEEERERRRKMAKLKRRKLGY

SEQ ID NO: 34154 - protein, 456 aa, Thermus thermophilus HB8
MLPKAFLSRMAELLGEEFPAFLKALTEGKRTYGLRVNTLKLPPEAFQRISPWPLRPIPWCQEGFYYPEEARPGPHPFFYAGLYYIQEPSAQAVGVLLDPKPGERVLDLAAAPGGKTTHLAARMGGKGLLLANEVDGKRVRGLLENVERWGAPLAVTQAPPRALAEAFGTYFHRVLLDAPCSGEGMFRKDREAARHWGPSAPKRMAEVQKALLAQASRLLGPGGVLVYSTCTFAPEENEGVVAHFLKAHPEFRLEDARLHPLFAPGVPEWGEGNPELLKTARLWPHRLEGEGHFLARFRKEGGAWSTPRLERPSPLSQEALRAFRGFLEEAGLTLEGPVLDRAGHLYLLPEGLPTLLGLKAPAPGLYLGKVQKGRFLPARALALAFGATLPWPEGLPRLALTPEDPRALAFATGEGVAWEGEDHPLALVVLKTAAGEFPLDFGKAKRGVLRPVGVGL

SEQ ID NO: 34155 - protein, 82 aa, Oryza sativa (japonica cultivar-group)
MAAEKGSPLPKFGEWDVNDPASAEGFTVIFNKARDEKKTGGNSQGQDLAAKSEQPSGQGLYPAKPNSSKKWFCCMQPTAAES

SEQ ID NO: 34156 - protein, 551 aa, Schizosaccharomyces pombe 972h-
MSVSKARLQSVVRLSRTVPYSKTMVRSFHVSCAVKNSGNVPTPRNKSFFSRALEMAEVTSSLSMLGAVALFQSLRRLNNSSPKGKSGVPKKNIVVLGSGWGAVAAIKNLDPSLYNITLVSPRDHFLFTPMLPSCTVGTLRLPSITEPIVALFKGKIDPSNIHQAECTAIDTSAKKVTIRGTTEANEGKEAVIPYDTLVFAIGAGNQTFGIQGVRDHGCFLKEAGDAKKVFNRIFEILEQVRFNKDLSPEERARLLHITVVGGGPTGMEFAAEMQDFIDNDVKDMFPELQKDIHVTLIEAAPGVLPMFTKSLITYTENLFKNLNIKIMTKTVVKDVNEKNLIVQKTNPDGSKAMQEIPYGMLVWAAGITARPLTRTLMSSIPEQSGARKGLIVDEFFRVKGVPEMYAVGDCAFSGLPATAQVANQQGAWLAKNLNVEGKKFALHERIQALEKQLGEKEAPSQVAGLKQQVEQLKLEPFKYHHQGALAYVGDEKAIADLKLPFMKKMLPLQGIVGHTFWRLAYLNELISARSQFMVLIDWLKTRLFGRYDAKV

SEQ ID NO: 34157 - protein, 309 aa, Hevea brasiliensis
MAGTGVVAVYGNGAITETKKSPFSVKVGLAQMLRGGVIMDVVNPEQARIAEEAGACAVMALERVPADIRAQGGVARMSDPQLIKEIKQSVTIPVMAKARIGHFVEAQILEAIGIDYVDESEVLTPADEENHINKHNFRIPFVCGCRNLGEALRRIREGAAMIRTKGEAGTGNVIEAVRHVRSVMGDIRLLRNMDDDEVFTFAKKIAAPYDLVMQTKQLGRLPVVQFAAGGVATPADAALMMQLGCDGVFVGSGVFKSGDPARRARAIVQAVTHYSDPDMLAEVSCGLGEAMVGINLNDKKVERFANRSE

SEQ ID NO: 34158 - protein, 353 aa, Aspergillus nidulans FGSC A4
MGCCFSVSREPHDSNGQTPTEEHSSAIAPPSHIPSSSRQSRQRHLTHNPSPSSSHHDRQRQQQQAVPLQQHINAPIRPHIWHSKKRLWTRALLDRERTEFFETRVTGRPEVWDALSAALQFMRNGDYETAQSIIDAAGVTVPTGDLCQGVYDEQGVLYRLPRCIVSDPVNIVVGDVGLGGSGSGSGSDSEGSDGGADDDLGFETDENEHGDRKVGYVREGEGVESGDELIKNGAGARARVLARSADDEASIERERERRRDEKGKTSERDLIRVKTRLSDRDGADVIVALRKTQNVGFLARKLQQEVGIPRTQRIRIAYLGKILKEHKTLFDQGWQPGHVVNALVVARRSSSSQ

SEQ ID NO: 34159 - protein, 235 aa, Stellaria longipes
LIKEIKAAVTIPVMAKARIGHFVEAQILESIGVDYVDESEVLTPADEDHHINKHNFQIPFVCGLSIPRGAPPPAYRRGYAGHDTGPRVRKPSTGNVVEAVRHIRSVMGEIRLLRNMDDDEVFAYAKKISAAYDLVMQTKQLGRLPVVNFAAGGVATPADAALMMQLGCDGVFVGSGVFKSGDPAKRARAIVQAVTHYSDPDLLGRGEFGLGEAMVGIIVRMRRLRGTPIVLNEVI

SEQ ID NO: 34160 - protein, 1468 aa, Aspergillus nidulans FGSC A4
MAESKRLSSSSRPGQDESEKIQEVQYQTRSRQNSRIDQDDTTFFDEINPGGRAELTRIASNFARRTSTAASTTTGKGIERMDTVDEMTLEDPAFDPTSDQFNHYKWARKIMKLMDEEGAPRPPSTGITFQNLNVFGSGSALQYQDTVVSLLTAPLRLHELLFKRAPERHILHDFNGLIGSGELLIVLGRPGSGCSTFLKSLCGELNGLKLGEGSHIQYGGIPMKTMHKEYKGEVVYNQEVDKHFAHLTVGQTLEFAAAARTPEHRLRGASRQQSAKYVTQVAMAIFGLSHTYNTKGNLSVQALAEMALSRAPIAAWDNSTRGLDSASALEFVKALRIAANVGGSCHAVAIYQASQAIYDIFDKAVVLYEGREIYFGPCDKAREYFVEMGYYCPPRQTTGDFLTSVTNPQERKAREGMEKRVPRTPEEFEKYWKNSPYFAELQREIAEHLEQFPVGGEVEQTFGQAKRYIQAKHVRPKSPYVISIPMQVKLCTIRAYQRTPDASAGFQSKGASLFFAVLMNALISITEINSLYDQRPIIEKQASYAFVHPFAEAFGGIVSDIPVKFVAAVVFNVIYYFLAGLFFIFFLFTFLSTLAMSAIFRTLAASTKTLSQAMSMAGVMVLAIVIYTGFVIPTPQMSDIPWFSWIRWINPVYYTFEAMIANEFHGRQFECSQFVPAYPNLSGDSFVCAVRGSVAGERTVSGDEYIYSQYRYTYDHEWRNLGILIAFWIFFTVVYLVATELNSATSSKAEFLVFRRRHVPPQMRILGKSQGDASPENVALAEKPTEVAPNTSAIPEQHSIFTWRNVCYDIPVKGGQRRLLDNVNGWVKPGTLTALMGVSGAGKTTLLDVLAKRVSIGVVTGDMFVDGRPLDTSFQRKTGYVQQQDLHLPTTTVREALQFSAVLRQPKTVPRAEKYAYVEEVIDMLNMQDFADAIVGTPGEGLNVEQRKLLTIGVELAAKPALLIFLDEPTSGLDSQSSWSICSFLRKLADRGQAVLSTIHQPSALLFQQFDRLLFLAKGGRTVYFGDIGEDSRTLLDYFEANGARACGSSENPAEYILEVIGAGASGKSDLDWPSIWKESTEAREVLQEIDRIHKDRASASSVEDKNTHREYAMPFTDQLWQVTSRVFQQYWREPIYVWAKLILAIASGLFIGFTFFKPDSSQQGFQDVLFSAFMLTSIFSTLVQQIMPKFVIQRSLYEVRERPSKAYSWAAFIIANVLVEIPWQILAAIVSWASYYFPVYGASQPPHRQGLILLFVIQFFIFTSTFATLIISSLPDAETGGTIATLMFMMTLVFNGVMQAPSALPGFWIFMYRVSPLTYLIAGLTATGLHGRAIECATEELNVFNPPNGMSCGEYLTEYLAVAPGLLYNPDATANCQYCGLTNADQYLAASNIYYSERWRNWGIGWAYIGFNIFGTVALYYIFRVRHWNPTSLIRSVKQGAQVVCRVFKRRSGETPRGKEAENGRLY

SEQ ID NO: 34161 - protein, 340 aa, Streptomyces avermitilis MA-4680
MTVTPQLPAVSREWHLASRPVGWPKPEDFALVEAEVQQPGEGQVLVRNKFVSVDPYMRGRMSAAKSYVAPFELNQPMQGGAVGEVVVSNAEGIEAGDHVLHFLGWREYAVVDAKQAVKVDPEAAPLSAYLGVLGMTGLTAYAGLLRTASFKEGDSVFVSGAAGAVGSQVGQIAKLKGASRVIGSAGSDDKVKLLVEEYGFDAAFNYKSGPVNEQLREAAPDGVDVYFDNVGGDHLEAAIGQLNRDGRIAVCGMISVYNDTEPAPGPKNLARLIQTRGRIQGFLVGDHYDLQSQFVQEVGGWIRSGELKYRETVVEGIENNLEAFLGVLRGDNTGKMIVKL

SEQ ID NO: 34162 - protein, 499 aa, Aspergillus nidulans FGSC A4
MAFNSSPCTNQSDSHLRLLGHDSTLMVGQSVSLTLGGDSLLIVDERVMRKSDRTCCGMVPKPTNKVTHSISLYNVLDTSVSSAGLTITYAEPAGKDDIAVTALQYPIAAEEKSRVEQWMSKLLALAYGNAQRYKRLKVLINPFGGKGHAAKMYRTYAEPVFAAAHCELDVQETTHGGHATEIAEQIDVNAFDAIVCCSGDGLPYEVFNGLARKPNAGEALRKLAVAMLPCGSGNAMAWNLCGTGSVSIAALTIIKGVRMPIDLMSVTQGSTRTLSFLSQSFGIIADSDLGTEHIRWMGAHRFTYGFLMRLMSRAIYPCDLAIKVVMDDKSSIKHHYNAYVNSPPPDPSRQDSEYTEGLPKLEYGTVLDELPKDWAVVPADTIGNFFAGNMAIVSKDTNFFPASVPNDGLMDIVTIDGKTPRTRILKMMSEVPEGTFFDMPEVEIRKALAFRLTPREKEGYISVDGEKIPFEAFQVEIHKGLGTVLSKTGHLYEAAGPRP

SEQ ID NO: 34163 - protein, 386 aa, Shigella flexneri 2a str. 2457T
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLCRFLGGLSLFTLAESLGGVESLISHAATMTHAGMAPEARAAAGISETLLRISTGIEDGEDLIADLENGFRAANKG

SEQ ID NO: 34164 - protein, 482 aa, Staphylococcus epidermidis ATCC 12228
MAYFNKFLSNSERKRGKVSKKVAIIGAGITGLSSAYFIKKQDPSIEVTIFEASNRVGGKIQTYRSDGYTIELGPESYLGRKTIMTDVAKDIGLENDLITNTTGQSYIFAKNKLYPIPGGSIMGIPTDIKPFIKTRLISPIGKLRAGLDLFKKPIEIEDDISVGSFFRQRLGNEVLENLIEPLMGGIYGTDIDQLSLMSTFPNFKEKEEQFGSLIKGMKDEKEQRIKKRQLYPGAPKGQFKQFRHGLSSFIEALVKDIESKGVHIRYNTPVKDILISQKDYEILLEDDSKEKFNGLLVTTPHQVFMNWFSHDPAFDYFKNMDSTTVATVVLAFDEKNITNTYDGTGFVIARTSQTDITACTWTSKKWPFTTPEGKVLIRAYIGKPGDTVVDDHTDEEIVSIVRKDLSQMMTISGNPDFTIVNRLPKSMPQYHVGHIKMIKEIQQHIKTTYPRLRVTGAPFEAVGLPDCIQQGKNAVDEILEEL

SEQ ID NO: 34165 - protein, 517 aa, Pediococcus pentosaceus ATCC 25745
MANADLSNFDKIIVLDFGSQYNQLITRRIREFGIYSELLSHKITAEEIKKINPKGIIFSGGPNSVYDKDAFRIDPEIYKLGIPILGICYGMQLMTYNLGGRVEPADNREYGHADIDVTDDQAVMFKELPAKQTVWMSHGDLVREVPEGFKTVATSANCPIASMADDARKFYGVQFHAEVRNTQYGNEILRHFAFDVCEAKANWSMNDFIDMQVQQIRETVGDRKVLLGLSGGVDSSVVGVLLNKAIGDQLVCIFVDHGLLRKGEAKQVMDSLEGKFGLNIIKVDAQDRFLSKLAGVSEPEQKRKIIGNEFIQVFNDEAQKLKGIDFLAQGTLYTDVIESGTDTAQTIKSHHNVGGLPEDMHFELIEPLRTLFKDEARDLGEKLGMPEDLVWRQPFPGPGLGIRVIGEITEDKLQIVRDSDLILREEIKKAGLDRDIWQYFTVLPGIRSVGVMGDGRTYDYTVGIRAVNSIDGMTADFARIPWDVLQKISVRIVNEVDHVNRIVYDITSKPPATVEWE

SEQ ID NO: 34166 - protein, 169 aa, Arabidopsis thaliana
MCGLYINLFCLLRITSNKKTMEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 34167 - protein, 370 aa, Francisella tularensis subsp. holarctica
MQQDKVNLLGLNQKAIEDFFISIGKKKFHARQVFKWIHKKGVIDFDAMTDLGKNLRHKLKDKAQITIPKVVFSKASKDGTHKWLIDVGGSAVETVFIPEEGRGTLCVSSQIGCTLNCSFCSTGKQGFNRNLSAAEVIAQLWIAARTLSKTDGEHDFTVTNIVMMGMGEPLMNFENVVPAMDIMMDDLAYGLSRRKVTLSTSGVVPRIYDLLEQSGVSLAVSLHTPNDMLRNEIVPINKKYNIDELLEACKLYAQKGPHKHITFEYTLMEEVNDNLSDAEELVALLKSREVPAKINLIPFNPYPGTPYKKPSNNRIHRFKEFLQHNGFVTTVRKTRGDDIDAACGQLAGDVMDKTNRKQRYLKKLGDTNAN

SEQ ID NO: 34168 - protein, 294 aa, Saccharum officinarum
MEQYEKVEKIGEGTYGVVYKGLDKATNETIALKKIRLEQEDEGVPSTAIREISLLKEMNHDNIVRLHDVIHSEKRIYLVFEFLDLDLKKFMDSCPEFAKNPTLIKSYLYQILRGVAYCHSHRFLHRDLKPQNLLIDRRTNTLKLADFGLSRAFGIPVRTFTHEVVTLWYRAPEILLGAKQYSTPVDVWSVGCIFAEMVNQKPLFPGDSEIDELFKIFRVLGTPNEQSWPGVSCLPDFKTAFPRWQAQDLATIVPNLEPAGLDLLSKMLRYEPSKRITARQALEHEYFKDLEMVQ

SEQ ID NO: 34169 - protein, 237 aa, Methanococcus vannielii
DPDMIFEIKDAVSIPVMAKARIGHFVEAQVLESIGVDMIDESEVLTPADEINHINKKAFTAPFVCGARNLGEALRRIDEGAAMIRTKGEAGTGNVVEAVKHMRAVNEGIARVVGYHEMGLEAELVQMARNELKVPMEIILEVAKLKRLPVVNFAAGGIATPADAALMMQMGCDGVFVGSGIFKSGNPEIRAKAIVEATYNFDKPELIGEVSKNLGEAMVGINIDQIPEEMLLAKRGI

SEQ ID NO: 34170 - protein, 254 aa, Thermus thermophilus HB8
MERLEEARKRLEEARRVAVLTGAGISKPSGIPTFRDAEGLWKNFNPLDYATPEAYARDPEKVWAWYAWRIQKVREAKPNPAHYALVELERRILSRGGSFLLVTQNVDGLHALAGSQNLVELHGNLLRARCEACGKRFPLPEAFAPPPFCPACGHRARPDVVWFGEFLPEGAWERAERAFAEADFALVVGTSAEVEPAASLGRIAFASGAYLVEVNPEPTPLTPLAHLSLRTGAVEGMALLLPPSPEDQAEGHLS

SEQ ID NO: 34171 - protein, 482 aa, Thermus thermophilus HB8
MRLFTPEAMREADRKAVERGYPSLLLMEWAGMKAARVYLELFGKAPALVLAGKGNNGGDGLVLARHLLLEGVGVRVYAAGGQTGDALLALQALLAHGVEVRPLEEASFREGEVVVDALFGTGLKGPLTDFYAELVERVNRAGLPVLALDLPSGLPFSPHVRATATVAFAALKTPHLFQREACGKLYLAEIGLPKPLLEREDLPEVASPEALRPLLPRRPLTAHKGSVGRVGVLGGYQGEDLRYAGAPLLAALGAYRMGAGLVHLVAPEGTPLEPLEAVFHPVPSPALPPLKAEALAVGMGGGPWGRAWALKALEARLPTVLDADALHPEVAEAYRKAGVPAVLTPHAGEAGRLLGISPEEVAKDPLGAARALAERTGLAVVLKGNPTVVAEGERLSVNPTGNPALATGGTGDVLSGAIAALLAAGLRPFDAARLGVFLHGLAGDLLAEEKGVGLLAREVAEALPRARRLLQEGRVPPAFFPR

SEQ ID NO: 34172 - protein, 345 aa, Oryza sativa (japonica cultivar-group)
MRTTARPTAAATALALILVLVFSPSPAAAAARMFKTIDARRSQHLDLGGSLVGPESVAFDGKGRGPYSGVSDGRVMRWNGEAAGWSTYTYSPSYTKNKCAASTLPTVQTESKCGRSLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAISADRTHLIVALTGPCKLRYWIRGPKVGKSEPFVDLPGYPDNVRPDEKGGYWVALHREKYELPFGPDNHLVAMRVSAGGKLVQQMRGPKSLRPTEVMERKDGKIYMGNVELPYVGVVKSI

SEQ ID NO: 34173 - protein, 874 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 34174 - protein, 226 aa, Saccharophagus degradans 2-40
MTQDELKQAVAQAALDYILPHLEDDMILGIGTGSTARLFIDLLAAHKGKFDGAVSSSEASSEQLKGHGIPVYDLNSVDSLPFYIDGADEANAQLHLIKGGGAALTREKIITAVADKFICIADASKDVDVLGKFPLPVEVIPMARAHVAREIVKLGGNPVHRQDCVTDNGCQILDVYDLAIHDAPALEAKLNNIAGVVTNGLFALRPADVLLLGTTNGVETRFAAKP

SEQ ID NO: 34175 - protein, 2390 aa, Aspergillus nidulans FGSC A4
MPDKISFPDDRSKLLSNVTRVAPTCSSCGKAKLECVYQAPPPRAKRKRSQSEDVYARLARYERILQDNNLLPSESRSSKDSCDESSTSMTGTSGQLLFDNGQSRYIDSVLLDTGEGGLCQLSVSEHDDFQDDFGSDENASSGQEAAFAILGTIRGRPQSLIEQHPCYEQATKLWDVYIQNVEPLLLQAYTLFLISMCTQINPNTFWILTGIAVRLSQRMGLHRDGEDLGLPPFEVQMRRRLFWQLLPLDGYAGQVSGTGISIAPNSWDTKQPLNINDDQIFPGMTQQPKEPKCASEMIFCLSRIKLSNFYTRTGVKMKDIGASLEFKDAEEIERLINEVEDSIETKFLRNCDIVNPLHILTTGIVRLALAGFYSPSEIDSAWNKITEIYRNHEELVISRRAIHTTIGKETLKAWDANPPSNSSPEPSFIVTLRAKHEEKAGKWQESIDRKVLGSFVDGSVLDDLFGTASDPYLDPDSGFSLDSSDWAAWDQLSRGPITGPSPAPTLCDWPPEEVYYSYKPVEANSKNRNLYISHNIYHEMRLRDSRTPDQGSPPSLEEANLENGGATSLNTEAHAQAEDSNLITWRGPDDPEKPQEMAQHDLGMQTEIEIYLSMAIFILAYAIGPTFFGPASELYGRVRLLQISNIWYLAWNLGCGFANTKAQLFAFRFLAGIGGSAPLAIGGGAVGDMWSAEERGKAMGVYTLGPLLGPVVGPIAGGFIAEYTTWRWVFWASSAAAVGIQLAGFVWLRECHPATLLRMRRDCLVKETGNENFHVEERAEALTHKLLHAFERPVLLSITQPIVTCIAVYMAYIFGVTYLMLATFPDIWTEVYDETRSISSVNYVSIALGSFTGLFLNLKFIDRIYRVLKARNNNIGKPEFRMPALAIGSIISTIGLFWYGWSIGTSYQTYAASAMAACAILRSLAGFAFPLFAPYMYQSLGYQWGTTCGRRILYLAWYGLDEALYTTPLSSSNIIMVIAFEGTFVLFCHKLTDVCLPAGSLASRSPPTFSRIPHRDHHQVMDPQAVREYQLMEQPDVGHIDSDGSGSSDDILNPPYVVRPGPIVGEPYDTQMASSNAGLPSSPPQTHPSLSSWAPATPARPRGASVGTPAFDKMSSPAVEGTPLVERELRMQQRPSHPARTPSNTYAPQRRPPPYISFQDDRQRSSSNKRTPRRNPDAQYRAQEKAYVQRIREDPQGWYSRFEDTGMGVTGDASDLEDPSPSSELPFEDDTYDPDIQLFIADDNQPSMEELKNPKNQERLEWHSMLASVLKGDVVKQEKQRLLGSAEPNRSAAQNHAIWLGVRARTCGRSLTLQRKLIEDARSGLGPIIENIINFEIKGETEIGKSPIKQVEDIVEQIGKCEALYPTHKELETAHPRVASEEYCSSRDAVFAWHNTTILINTELAILQKWVGNAELDFSKAGLKPANSDLSDESSFLDRIMKEDGLKTLQGEHNMLNGIGAVIQKAKNTLIENATSFAKRHLPPYIEELLILINFPSRLIQEIIRVRLSYARNMKDPAQQSPILVDQMITQFQILMRAAVDIKQRYLDIARPEPGWDLPPCIDESFDSVVLDALRYYFRLLNWKLQANKNTFKEAEILEQEWDFCNEIGRQLDSGDIEVAEQFSVLTARAIHRLLIHFERELHVQEDEDPAELDKRFKGILDSTRIRQRKLYRFSRFLRQLFENASEYNLPADISWDFFEALFVSDHFLIKSNASSAQKGVYYFAHPALWNRPDEIAAILGTSFREEEVGKELTHVPYVLAVRPEKPLSWAGKEMQVELVEQPTDLRLGKLRLIVEGSQQRLVNARLELTHLTGIQLDMAIEQRANLSRVNAELNRIKKISFKLSMTIMDSVAILRRQLREKGVENTELIQACYAFATEFGKRSSNVDPNRRAMNSARLAELSLDWVSFICDDCDAADRKTFKWAVAALEFAMAITSSRHLLSMDDAHFARLRQKVAGCMSLLISHFDIMGARSSRAAQAEKQRMDESARSWKIGAGRILTDEEAMRLVREQRLISLNAIEEGRVEADAKRQALGRVLEGTNEADKSLAVLSSSATNVTLRWQQGQYIGGGTFGSVYAAINLDSNYLMAVKEIRLQDPQLIPKISQQIRDEMGVLEVLDHPNIVSYHGIEVHRDKVYIFMEYCSGGSLATLLEHGRVEDETVIMVYALQLLEGLAYLHQSGIVHRDIKPENILLDHNGIIKYVDFGAAKIIARHGKTLLPMDALGNGGNKDGINPKDNQVAPNRGKNQKTMTGTPMYMSPEVIRGDTSKLVHRQGAVDIWSLGCVILEMATGRRPWSSLDNEWAIMYNIAQGNQPALPSRDQLSDLGLDFLRRCFECDPMKRPTAAELLQHEWIVSIRQQVVIETPTPSSEHSGSISSSNSGSRHSSAYM

SEQ ID NO: 34176 - protein, 244 aa, Medicago truncatula
MSTTNIVNHHSLFDQEQDHEIPMQMGFNIPFPPNMTLPPLDNCHHQSLKGISAITPSSLSPEAANFAETLLATAVQKTREFDDHLTSSFGGGGQLLSLNRSKVNSWAWGEVTGSLIGKRSSGGDDQHHHHHNQQLGVSAIKMKKMKGRRKVREPRFCFKTMSDVDVLDDGYKWRKYGQKVVKNTQHPRSYYRCTQDNCRVKKRVERLAEDPRMVITTYEGRHAHSPSNELEESQTQSELTNFFW

SEQ ID NO: 34177 - protein, 378 aa, Schizosaccharomyces pombe 972h-
MIQYVYLKHMRKLWSLGKVRSTVLRFSTTNRNASHLIKNELEQISPGIRQMLNSNSEFLEECSKYYTIAQGKQMRPSLVLLMSKATSLCHGIDRSVVGDKYIDDDDLRSFSTGQILPSQLRLAQITEMIHIASLLHDDVIDHANVRRGSPSSNVAFGNRRSILAGNFILARASTAMARLRNPQVTELLATVIADLVRGEFLQLKNTMDPSSLEIKQSNFDYYIEKSFLKTASLISKSCKASTILGQCSPTVATAAGEYGRCIGTAFQLMDDVLDYTSKDDTLGKAAGADLKLGLATAPVLFAWKKYPELGAMIVNRFNHPSDIQRARSLVECTDAIEQTITWAKEYIKKAKDSLLCLPDSPARKALFALADKVITRKK

SEQ ID NO: 34178 - protein, 379 aa, Lactococcus lactis subsp. lactis Il1403
MNNTEYYERLGVDKNASQDEIKKAYRKMSKKYHPDLNKEEGAEEKYKEVQEAYETLSDEQKRAAYDQYGEAGANGGFGGGGFGGASGFSGFGGGSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQVTCDVCNGTGKEIKEKCETCHGSGHEKVAHTVKVTVPAGVETGQKMRLQGQGDAGVNGGPYGDLYVVFQVEASDKFERDGAEIYYKMPMDFVQAALGDEIEVPTVHGNVKLKIPAGTQTGANFRLKGKGAPKLRGSGNGDQYVIINIVTPKNLNQAQKEALQAFAKASGVEVSGSGKKGFFDKFK

SEQ ID NO: 34179 - protein, 333 aa, Medicago truncatula
MASTATTTLFISSEFKPNLPNSLLLPRIRICNKPLSISLQPSKFRATHLSLCNCSRTPLTPSTIFSPQTTLTNFISQKISFFLIGSFIFVACFSRKPAFAVSVPSVDSAEILEEKILEKDSRNVEALKVIVYGKIRRGKCKEAEKFVKRLIDEEPNEVEWRLLLALCYETMGYLSKAKGLYLEILENWPLFVRALHGLAMVMHKNKEGPAVFEMLNKAVELAINENKVTEERNIKILTAQMRVVQGDLEEGLKRCQDLIDQNPRDFRPYLCQGIIYSLLDKKEEAAKQFETYQALVPEEFPQRGFLDDITLAAKGTSPVQFQKEFRNQFSDQK

SEQ ID NO: 34180 - protein, 393 aa, Zea mays
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIIRSAGNKVASAATQPLLLPSSTSTDNV

SEQ ID NO: 34181 - protein, 549 aa, Rhodobacter sphaeroides 2.4.1
MGWLADERGLEKCAANYAALTPLSHLKRAAEVHTDRTALVNGSIRLTYGEYHARVSRLASALAGMGIQSGDVVATLLPNIAAHAEAHFGVPACGAILNAINTRLDLDTVSYILEHGGAKLLLCDTAFLKLAKDACARLEGKAPILVEVCDREAGFSPSGEVLEYEDLMDRGNPWAPWVMPEDEWESIALNYTSGTTGRPKGVVYHHRGAYLSTYGNAIAWRMQLYPVYLTIVPLFHCNGWCHTWMVPMLGGTVVCCRDITATAIYAAIADEGVTHFGGAPIVLNTLINAAPEDRRSFDQVVEVFTAGAPPPAATLAAIEPLGFNVTQVYGLTEVYGPATECIWKPEWDETAGEERSALKARTGVAMATLEGAEVHDTHGQPIPRDTVHLGEIAMRGNMVMKGYYKNPEATAEAFRDGWFRSGDIAFQHPDGYIKITDRAKDIIISGGENVSSVEVEGVIAHHPAVSLCAVVAKPDERWGEVPCAFVELKRGRQATEEEIIAFARERLAGFKTPKQVIFCELPKTSTGKIQKFELRAVAKLAVTETEDAR

SEQ ID NO: 34182 - protein, 520 aa, Picrophilus torridus DSM 9790
MVVIRADRSYLRTSFGESFIDYLNKFSDIIGFSIECDDDIKVELNPDRPDLFSFYAINNAIKTYYHNNFIVKSPFDRSNVKFTSKLNDRYIMGFTASGHRLGNLFKHIIEYQERLHETIGKNRKKMAIGIHDLDKIKPPFLLKYADGISFETYDGFKGSVNEIISGHPKGIEYGSLVKRPIVIIDDENDVLSMPPVINGKKSIVTEDTKNLFFDITGSDFNAVRSALMLFMYEMHYLNYKVSYADFPGLKGVLKYDFRPLKLNDNIIKRYLGISIGRENTIESLRRMGYRAEVSSYGYNVLVPGNRIDVMGDVDIIEDIAKAYGYNNIDENVPETSGIARHYKINDFKNIIRDIMISSGFQEIMTFVLSSNYYNNIKYDGGFKIENPKSIDFSVIRDRLYLNFLNFLNINKRNPLPQKIFEIGNVISKTEEKTHLCAMICDSETDYTSIYKILRYLSLRLSIDFHVEPMDIETLIPGRSGVIKINGVDAGIIGEMDPEIYTKFDIYNPIAFLEIDVESLI

SEQ ID NO: 34183 - protein, 458 aa, Sinorhizobium meliloti 1021
MMIEAKKLAARFPGDFVFGVATASFQIEGASKADGRKASIWDAFSNMPGRVYGRHNGDVACDHYNRLEQDLDLIKSLGVEAYRFSIAWPRIVPEGTGPINEKGLDFYDRLVDGLKARGIKAFATLYHWDLPLALMGDGGWTARTTAYAYQRYAKTVIARLGDRLDAVATFNEPWCSVWLGHLYGVHAPGERNMDAALAALHFTNLAHGLGVAAIRSERPELPVGIVINAHSVYPGSNSAEDKAAAERAFDFHNGVFFDPIFKGEYPEDFLSALGERMPAIEDGDMATIAQPLDWWGLNYYTPMRVSADPAKGAEYPATVNAKPVSNVKTDIGWEVYAPALGSLVETLNARYRLPDCYITENGACYNMGVENGTVDDQPRLDYISDHLAVTADLIAKGYPMRGYFAWSLMDNFEWAEGYRMRFGIVHVDYETQVRTIKKSGRWYKDLAERFPSGNHKPG

SEQ ID NO: 34184 - protein, 369 aa, Burkholderia vietnamiensis G4
MKSRAAVAFEAGKPLQIVELDVEPPRKGEVLVKITHTGVCHTDAFTLSGDDPEGLFPAVLGHEGAGIVVEVGEGVTSVKTGDHVIPLYTAECGECLFCKSGKTNLCVSVRATQGKGVMPDGTTRFSYNGQPVYHYMGCSTFSEYTVVAEVSLAKISPDANPEQVCLLGCGVTTGLGAVKNTAKVQEGDTVAVFGLGGIGLAVIQGAKLAKAGRIIAVDTNPGKFDLARVFGATDCVNPTDYDKPIQQVIVEMTGWGVDHSFECIGNVNVMRAALECAHRGWGQSVIIGVAGAGQEISTRPFQLVTGRRWLGTAFGGVKGRSELPGMVEDAMAGKIQLAPFVTHTKPLTGINEAFDLMHEGKSIRTVVHF

SEQ ID NO: 34185 - protein, 283 aa, Mesorhizobium sp. BNC1
MSEQTLPKQEQEHQPGKEHQMHPRPEFTPRYRGSDRLKDKVAVITGGDSGIGRATAILFAREGAKVAFLYRDEQKDAEETERLVAAEGGDVFSMPGDVGETETAERFVKAVIERFGKIDVLVNNAAEQHYQEELTDISDEQLERTYKTNIFGMFRITRAALPHMQEGSSIICTTSVTAFKGQDVLMDYASTKGAILAFVRALSGNLASKGIRVNAVAPGPIWTPLIPASFPAEKVAKFGGNVPLGRPGQPNEVAPCMLFLACEDSSYITGQTLHPNGGTLVGG

SEQ ID NO: 34186 - protein, 325 aa, Francisella tularensis subsp. holarctica
MQQLKDIQALVKEDIQNNNQFIVDSLCSDVVLINQISHYIINSGGKRLRPLLVILFARALNYNGDKHLACAAIIEFIHTATLLHDDVVDDSQLRRGKQTANNVFGNAASVLTGDFLYSRAFQMMVSLDNMQIMQILADATNKISEGEVLQLLNARNSELSEEEYIKVIYCKTAKLFEAACELAGLISIDKQDYTKYQGRIKNYGVYLGNAFQIADDVLDYVSDAESLGKNIGDDLDEGKMTLPTIYALANVTEQQQQILKKAIEKGEYRIDEIIAMVKDSGAVDYSYKVACQYADLAKQQIDFLPDSEYKQAMILLCDLAVNRKN

SEQ ID NO: 34187 - protein, 563 aa, Oryza sativa (japonica cultivar-group)
MASSALICDTEQWKGLQAHYDFVFRHACGGEQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 34188 - protein, 364 aa, Triticum aestivum
MAAYDYDAAVALAEFQAARAGVRGLIESGITSVPPLFLVPSTISPSPPPLESEIIFTIPSVDLALPHSSSLPLIRAAARSCGFFHVTNHGVDTATVDGAVSAVRAFHELPLTVRSAFYTPASVGSVTYSTIPIQPGKNSAGPLLPWRDTLQVRFGPPPAPDLAHLPPACRDALLKYQLLMTALGKKMAGLLSEALGVGAGRLERAMQVEGLLMACHYYPPCPEPARVVGGLEHTDPSLFTVLAQDGVGGLQVRLRDGRWADVPPEPGALLVNIGDVLKVVSNDEYESVEHRVVIKSCEDARVSIALFFNPAKRQESDLFGPLPELLTAGKQQRYRAFTLTEFMSSRREHGHGTKSIDQFRIAHE

SEQ ID NO: 34189 - protein, 305 aa, Escherichia coli O157:H7 EDL933
  misc_feature (23)..(23): Xaa can be any naturally occurring amino acid
MSAKVWVLGDAGRRSLARIRRAXYCLVLAARQLTLPVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTEIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVDCVDSTGAGDAFVAGLLTGLSSTGLSTDEREMRRIIDLAQRCGALAVTAKGAMTALPCRQELE

SEQ ID NO: 34190 - protein, 349 aa, Methanothermobacter wolfeii
METTEVIEGKNITVERTGEENRRLIFQDCLCAVCGLCGEICPVSAIEVNPTGAMVRTEQEKSKIAIDENKCVLCGMCSSICPFQALDLQIDGTSIKELAEYPKIIKSAEIDDETCIQCKACETACPQDAITITRELPERKDLVTGEIEIDKDTCIYCGMCEEMCPVDAIEIDHQTPSSASPVVATDIRVDEDKCVHCGICKRICPVDAIMQVCRICPYGEYEIKTPEVTGTSYIDPELCVNCGWCQEICPVDAATVTKPFEGELIIDQDTCQACETCVMVCPCNVLSFPKPEKPGEKTTKLHKDERFCIYCGACERSCPVTAITVKRNRINTTPIRSKAWKNAFDSLLK

SEQ ID NO: 34191 - protein, 478 aa, Oryza sativa (japonica cultivar-group)
MAGAAAASAAAAAVASGISARPVAPRPSPSRARAPRSVVRAAISVEKGEKAYTVEKSEEIFNAAKELMPGGVNSPVRAFKSVGGQPIVFDSVKGSRMWDVDGNEYIDYVGSWGPAIIGHADDTVNAALIETLKKGTSFGAPCVLENVLAEMVISAVPSIEMVRFVNSGTEACMGALRLVRAFTGREKILKFEGCYHGHADSFLVKAGSGVATLGLPDSPGVPKGATSETLTAPYNDVEAVKKLFEENKGQIAAVFLEPVVGNAGFIPPQPGFLNALRDLTKQDGALLVFDEVMTGFRLAYGGAQEYFGITPDVSTLGKIIGGGLPVGAYGGRKDIMEMVAPAGPMYQAGTLSGNPLAMTAGIHTLKRLMEPGTYDYLDKITGDLVRGVLDAGAKTGHEMCGGHIRGMFGFFFTAGPVHNFGDAKKSDTAKFGRFYRGMLEEGVYLAPSQFEAGFTSLAHTSQDIEKTVEAAAKVLRRI

SEQ ID NO: 34192 - protein, 625 aa, Lactococcus lactis subsp. lactis Il1403
MCGIVGFIDRMNQNDKSKTLEEMMNTIGHRGPSSSGEFIDEGAAIGFRRLSIIDLEGGDQPIFNEDKSKLITFNGEIYNFRELREDLIAKGHDFTTHADTEVLLHGYEEYGVELLQKLRGMFAFVIWDREKQELFGARDHFGIKPLYYTQMGGTFMYGSEIKSFLKHPNFKKELNKEALKPYMTFQYSALDETFFKNVFRIKEGHYFTYKDGVLDIKPYWDMKVDEKDMSLEESIDLIDKTVLGSVDAHKFADVEVGAFVSSGVDSSYVASTLRPEHTYSIGFGQGTFNESKQAKQLTDMIGLNNTSREIHGDEAFKYFPQIQYYLDEPDSNPSCVPLFFLAELAARDVRVVMSGEGADELFAGYESYGFSTNSRAVRVFAEGLKKLPKSLRFSIARGIENKHFKGQKHLYESLAPAEDFFIGQAKVFDESESVELLKEEFKAAPTVKDIVGKTYKKAPEGSELRKMQYLDMHQWMPGDILLKADKMAMAHSLELRVPLLDIELMHTAEQIPTKYLLNEHNTKYAFRQAARRHLPEEWSNRKKLGFPVPIKDWLREEKYYKVVRQLFEQDFVAEFFDQEKLLKMLDDNFADKNDARRKLWTIYSFLTWYDVYFINNGEKPAVVNF

SEQ ID NO: 34193 - protein, 428 aa, uncultured archaeon GZfos3D4
MTSEIKEIKGREILDSRGNPTVEVEVLTESGFGRAEVPSGASTGSNEAWEKRDGDKGKYGGKGVLEAVKSVNTVIKKELVGMDALEQREIDNRLIELDGTENKTKLGANSILGTSMAVCKAAAESLKKPLFAYICENVAGMKLQAELPVPIMNVLNGGEHAGNELSVQEFLILPFGFDRFSDNLRAGAETYHALKKVLAKKYGKIATNVGDEGGYAPPMSRTEEPLEVMTEAISEAGYSESEIRLGMDAAASTFFNAKTQKYVIDGMEKEGSELIDFYQALVDKYPVESIEDPFDEESFELFAELTAKMPQKIIIGDDLFVTNVNRLQEGINKKAANAILLKVNQIGSVSETLDTIRLASENGYKKVVSHRSGETEDTFIADLAVAVNAEIIKTGAPARGERTCKYNQLLRIEEQLGEQARSRKFLKA

SEQ ID NO: 34194 - protein, 224 aa, Lactococcus lactis subsp. lactis Il1403
MDNLKKQVGIKAAEFVKSGMVVGLGTGSTAAYFVEELGRRIAEEQLEITGVTTSNVTSSQARALGIPLASIDEVDYVDLTVDGADEIDSSLNGIKGGGAALLMEKIVATYSKDYIWIVDESKLSENLGSFKIPVEVIPYGSQQVFKKFEAAGYAPTWRLNEENERLITDMHHFIIDLHISQIKEPEKLAEELDLMGGVVEHGLFNNMVKKVIVAGNEGVRIINK

SEQ ID NO: 34195 - protein, 441 aa, Oryza sativa (japonica cultivar-group)
MGASGKWIRTLVGLRPAAEREKERGGGGGKGRKWSRLWRSSSSQRGGGNASASEVYSETSSSADALSSVVAAVVRAPPRDFRLIRQEWAAVRIQTAFRAFLARRALRALRGIVRLQALVRGRRVRKQLAVTLKCMQALVRVQARARDRRARISADGLDSQDMLDERGGRVDHVKEAEAGWCDSQGTADDVRSKIHMRHEGAIKRERARTYAQSHQRCSNHGGRPSSPAVSLKHHGNGATRSNHSWSYLEGWMATKPWESRLMEQTHTENSTNSRCSESVEEVSVGGPKLSDASSVKIRRNNVTTRVAAKPPSMISATSSDFVCDESSPSTSSVTPLSANNSLATERRSDCGQVGGPSYMSLTKSAKARLSGYGSHKPPLQRQRSGDLLHHNNRMAFSSIDVQSTAGSEVSVTSKRLNSLALKGRATRSLDKENERRPSSLL

SEQ ID NO: 34196 - protein, 1081 aa, Crocosphaera watsonii WH 8501
MPRREDLKKILILGAGPIVIGQACEFDYSGTQACKALREEGYEVVLVNSNPASIMTDPGMANRTYIEPLTPDMVEKVIAKERPDALLPTMGGQTALNVAVALAKNGVLDKYNVELIGAKLPAIKKAEDRDLFKEAMNKIGVPVCPSGIASTLKEAKAIGEEIGSYPLIIRPAFTLGGTGGGIAYNQEEFEEMAQFGIDASPVSQILVEKSLLGWKEYELEVMRDLADNVVIICSIENFDPMGVHTGDSITVAPAQTLTDKEYQRLRDYSQAIIREIGVETGGSNIQFSVNPLNGDVIVIEMNPRVSRSSALASKATGFPIAKFAAKLAVGYTLNEINNDITKQTPASFEPTIDYVVTKIPRFAFEKFPGSQAILTTQMKSVGEAMAIGRTFQESFQKALRSLETGRYGFGCDRTETLPSLSQVRSNLRTPNPERVYSIYHAMRLGMTPEEIHELTAIDIWFLDKLQDIIETEKVLKQTNLNDITASDLRAIKQKGFSDRQIAFATKTTEDEVRNYRKGLGIIPVYKVVDTCAAEFEAYTPYYYSTYEPEETEVTVTEKKKVMILGGGPNRIGQGIEFDYCCCHASFSLSDAGFETIMVNSNPETVSTDYDTSDRLYFEPLTKEDVLNIIETENPVGVIIQFGGQTPLKLAVPLQTYLDSPECPVQTKIWGTSPDSIDTAEDRERFEKILNDLNIKQPPNGIARSYEESAVVSSRIGYPVVVRPSYVLGGRAMEIVYSDEELERYMTYAVQVEPDHPILIDKFLQNAIEVDVDALCDATGKVVIGGIMEHIEQAGVHSGDSACSVPFTTLSSNAIETIRTWTTQLANSLKVVGLMNIQYAVQGEQVYILEANPRASRTVPYVSKATGRPLAKIASLVMSGKTLEELGITEEFVPRHIAVKEAVLPFQKFPGADTLLGPEMRSTGEVMGIDEDFGKAFAKAEIAAGVDLATEGTVFVSMSDRDKISTVPVVKDLVDLGFKVVATSGTQKVLEENGIEGVEVVLKLHEGRPHVIDWIKNKQIQFIINTPSGEDSHADGRRIRRTALDYKLPIITTIAGAKATVAAIRSLQTEPLEVKALQDYIS

SEQ ID NO: 34197 - protein, 448 aa, Picrophilus torridus DSM 9790
MEALKGINIKVEPPGPIAKKIIEMDEKYLARSTKSLPIVAKRGYNSYIEDVDGNVFLDFTTGISTTNIGYMNKNVLDAVEEQLHQLWHFAGTDFYYEAQVNAAKALGEVAPGNFNKKVFFANSGAESNEASLKVAKNYTKKRQFIGFIGAFHGRTMGALAFTASKPVQHSMYFPEMPGVVHVPYPNPYRNPFNIDGYENPDELVNRTIDFIEKYTLETYLPADDVAAIMVEPIQGEGGYIVPPENFHRELIKLAHENNILLIMDEVQTGFGRTGYFFASEYFKVEPDIISVAKSIASGIPMGASIFNEKFDFDKEGLHSNTFGGNLLASVACTATINEIKEKKMLENSRKMGKYLNKRLNELKDKYEEIGDVRGLGLMQAIDFVNDRSRRDFNVGLRDRVIERSFKNGLLLLGAGESAIRLIPPLIITEEEIDNAIEIIDESINRELK

SEQ ID NO: 34198 - protein, 258 aa, Mesorhizobium sp. BNC1
MAGEAEPLSSLDCSALKPNSIAIFLDFDGTLADIAERPDEVSVPPTTREALARLLKSTDGAIAIITGRPIEVIDHFLAPLLLPVAGVHGMERRTAGGQHVGSVIDEEELSAVRAKLQAFADSHEGLLLELKHGSLALHYRQRPDLEAASIAAVHAAANDSKGLHLLHGKMVLEVKGGKATKADALTAFMQEDPFRGRTPLFAGDDVTDEDAFNQIAHINGFSIKIGGGKTSARFRADEASSFREWLERLAARFESRDY

SEQ ID NO: 34199 - protein, 196 aa, Oryza sativa (japonica cultivar-group)
MAGRKRKAEAARAAEEEADRALYGAFRGAANSLSQLYALAGAHQRLSFHAGERHALEKLYQWMVRQHEIGLRLTVSDIASHIQHEIEYGGDNALTSPRSQHAFQNLQAPMHIPNTSTQQPPSCSITPSNPSKDSMIFSKALSSPVRQNLQLYHVQQCGDTGCFADGIFCPGNGDSDPAASNDSSVDMHSDSPGHDS

SEQ ID NO: 34200 - protein, 416 aa, Francisella tularensis subsp. holarctica
MRKIIVIGAGFVGINLLNKIAKQSKNKYHIILFDKNNHHVFQPMLYQAATAFIPLNNVVVPIRKLFTQENIEFKIDILPEEQLVKTAANILYSYDYLIVATGIEYDYLGNDQWREYTFCLKSAYDAQKIKSHILSQFELAEVAQTDEEKRYHLSFIIIGAGATGVEITGALLDLLHTDFLKTYHNFSIDDISIHLIEGGENILSAFPKELSNHAYDSLKARRVNIHLKEPVTNILDSRVTTEKDSYRGATIIWSTILKGKGIGNWMSSQIEKGKIAVLDDLTHRDFKNIYFAGDISYIKNNPLPGLAAVAKQQGKYIAKTIIKRDKNKAYNDFKYKDLGTMAIIKKHEAIANIFGMKFKGKLGWFIWGGVHITFLISIRNKFVVSFNWLSYYICKRIGSIEFIKSKKTKKVNKFEN

SEQ ID NO: 34201 - protein, 770 aa, Mesorhizobium sp. BNC1
MVVKKTRSDLDEAALFFHRYPVPGKLEIQPTKPLGNQRDLALAYSPGVAAPCLAIHEDPATAADYTSRANLVGVVSNGTAVLGLGDIGPLASKPVMEGKAVLFKKFAGINVFDIEIDAPDVDRMVETISALEPTFGGINLEDIKAPECFEVEERLKERMKIPVFHDDQHGTAIIVAAAVLNGLELAGKDIASVKIVTSGAGAAALACLNLLVSLGVKTENIWITDRHGVAYRGRVEEMDRWKEPYLKDTEARELADVIDGADVFLGLSAGGVLKPEMLKGMAERPLILALANPNPEIMPDVARKARADAMICTGRSDFPNQVNNVLCFPYIFRGALDVGATAINEEMKLAAVRAIAALAREEPSDVAARAYSTETPVFGPDFLIPSPFDPRLILRIAPAVAKAAMESGVATRPIEEMDAYLDRLNRFVFRSGLVMKPVFSTAKQIGRKRVIYADGEDERVLRAAQVVLEEGLAQPILIGRPHVVEMRLKRYGLRIKPGVDFEIINPEDDPRYRDYVDLLIRIAGRRGVTTEVARTLVRTNATVIAALAIMRDEADAMICGLEGRFERHLRYVEAIIGRREGVQDLSALSMLITQQGVVFLTDTYVTLDPSAAEIAEMTVLAAEEIRRFGIDPKAALLSHSDFGSRDSASAMKMREAVGILHRIAPDLIADGEMHGDAALSEELRQRVYPHALLKGEANLLVFPNLDAANITLTTLKVMTDALHVGPILLGMARPAHILTPSVTSRGIVNMTALSAVEALQSQNRQLNLPG

SEQ ID NO: 34202 - protein, 418 aa, Bordetella pertussis Tohama I
MAEIKNYTLNFGPQHPAAHGVLRLVLELDGEVIQRADPHIGLLHRATEKLAEHKTFIQALPYMDRLDYVSMMCNEHAYVMAIEKLLGIEAPLRAQYIRVMFDEITRVLNHLMSLGSHALDVGAMAVFLYAFREREDLMDCYEAVSGARMHAAYYRPGGVYRDLPDTMPQYGDSSKYRGEKEVRAMNDARSGSLLDFIEDFTNRFPSCVDEYETLLTDNRIWKQRLVGIGVVDPDRAKALGFTGPMLRGSGVAWDLRKTQPYEVYDLMDFDVPVGVNGDCYDRYLVRVAEMRESNRIIRQCVEWLRNNPGPVMIENHKIAPPSRTAMKSNMEELIHHFKLFSEGFHVPPGEAYAAVEHPKGEFGIYLVADGANKPYRLKIRAPGFAHLQSLDEMARGHMIADAVTIIGTQDIVFGEIDR

SEQ ID NO: 34203 - protein, 173 aa, Thermotoga maritima MSB8
MFKLDLKRFIRDIPDFPQKGIVFRDITPLLRNQEAFKEAIDRMCELVFDREFDLVVAPEARGFILGAAMAYKLGKGFVPVRKPGKLPYKTVYEEYQLEYGTEQLHIHEDAIEKGQKVLIVDDVLATGGTAEALIRLVKKLGGEVVSLAFLVELSYLEPRKRLEGYDVKTLIVY

SEQ ID NO: 34204 - protein, 347 aa, Arabidopsis thaliana
MAEEFKATASICGGGGGAWWNSPRSVMSPSDHFLSPCFGAAITSNDFSSQENHLKSRMTCTDNNNIVFGQREADSDSGGSTVTMDSTLQMMGLGFSSNCSSDWNQTILQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTVLSTPYMKQGASNQQQQQVQYTI

SEQ ID NO: 34205 - protein, 162 aa, Bordetella pertussis Tohama I
MEAIKDFFGSLLLTELFKGLRLTGKYFFKRKVTLRYPMEKTPTSARFRGLHALRRYPNGEERCIACKLCEAVCPALAITIESEQRDDGTRRTTRYDIDLTKCIFCGFCEESCPVDSIVETHIHEYHGEKRGDLYFTKDMLLAVGDRYEAEIARRRAEDAPYR

SEQ ID NO: 34206 - protein, 99 aa, Brassica napus
  misc_feature (4)..(4): Xaa can be any naturally occurring amino acid
  misc_feature (11)..(11): Xaa can be any naturally occurring amino acid
  misc_feature (29)..(29): Xaa can be any naturally occurring amino acid
  misc_feature (31)..(31): Xaa can be any naturally occurring amino acid
  misc_feature (44)..(44): Xaa can be any naturally occurring amino acid
  misc_feature (58)..(58): Xaa can be any naturally occurring amino acid
  misc_feature (61)..(61): Xaa can be any naturally occurring amino acid
  misc_feature (64)..(64): Xaa can be any naturally occurring amino acid
  misc_feature (72)..(72): Xaa can be any naturally occurring amino acid
GVLXENKTQGXVRTEAIRSRNGVDAKIAXTXERKEKKPRLSISXSKLEIDEDIYSLTXSKXSRXPKKRAKNXQKQLDVLFPGLWMGNVSADAYKVSEHA

SEQ ID NO: 34207 - protein, 915 aa, Streptomyces avermitilis MA-4680
MASGSDRNPIIIGGLPSQVPDFDPEETQEWLDSLDAAVDERGRERARYLMLRLIERAREKRVAVPEMRSTDYVNTIATKDEPFFPGNEEIERRILNATRWNAAVMVSRAQRPGIGVGGHIATFASSASLYDVGFNHFFRGKDEGDGGDQIFFQGHASPGIYARAFLLDRLDERQLDAFRQEKSKAPYGLSSYPHPRLMPDFWEFPTVSMGLGPLGAIFQARMNRYMEARGIADTSKSHVWAFLGDGEMDEPESLGQLSIAAREGLDNLTFVVNCNLQRLDGPVRGNGKIIQELESQFRGAGWNVIKLVWDRTWDPLLAQDRDGVLVNRLNTTPDGQFQTYATETGDYIRRHFFGDDHRLRAMVEHMTDDQILHLGRGGHDHKKIFAAFSAAKAHKGQPTVILAQTVKGWTLGPNFEGRNATHQMKKLTVADLKGFRDRLHLPISDKQLESGPPPYYHPGRDSEELQYMHDRRKGLGGYVPTRVVRSQPLALPDDKTYAGVKKGSGQQSIATTMAFVRLLKDLMRDKEIGKRFVLIAPDEYRTFGMDSFFPSAKIYNPLGQQYEAVDRDLLLAYKESPTGQMLHDGISEAGCTASLIAAGSAYATHGEPLIPVYVFYSMFGFQRTGDQFWQMADQMARGFVLGATAGRTTLTGEGLQHADGHSQLLASTNPGCVAYDPAFGFEIAHIVQDGLRRMYGSSEEYPHGEDVFYYLTVYNEPIQHPAEPENVDVEGILKGIHRFSEGTAGSIPAQIIASGVAVPWAVEAQRILAEEWNVKADVWSATSWNELRREAVEVERHNLLHPEEEQRVPYVTQKLSAAEGPFVAVSDWMRSVPDQISRWVPGTYQSLGADGFGFADTRGAARRFFHIDAQSIVVGVLTELAREGKVDRSVLKQAIDRYQLLDVAAADPGAAGGDA

SEQ ID NO: 34208 - protein, 422 aa, Schizosaccharomyces pombe 972h-
MDRRHRVYRVFNQEMYVEPNFKVVKELGQGAYGIVCAARNVASKDQEAVAIKKITNVFSKSILTKRALREIKLLIHFRNHRNITCIYDLDIINPYNFNEVYIYEELMEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 34209 - protein, 557 aa, Schizosaccharomyces pombe 972h-
MCGILAVHHVAEDIEAFKPKALHLSKQLRHRGPDWSGKAIRNQTILCHERLAIVGVESGAQPLVSDDGKLVLTVNGEIYNHLKLRENLKGNYKFKTYSDCEVILYLYREHGPACANMLDGMFSWVLYDQDKDKVVAARDPIGITTLYQGFSSDSPDTAYFASELKALHPVCDKIIAFPPGHYYDSETKQTVRYFKPSWWDENKIPSNPVDYKLLRETLEASVRKRLMAEVPYGVLLSGGLDSSLIASIAARETEKLANSTSQSEEARTITAWPKLHSFAIGLPGSPDLLAARKVADFLHTFHHEHTFTIDEGLDALRDVIYHLETYDVTTIRASTPMYLLSRKIKAQGVKMVLSGEGSDEIFGGYLYFGNAPSREAFHSECVRRVKNLHLSDCLRANKSTMAWGLEARVPFLDKDFLEVALNIDPEEKMYINGRKEKYILRKAFDTTHDSSLQPYLPQDILWRQKEQFSDGVGYSWIDALKDTAELCISDDEFALPRREWGDDIPTTKEAFWYRKLFDEIFPRQCADTVMRWVPKAEWGCPEDPSGRYQAGHVAALK

SEQ ID NO: 34210 - protein, 314 aa, Shigella flexneri 2a str. 2457T
MLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 34211 - protein, 336 aa, Lactococcus lactis subsp. lactis Il1403
MVVKVGINGFGRIGRLAFRRIQNVEGVEVVAINDLTDPAMLAHLLKYDTTQGRFDGKVEVKDGGFEVNGKFVKVTAESNPANINWAEVGAEIVLEATGFFATKEKAEQHLHANGAKKVVITAPGGSDVKTIVFNTNHEVLDGTETVISAGSCTTNCLAPMADTLNKQFGIKVGTMTTVHGYTGDQMTLDGPHRGGDFRRARAAAENIVPNSTGAAKAIGLVLPELQGKLQGHAQRVPVPTGSLTELVTILNKEVTVDEINAAMKAASNESFGYNEDQIVSSDIVGISNSSLFDATQTEVTSADGAQLVKTVSWYDNEMSYTSNLVRTLAYFAKIAK

SEQ ID NO: 34212 - protein, 448 aa, Oryza sativa
  misc_feature (195)..(195): Xaa can be any naturally occurring amino acid
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARXNRPMQGDDEAYNLVLNFKEAVLGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLVRVQVEIPKRLSSDERKLIEELANLNKAQTANSRR

SEQ ID NO: 34213 - protein, 469 aa, Mesorhizobium sp. BNC1
MTTAQDILKQIKDNDVKFVDLRFTDPKGKLQHVTMDVVAVDEDMFADGVMFDGSSIGGWKAINESDMVLMPDPETAHVDPFFAQSTMVVYCDILDPISGEAYNRDPRGIAKKAEAYLRAEGIGDTVFIGPEAEFFVFDDVKYKADPYNTGFKLDSSELPSNDDTDYETGNLGHRPRVKGGYFPVPPVDSLQDMRSEMLSVLTEMGVVVEKHHHEVAAAQHELGLKFDTLVRNADKMQIYKYVVHQVANAYGKTATFMPKPIYGDNGSGMHVHLSIWKDGKPTFAGNEYAGLSESCLYFIGGIIKHAKAINAFTNPTTNSYKRLVPGFEAPVLLAYSARNRSASCRIPFGTSPKSKRVEVRFPDPTANPYLCFSALLMAGLDGIKNKIHPGQAMDKDLYDLPPKELKKVPTVCGSLREALMSLDKDRGFLKAGGVFDDDQIDAYIELKMAEVLRFDMTPHPVEFDMYYSV

SEQ ID NO: 34214 - protein, 133 aa, Staphylococcus aureus
SLHAAKDEVRSRLMPINRAYNVEKLIEAIQYYQEKTNRRVTFEYGLFGGVNDQLEHARELAHLIKGLNCHVNLIPVNHVPERNYVKTAKNDIFKFEKELKRLGINATIRREQGSDIDAACGQLRAKERQVETR

SEQ ID NO: 34215 - protein, 549 aa, Aspergillus oryzae
MSYTWGSLFTGSKILFYILFWGSHILVFALGWYFQANNSRLDALNALKYSVWISRGAGLVLTFDGTLILLPMCRNIVKTLRPRIRWLPLDESIWFHRQVSYALLIFTILHVAAHYVNFYNVEKDNIRPVTAVQIHFTEAGGITGHVMLLCMMLMYTTAHHRIRQQSFETFWYTHHLFVPFMLALYTHATGCFVRDSTDPYSPFAGKDFWNHCIGYEGWRWELVAGGLYLLERLYREIRARRGTVITKVIRHPYDAMEIQFQKESMRYKAGQWLFIQVPEVSSNQWHPFTITSCPFDPYISIHVRQVGDFTRALGDALGCGPAQARDLEGLDPLGMYEVALENGQKMPQLRVDGPYGAPAEDVFENEIAVLIGTGIGVTPWASILKNIWHMRAGPNPPRRLRRVEFIWVCRDTSSFEWFQALLSSLESQSAYEAANEGRAEFLRIHTYLTQRLDDDTAANIYLNSVGQEVDPLTELKSRTNFGRPNFQRLFTAMRDGLQDGTYMPGLYAEFSTQIGVYFCGPNAAARQIREAGALSATKDIKFKFWKEHF

SEQ ID NO: 34216 - protein, 496 aa, Mesorhizobium sp. BNC1
MHEILSPEEMGRADRFAAEAGPLESYDLMRNAGAAVTAEILARFADRTGFDVLCGPGNNGGDGYIVARLLHERGLDVRIWRETEPRPGTDAARAAAEWPMRVGTLGNFAPEAGRLVVDALFGAGLAKPVEGVYAEALEKTVAAKSPVMAIDLASGVSGESGKILGTAAPAQVTVTFFRKKPGHLLYPGRTLCGEVVVADIGIPEDVLKTIRPRCRENAPEFWKALLPRPHIETHKYERGHAAVFSGGPSATGAARLAARGAARIGAGAVTLLSPATALAVHAMHLTSIMLKRVEAVDELDVFRRSRKASAYLLGPGFGVSEKARVFAAAVLRSSEEAPAHLVLDADGISAFSEEPELLFAEAAGTPGNLVLTPHLGEFSRLFPDLAADEQLSKLGKARAAAARSGALILLKGPDTVIAAPDGNAVINTNATPYLATAGSGDVLAGMITGLLAQGMPAFEAAAAAAYLHAEAARAFGPGLIAEDLPEMLPEVLKRFL

SEQ ID NO: 34217 - protein, 429 aa, Escherichia coli K12
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 34218 - protein, 490 aa, Burkholderia vietnamiensis G4
MPLTLSRTELVRTANLVDGSWRAALDGRCFDVTNPATLDTIAYAPDSGAADARAATDAAARALPAWRATPARERAAILRAWHAAIVAHTDDLAKLMSLEQGKPLAEARGEVAYGASYVLWFAEEATRTYGDLIPQQQRGKQLSAVKVPIGVVAAITPWNFPLAMIARKIAPALAAGCTVVAKPAEDTPLTALALGFLAMEAGVPPGVLNLIAASRERGIDAVADWLADARVRKITFTGSTAVGKLLARESAATLKKLSLELGGNAPFIVFDDAQLDAAVDGLMAAKFRNGGQTCVSPNRVYVQAGVYDAFAAKLAARVAALKVAPATDPAAQIGPMINARAVDKIARHVGDALERGARVLTGGRRLSQLGPNYYAPTVLADATADMQLSCEETFGPVAALFRFDTEEQAVDAANDTPFGLAAYFYTQDVRRIARVSARLETGIVGINEGALASEAAPFGGVKESGYGREGSKYGLDDYLSIKYLCQGGLD

SEQ ID NO: 34219 - protein, 412 aa, Escherichia coli O157:H7 EDL933
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAILESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 34220 - protein, 404 aa, Magnetospirillum magnetotacticum MS-1
MLHGKVLVAQGGGPTAVINQSMVGAVLESRKFRNVDLVYGAHHGVRGIVNEDFLDLTQETSHNLEMVAQTPSSGLGSTRDKPDLKYCHEIFEVLKAHGIAYFFYIGGNDSSDTVRIVSEEARKAGYPLRCIHIPKTIDNDLVLNDHTPGFPSAARFVAQAFMGVNLDNAALRGIYLAVVMGRHAGFLTAASALGKKFPEDGPHLIYIPERTFRVDSFLTDVKATYDKYGRCVVALSEGIHDEDGAPIITKLSKATEKDAHGNIQLSGTGALSDLLCEEIKGKLGIKRVRGDTFGYLQRSFIGCVSDVDQREAREVGEKAVQFAMWGDQDGSVTIQRTGFYSVDYKLLPLAAVAGKTRVMEDHFIAESGTDVTDSFRMYLRPLLGSGMPDAFRLRLNSVPRILKK

SEQ ID NO: 34221 - protein, 466 aa, Burkholderia vietnamiensis G4
MNQAALIEADRQHLIHPVVNYRAHEARGVTVLESADGVFLRDGDGHTLLDAFSGLWCVNVGYGRESIVKAAAEQMAKLPYATGYFHFGSQPAIELAERLAALAPPSLNRVYFTLGGSDAVDSAVRFITHYFNATGRPSKKQMIALERGYHGSSSIGAGLTALPAFHRHFDLPRADQHHIPSPYPYRHPLGDDPQALIAASVAALEAKVAALGADNVAAFFCEPIQGSGGVIVPPAGWLKAMRDACRRLGILFVADEVITGFGRTGPLFACETESVEPDLMTVAKGLTAGYAPMGAVLMSDEIYEGLAGSRTESAVVGHGHTYSAHPVSAAIGLEVLKLYHEGGLLANGRAQAPRFAAGLDALRAHPLVGDARSAGLLGALELVADKARKTRFDPALNVPDKIAAAAYANGVVFRAFGDGVLGFAPALSFTAGEFDLMFERVRKTLDDVLADPGVQRALDAAHAQPA

SEQ ID NO: 34222 - protein, 221 aa, Synechococcus sp. RS9916
MSRRQALRVMETSYLAATAALIWLALYYLPVGGALFRLALPLPLALLLLRRGGKAGVEGVLLVVLLLVALMGPVRGPLILFPYGFLSLWLGWCWLRGMSWWISWGLGTLIGAAGFLVRVVALSLLVGENLWVVITRAGDNMLNGLIGVINNALAFVQVPLRLSIAPDLEQVQLMALALVLVQQLIYVLALHALSYWIFPRLKAPIPSPPKALEGLVALDPL

SEQ ID NO: 34223 - protein, 499 aa, Glycyrrhiza echinata
MDILSLLSYSVFYLALFFIFNIVIRARKFKNLPPGPPSLPIIGNLHHLKRPLHRTFKGLSEKYGHVISLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEIELSYRFYDMTFNNIMRMISGKRYYGEDCDMSDLQEASQFRDMVSELLQLSGANNKTDFMPLLRFLDFENLEKRLKDISGKTDAFLRGLIQEHRAKKERANTMIDHLLNLQDSQPEYYTDQIIKGLALAMLLAGTDSSAVTLEWSMSNLLNHPEVLKKVKDELDTHVGQDRLVDESDLPKLSYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLTNGDKIDMAERDGFTLTKLVPLKAMCKSRPVINKVFKQ

SEQ ID NO: 34224 - protein, 523 aa, Glycyrrhiza echinata
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQESGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFCPERFLKLEGDSSGVVDVRGSHFQLLPFGSGRRMCPGVSLAMQEVPALLGAIIQCFDFQVVGPKGEILKGDDIVINVDERPGLTAPRAHNLVCVPVERRSGGGPLKIIEC

SEQ ID NO: 34225 - protein, 397 aa, Synechococcus sp. RS9916
MLTSRRLDRLGSGVFDRNDQRKQLYRSSAAADSQPLVDLSLGSTDLEPPPEALEAMAAALDRSGSATYCLHAGTRPFREAVSAWCARRFDVAVDPDREVLLLVGSQEGTAHLPLAVLNPGDGGLILDPCYPSHRGGLLLADARVEHLPLDPQEQWRPRFDSLSDTVWDQLRLMVMGFPHNPSAQVGQQAWLDEAMARAQRHDLVFAHDNPYVDLALDGEAPSLLRCAGWRERGMEFFSLSKGWCLGGFRLGFAVGAEPLITALRQLKGVVDFNQSLALQEGAMAALSQAPDWPQRLLPVYRERRDRTLQALARLGWQVPTPSMALYLWLPLPGWARERGWNDEQLTAALLEQTGLALTPGSGFGAGGQDWMRMALVRPVEELEAAVARLESFWQQQC

SEQ ID NO: 34226 - protein, 548 aa, Thermus thermophilus HB8
MKPWYAHYDPGVPKEAPAPRLLPEALAETARRFPKKVALEFLGRRLTYAALWREVEAFAKGLQEAGLKPGDRVALMLPNSPQFVIAFYGTLLAGGVGVNTNPMYTPRELHHQLRDAGARFLVILDQLLPRYLEVKGEVPVEKVVRTGIQDYLPFPKNLLYPLLLRRKGEAPKALEGLPWRAFLRPGTPRPVPLDLDDLALLQYTGGTTGLAKGAMLTHRNLSANALQVRAWIPDFREGEEVVLGAIPFFHVYGMTVAMNLALLGGAKLVLLPRPEIKAIVEAIEKHQVTLFPGVPTLYVAFNNFPGIERRDLKSVRACISGSAPLPLEVAERFERLTGAKLVEGYGLTEASPVTHCNPLYGERRLGSVGLPFPGVDAKVVDEEGKELPPGEVGELAVKGPNVMKGYWNRPEETQKTLKDGWLFTGDLAKMDEDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILKRELQKEVAAKR

SEQ ID NO: 34227 - protein, 400 aa, Crocosphaera watsonii WH 8501
MSKKTIANLSAADLAGKRVLVRVDFNVPFDNGSITDDTRIRAALPTIKELISNGAKVILCSHMGRPKGKVVDSMSLTPVAARLGELLGQKVTMCDDCVGESVTAAIGGLENGQVALLENLRFHSEEEGNDPEFAKQLAANADLYVNDAFGTAHRAHASTEGVTHYLSPSVAGYLIEKELQYLQAAIENPQRPLVAIIGGSKVSSKIGVIETLLEKCDKLIIGGGMIFTFYKARGLNVGKSLVEDDKLELAKSLEAKAKEKGVDFLLPSDVVLADNFAPDANAKTTSIDNIEDGWMGLDIGPDSIKLFQDALSDCKAVIWNGPMGVFEFDKFAAGTEAIARTLAELTGTGTTTIIGGGDSVAAVEKVGVAEKMSHISTGGGASLELLESKVLPGIAALDEA

SEQ ID NO: 34228 - protein, 429 aa, Staphylococcus epidermidis ATCC 12228
MKFTESERLQQLSNEYILGGVNSPSRSYKAVGGGAPVVMKEGHGAYLYDVDGNKYIDYLQAYGPIITGHAHPHITEAIQDQAAKGVLYGTPTELEINFSKKLREAVPSLEKIRFVNSGTEAVMTTIRVARAYTKRNKIIKFAGSYHGHSDLVLVAAGSGPSQLGSPDSAGVPQSVAQEVITVPFNDIESYREAIDYWKDDIAAVLVEPIVGNFGMVMPQPGFLEEVNKISHDNGTLVIYDEVITAFRFHYGAAQDLLGVKPDLTAFGKIVGGGLPIGGYGGRQDIMEHVAPLGPAYQAGTMAGNPLSMRAGIALLEVLEQEGVYDKLDQLGRRLEEGLQKLIDKHHITATINRIYGSLTLYFTNEKVTHYEQVENSDGDAFAQFFKLMLNQGINLAPSKFEAWFLTTEHTEEDIDRTLEAADYAFSKMK

SEQ ID NO: 34229 - protein, 97 aa, Triticum aestivum
FLRVTPTLPNTFINLASPIVDVPYHTFLLGTLIGLIPAAYVTVRAGIALGELTSLSDLYDTQSIALLFLIGVVSVTPALLGKDEAQEKPSEMVVGAS

SEQ ID NO: 34230 - protein, 90 aa, Glycine max
  misc_feature (25)..(25): Xaa can be any naturally occurring amino acid
RKTIAISLRGKGGTPLNKGGAKRHXKGLRDNIQGITKPAIRRLARRGGVKRISGLIYEETRGVLKIILENVIRDAGTYTEHARRKTGTGM

SEQ ID NO: 34231 - protein, 841 aa, Crocosphaera watsonii WH 8501
MRAVLMAGGSGTRLRPLTCDLPKPMVPILNRPIAEHIINLLRRNNITEIIATLYYLPDVMRDYFQDGREFGVEITYAVEDEQPLGTAGCVKNVEDLLQNTFLVISGDSITDFDLQAAIAFHRQKKSKATLVLTRVPNPMEFGVVITDQEQKISRFLEKPSSSEIFSDTVNTGTYILEPEVLEYLPLKQESDFSKDLFPLLLAKGEPMYGYIAEGYWCDVGHLDAYREAQYDALEKKVKLYFAYTEESPGIWLGQNTYIDPTARIEPPALIGDNCRIGSGVVIEQGCVIGDNVTIGAVSDLKRPIIWNGVTIGDESYLAACVIARGTRLDRRAQVLEGAIIGPLSIVGEEAQISSNVRVWPSKRIESGAILNINLIWGSTANRNLFGQRGVTGLANIDITPEFAVKLGAAYGSTLKAGSQVVVSRDQRGFSRMISRSLISGLMSVGIDIQNLEATAIPISRTMTPKLGVSGGVHLRAHPDRMDHILIEFFDDEGINISKSQEKKIEGAYFKEDLRRVGIADIGIMAYPAQIIETYRQTFETQLDLDSISNSEPKIVIDYAYGVSGAILPQLLTKFGCDAIVLNASLRQTSVPTEERESLLHQLGQVVEAVKANLGAQVSANGEQFILVDESGLPIRGEWLTALMVNTIFTAYPRSIVVVPVEASSAVEQIARRHDGRVIRTKSNPTALMEAAQANSNVSLGGSGDTGFIFPQLHPGFDAMFSLAKLLEMLATQGRSLVQIQAELPRICHKSYVLRCPWKIKGALMRYLVEIHHHEQLELIDGVKIINPQNDNWVLILPDAGDAFVHIVANSDDREWVDVTLREYRHKVQKFIEHEQDNLNSM

SEQ ID NO: 34232 - protein, 1086 aa, Anaplasma phagocytophilum HZ
MPKRTGIESILIIGAGPIVIGQACEFDYSGTQACKVLREEGYRTILVNSNPATIMTDPDLADSTYIEPITANFIEQIIIKEKPDALLATVGGQTVLNVALELFDKGVLSEHNVEMIGTNHTAIRKAEDRGLFREAVHKVGAKCPKSVIIRQGDPIAPALEYIGLPAIIRPSFTLGGIGGGIATTEAEFYAAVERGFVMSPTSEVQVDESIIGWKEFEMEVMRDCRDNCIVVCSIENIDPMGVHTGDSITVAPALTLRDEEYQKMRNISFDILREIGVETGGSNVQFAVNPQRDGEIVVIEMNPRVSRSSALASKATGFPIAKIAAKLAVGYTLDEIVNDCAISIPASFEPVMDYVVVKIPRFDFAKFRVPDQALSTSMKSVGEVMAIGRSLPEALQKALCSLEVGYTGLNEVFDENTCIEHVYKELANPSPGRILMIADAIRMGVSSQKINEITCYDPWFIQQISRIIACESDIKQNGLPTTKEDLLYLKKMGFSDARLAELGNVSVDYVEDLRQKLSVNPVYKRIDTCAGEFRTNTAYMYGCYEGDSINTPECESHVTAKEKVIILGSGPNRVGQGIEFDYTCVHAAFTVKQLGLEAIMINCNPETVSTDYDISDRLYFSPVSRECVLDIIRNESQGAASVKVIVQLGGQTPLKLAKILKEKAVHVIGTDFESIDLAEDRMKFKGLLQSLGLKQPRSITCVTAEEVLRKVEEVGYPVLLRPSYVIGGQFMSVVRDRSALSSYLHINKNVFDTGCLLIDEFLNDAVEVDVDAICDGDNVYIAGIMEHVEEAGIHSGDSACSLPYYTLGKEIVDLIAECTKKVASALNVRGLLNIQYAIKDKELYVLEVNPRASRTVPFIAKASGVPVAKIATSVMLGNKLSIDQEINEMPYTAVKEAVFSFSRFASADPLLGPEMKSTGEVMGIDETFGMAFLKSQAAAGYELPTSGKVFISVKNSDKPAAAVLAKKLIALGFEVLSTKGTNNYFNELNIPSTHVNKVREGSTHIVDMLNNNEISLVINTSEGIKTISDSADIRRTAMMKKIPHSTTLAAAKATVISLEELAAGRTPKVIPVREYHEKNRHRRKAE

SEQ ID NO: 34233 - protein, 342 aa, Frankia sp. CcI3
MRLAVIGGDGIGPEVVAEGLRVLRAVHPKVDTTEYDLGARRWHETGETLPDSVLEELRGHDAILLGAVGDPGVPSGVLERGLLLRLRFEFDHHVNLRPVRLYPGVRSPLAGDPAIDMIVVREGTEGPYAGAGGVLRKGTPHEVATEESLNTRYGVERVVRDAFRRADRRERRHLTLVHKNNVLTKAGDLWSRTVAEVAPEFPDVRVDYQHVDAASMFFVTDPGRFDVVVTDNMFGDILTDIGAAITGGIGLAASGNLDPSGVHPSMFEPVHGSAPDIAGRQLADPTATVASVAMLLDHLGHAEEAAKVEAAVASSLADRAAAGAAQPSTRERGEDLAARAAG

SEQ ID NO: 34234 - protein, 486 aa, Magnaporthe grisea 70-15
MASIDRYRPAGRESYQPPSLPPKPPPPSDRQSRSPTRRHGAALVPPAAPSPPVHSSRNSPPRPGMARRGPLAASPLRPPATPAPKPRKNSQWFFTPDEIRSTPSIADGLRPADERMRRAKGVSFIYQAGVLLELPQITLWVAAVFFHRFFMRVSLVEEKGGVHHYNIAATSLFLANKTQEDCRKTKDLIISVARVAQKNANLIIDEQSKEYWRWRDSILMHEEIMLEILTFDLMVKVPYQPLFENLKELGLQHNKRLRDAAWAYLNDSCFSTLPLLMSAKDIAASAILFASATTGEKVEDINGEPWWVLIKADESRIVQAINVIVDFYTENPLGKKTDRLPGSPEFSLESTRRRGDTILSQQTDASSYNGTPMETDQDGTQSPGVRLNGKPDRDSSGSNSAGKEELRREPNGGAPLRSDVKGDSDAALKAAANDLDAQDEGLVSPNINDVASPSGTKRSGGASDADRDRKRARLSDEDEDEGEVPE

SEQ ID NO: 34235 - protein, 586 aa, Ustilago maydis 521
MEADEQLFPIAILIDELKSDDVTLRLNAIHRISTIALALGPERARDELIPFLQDSLDDEDEVLLALAQELGSGFVEYLGGPPYAHLLLGPLENLAAVEESVVREKAAESIVKIAEVLSEAQIEEHYIPLLKRLSGGDWFTSRTSSTSLFSAVYPKAKPTTQEELRKMFTALCNDDTPMVRRAAARDLGPFAKNLSKELVVSDIIPLYRKLSSDDQDSVRLLTVQDLIAIAESLNHDESKNYLLPSIRSAVQDKSWRVRYMVADHFVKLASAVGEDVVRDELVMAFVHLLKDNEAEVRTAGAGQIPGFAKLVDQDIILARLMPCVRDLAGDNSQHVRAALGMQISGMAPLLGKEATIEHLLPLFLQLLKDEFPDVRLNIISKLEQVNEVIGIDLLSQSLLPAIVELAEDKQWRVRQAIIEYIPLLANQLGVQFFDEQLSNLCMSWLGDTVFSIREAATVNLKKLTDVFGVAWARQTIIPKVLQMGTHPNYLYRMTTIFAITTMAPSLDTPAITGDVLETVLPMVSDPIPNIRFNVAKAFEVLSSVLVKTPEGNEVIKSKISPALEKLKEDSDADVRFFAQKALDAES

SEQ ID NO: 34236 - protein, 323 aa, Rhodopirellula baltica SH 1
MTLHPQAQTFVALLRELQPPRWEDLGVAKARRGFSALVDNFGAGPAMASVEDQVVEEQNCDGQVSRIPVRIYRPDDVSELAPVVMFFHGGGWVLGDVESHDTTCRRLAAASRAAVVSVEYRRSPESPFPGPVHDCFVATKAVAKNGISWGLDASRLAVMGDSAGGNLAAAVALLAKDDPDVAVKYAVLVYPVVSPAFDSESYREFESGFGLTKRTMQWFWGNYFGRAGEDFFGVDRVSDADPLADLMKADFSDFPPAHVLVAGYDVLRDEGLALADKIEASGGDVTRENASDMLHGFIHFAGQFETGVTAMQSLGNRIANQLS

SEQ ID NO: 34237 - protein, 321 aa, Escherichia coli O157:H7 EDL933
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEAIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDNPGLLGSGAHLRQTLGHIL

SEQ ID NO: 34238 - protein, 412 aa, Escherichia coli O157:H7 EDL933
  misc_feature (385)..(385): Xaa can be any naturally occurring amino acid
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLAMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKXVKQTGWVIVVLVVALNIWLLVGTALGL

SEQ ID NO: 34239 - protein, 339 aa, Bordetella pertussis Tohama I
MKRKTLTQYLVEQQRSAQALGPEVRLLIEVVARACKAISHAVSKGALGGVLGSLESENVQGEVQKKLDVLSNEILLEANEWGGHLAAMASEEMETIHLIPNRYPKGEYLLLFDPLDGSSNIDVNVSIGTIFSVLRAPHRVAGADVCEQDFLQPGSQQVAAGYAVYGPQTMLVLTIGNGVVGFTLDREMGSWVLTHESMRIPEDTKEFAINMSNMRHWAPPVKRYIDECLAGKTGPLGKDYNMRWIASMVADVHRILTRGGIFMYPWDAREPGKAGKLRLMYEANPMGLIVEQAGGAAIDGTGRILDIQPDKLHQRVSVILGSKNEVERVGRYHAEAHAS

SEQ ID NO: 34240 - protein, 615 aa, Bacillus halodurans C-125; identical to SEQ ID NO: 1227

SEQ ID NO: 34241 - protein, 287 aa, Bacillus halodurans C-125
MTKQYPSSQPPQHQMKQPGIEQEMNPRPVFDRADYRGSGKLSGKVALITGGDSGIGRAVAVAFAKEGAKVAISYLDEHGDANETKQYVEQIGGVCHLLPGDVGEEAICQQIVQETVNQFGRLDIVVNNAAEQHPQAGLEAIDSTQLEQTFRTNVFSFFYTTKAALPHLQQGASIINTTSITAYQGSKDLIDYASTKGAIVALTRSLSESIVGQGIRVNGVAPGPIWTPLIPASFDAQKVAQFGSDTPMKRAGQPEELAAAYVYLASDDSSYVSGQVLHVNGGVIVNG

SEQ ID NO: 34242 - protein, 113 aa, Crocosphaera watsonii WH 8501
MTDTIFGKIIRREIPANIVYEDDLCLAFTDVNPQAPTHILVIPKKPIPKLEEAQEDDQNLLGHLLVTVKKVAQQAGLNNGYRVVINNGNDGGQTVDHLHLHILGGRSLSWPPG

SEQ ID NO: 34243 - protein, 424 aa, Bacillus subtilis subsp. subtilis str. 168
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 34244 - protein, 192 aa, Magnaporthe grisea 70-15
MPAYNSVFNGDPSPRLVGNFPLLPLRTKTRGPAYTLPYPNPPVPLNDAPEPDSESYDILDEVLLLFRANTFFRNFEIQGPADRVLIYGILFVSECLTKIKPTAGVRDATKDVQNLALDNNFAIPGDPGFPLNQMYEAPRDRQDAELLRQYMAQCRQELAIRLLARVYEEGGDGKPSKWWLSFTKRKFMGKSL

SEQ ID NO: 34245 - protein, 400 aa, Pediococcus pentosaceus ATCC 25745
MAKLTVSDLDVKNKKVLMRVDFNVPVKNGVIGDDNRVVAALPTIKYIIENGGKAILFSHLGRIKTEEDKKELTLRPVAQRLSDLLGKPVTFVPVTRGAQLEDAVNGMNDGDVLLFENTRFEDLDGKKESKNDPELGKYWASLGDMFVNDAFGTAHRAHASNVGVAEAMKADGKQVAAGFLMEKEIKFLGEAVDEPKHPFVAILGGAKVSDKIGVIDHLLNKADKVIIGGGMTYTFYAAKGMSIGNSLVEADKIDVAKEILAKGGDKIVLPSDSIVAEKFDNDVPNKVVEGDIPDGYMALDIGPKSVAEFKDVLKDAKTVVWNGPMGVFEMSNYANGTLEVGKFLGTLSDATTIVGGGDSTAAVKQLGVGDQLTHISTGGGASLEYLEGKELPGIAAISNK

SEQ ID NO: 34246 - protein, 251 aa, Pediococcus pentosaceus ATCC 25745
MRTPIIAGNWKMNKNPQETQEFLDAIKGKLPDASVVESVIAAPAIDLSTLVAFSKDEQLKTAAENSYFEDEGAFTGETSPKALNEMGVNYVVIGHSERRQYFGETDEDINKKAKAIFNNNMTPIICCGETLEQREAGETNEWVAGQITNALKDLTAEQVAASVIAYEPIWAIGTGKTASSDQAQEVCHVIRETVAKLYDQTVADKVRIQYGGSVKPANIAELMGKEDIDGGLVGGASLDPESFLELVNYKG

SEQ ID NO: 34247 - protein, 459 aa, Anaplasma phagocytophilum HZ
MHRILSVNQFRTCEQGSSIAEEELISRAGAAVVQELVSRFPKSPVLVLCGPGNNGKDGAVIANLLRDKGWSVRLLCYRSNIPDGFALEPDGFVLEEPLIIDSIFGIGLSRPLEEDLSSIVQQINVSGKFVVSVDIPTGINSDTGEVMGAAIKADLTVTFSCLKLGHVISPGRQHSGVVCVKDIGLEVCDSTVSLNSPALWEKSMARLSYKSHKYNRGYAAICSLGIRSIGAVKLASLAALRTGPGAVAVACEEDEVVLYASTLLSVMYKAHEEIIRDEKVTSILIGPGGELSDASIKNKVLNVLESGDRGYVLDAGALSVFKDCSDILFKSISKKRVVLTPHEGEFERLFPGLKGTVVERARAATTISNAIVVLKGHDTVIASPEGRVVVNNNAPCALATIGSGDVLAGMITGLIATGMNEFDAACCAVWVHGECGKKYRLGLIAEDIISQISEVLSAL

SEQ ID NO: 34248 - protein, 440 aa, Pediococcus pentosaceus ATCC 25745
MSLITDIYAREVLDSRGNPTVEVEVYTEDGGFGRGIVPSGASTGEHEAVELRDGDKNRFSGKGVEKAVANVNGPISKEIVGFEVTDQIAIDKAMIKLDGTPNKGKLGANAILGVSLAVARAAADELQVPLYNYIGGSNAHVLPTPMMNVINGGAHSENKVDFQEFMIMPVGAPSVKEAIRMGSETFHALKSLLSADGKATSVGDEGGFAPDFANNEEPLQYLIKAIEKAGYKPGKDVAIAVDVAASELWNDEDKKYKLRWSTGEEFTTEEFVKYLEGLVNKYPIISIEDPIDENNWDDWASITKELGKKVQLVGDDFFVTNTEYLAKGIKMGAANAILIKVNQIGTLTETMESIEMAKEAGYTAIVSHRSGETEDTTIADLVVATNAGQIKTGSMSRTDRIAKYNQLMRIEDQLEGVAEYKGINSFYNLSADAREEISNK

SEQ ID NO: 34249 - protein, 113 aa, Brassica napus
MRPPRGGGSFRGRGGRDGGGRFGGGDRGGGRFGGGGGGWRDEGPPDQVVEVATFVHACEGDAVTKLCQEKIPHFNAPIYLQNKTQIGKVDEIFGPINESLFSIKMMEGIVATS

SEQ ID NO: 34250 - protein, 774 aa, Magnaporthe grisea 70-15
MSSQPEISNTAATTSGGGISEKKPGLGKEVNVTAVEVDSTLSKAHASSGGSSSSSSSSRSSTHEKNSSSSNSIQDSDNEDVIIISGEDVSNHLLPLRDDGDAALTFRSIFLATCLAAFESTLYQIYQFKPTEIEVSSLFIVLIAHFAGTAWASLLPRGDRLEARWRAGRGSSSSSTGAPPLWIRIASVVNPGPWGLKEHAICAITAASSSNAAEAILAFTAQDLFYDLELKPVTVVLSIISISLFGYGICGLIRPIAVWHVDAVYWSSLPVVKTVQSLHWQEFKTSKPLRVFWIAFACMFVYEFLPAYMWPWLNSVSIPCLAAMHATGDLGATLTRFFGGSINNEGLGLFSLSFDWQYITSYNTSLPLITQLHTGLGFGICMIGMVVVWYTNAFNAQSQPFMSTRLHSADGSIYPISQVFEAGQLDHAALERFGLPQLSGTFVWGLFMANAAIGGMITHCAVFYAKDIINSFKSANNDDFKDRHHNHMKANYKEAPWWWFAIVLFSTMLFSRFGLAIATNNLSKMLAGLIIPERPIGTMYFAAWSHSVISSCHSLCNDLKIGEYLKIPPRDMFLTQVYGTILGGFINYGVMSSIVKTNRDLLVNSDGNNSWSGATIQSYNTNAATWALAKYLYAPGGAYSIVPLGLVLGVVLVLIHRAIVYFVPKIKGWDLAENINLPQLLTYCGEIPIGATQTCVIFSQILGGLFAQFYLRNYRPRIFKNYFYSTAGAFDGAALSALFLLSFAMFGAAGPAIPFPKWWGNRAGENYDFCPKVE

SEQ ID NO: 34251 - protein, 337 aa, Sinorhizobium meliloti 1021
MARMTMIEAVRSAMDVSMARDDNVVVFGEDVGYFGGVFRCTQGLQAKYGKTRCFDTPISESGIVGTAIGMAAYGLKPCVEIQFADYMYPAYDQLTQEAARIRYRSNGDFTCPIVVRMPTGGGIFGGQTHSQSPEALFTHVCGLKVVVPSNPYDAKGLLISAIEDPDPVMFLEPKRLYNGPFDGHHERPVTAWSKHELGDVPDGHYTIPIGKAEIRRKGSGVTVIAYGTMVHVALAAAEETGIDAEVIDLRSLLPLDLETIVQSAKKTGRCVVVHEATLTSGFGAELAALVQEHCFYHLESPVVRLTGWDTPYPHAQEWDYFPGPARVGRALAEAMEG

SEQ ID NO: 34252 - protein, 464 aa, Sinorhizobium meliloti 1021
MKEISCKLLVLGAGPGGYVAAIRAGQLGVNTVIVEKAKAGGTCLNVGCIPSKALIHAADEYHRLRAAASGKGPLGLSLSAPAIDLRRTIAWKDGIVGRLNGGVTGLLKKAGVKAVIGEGRFVDGKTVDVETETGLQRIRAEAIVIATGSAPVELPDLPFGGSVISSTQALALTDVPQTLAVIGGGYIGLELGTAFAKLGSKVTVLEALDRILPQYDADLSKPVMKRLGELGVEVFTRTAAKRLSADRRGLLAEENGRAFEVPAEKVLVTVGRRPVTDGWGLEEIDLDHSGRFIRIDDQCRTSMRGVYAIGDVTGEPMLAHRAMAQGEMVAEIVAGHKRSWDKRCIPAVCFTDPEIVGAGLSPEEARAAGIDVKIGQFPFQANGRAMTTLSEDGFVRVIARADNHLVLGIQAVGHGVSELSATFALAIEMGARLEDIAGTIHAHPTQSEAFQEAALKTLGHALHI

SEQ ID NO: 34253 - protein, 670 aa, Vibrio vulnificus CMCP6
MHSGADMPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKPGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAEKEAAWNAKFDAYAAAYPTEAAELKRRLNGELPAEWEEKANQIIADLQANPANIASRKASQNALEAFGKMLPEFMGGSADLAPSNLTMWSGSKSLEANDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDTFDKQDAAYREAVLPSDVTARIAIEAGIADFWYKYVGFDGRIIGMTTFGESAPADQLFEMFGFTVENVVNTAKELLA

SEQ ID NO: 34254 - protein, 285 aa, Oryza sativa (japonica cultivar-group)
MGWAARFLTAVSFLAAGVLFAPDALLGGSGRSGAGVAAARLAHVLCFATAWGAALWVTFIGGIVMFNSPFWHLAWRTFQNSFMVSPMFMVPFASKLDYCKKYHLKPEMQHLFWLLIHQVQVVYSKIFQNKATDIALMYSLRYLPRHQFGSLQGKMFPAYFMLISVCSAISVAAFAYLHPWKTASTIERYQLGFLISALGFDLSNLLVFTPMTTEMMMRRHKIEKDLGIGSEVGFSKNAEVARTNPTLAAMNKKFGMIHGLSSLANIMAFGSLAMHSWYLASKLQI

SEQ ID NO: 34255 - protein, 503 aa, Ostreococcus tauri
MSVRARASSSNASAASEVARALGLRRDDLLLDVVREREASTSGTMSVEVTNPATGTTLARCRATSANDVEHILRRSKESQERWANEYTAHARAKIVRRWFELVEANAEDLARVCTAESGKPLAESRAEVAYAASFLEWFADEGRRVYGDVVPSSSTGSRIMAIKQPVGVTAAITPWNFPLAMITRKAGAALAAGCSMVVKPSEETPLSAFALGALAKEAGCPDGVLQFVVGDPVVIGELLCASPIVRKITFTGSTRVGKLLMKQSSDTVKRVSMELGGNAPFIVCADADVDAAVRGAMASKFRNSGQTCVCAQRFIVHESVEDDFVRKLTAAANALKLGNGLEDESVTQGPLINAAQVERVDAHVRDALSKGAVCHSGGKRADGTFYEPTVLSKCTDDMLVMQEETFGPVAAITTFVSDDDALRMANSTNAGLASYVFTSDLKRSYTFSEKLEFGIVGVNTGVISTAQAPFGGVKESGVGREGGKYGMEEYVETKYVCVGGLD

SEQ ID NO: 34256 - protein, 388 aa, Oryza sativa
  misc_feature (224)..(224): Xaa can be any naturally occurring amino acid
YDILFAQETAASGSVEQLIMLHKDTIMAALEKMCIRRKVRSVEDLVSKKRTVKPKPRFLRVNTLRTSTDSVIEELNKIHKVDKDELVPDLLVLPPGTDLHNHHLVSEGKVFLQGKASCMVAVALCPEPGWKVIDACAAPGNKTVHLAALMNGEGSITACELNKERTKTLQNTIRRSGANNIETINGDFLDIDSNDPSYAEVRAILLDPSCSGSGISTERLDHLXLPSHSRGNQDDAITSSKDKENSPPSRGKRSSHALSFPSVERVVYSTCSIHQAENEDVVSSVLPLASSLGFELATPFPQWRRRGLPVFEGSEHLLRTDPEDGLEGFFISLFVRKAAAAADAVKPSNGGLGVSKQVFKRRNGLMAFGSSRLSRMMMLCSTRGLSRR

SEQ ID NO: 34257 - protein, 454 aa, Escherichia coli K12
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGRGQQQPRRGEGGAKSASAKPAEKPSRRLGDAKPAGEQQRRRRPRKPAAAQ

SEQ ID NO: 34258 - protein, 223 aa, Ustilago maydis 521
MFARSAIPTLRAASVRAFSTQTASTGTASARRYMGAAALAAGGALTYSAFAAPTVHLEGPKTIAGELGTSTERSYVMIKPDGVSRQIVGEIISRFEKRGYQLVALKTVIPSAELAKEHYIDLAKKPFYGGLVKYITSGTPVVAMVWQGKDVIRQGRRLVGATNPLDAAPGSIRGDFCVSVGRNIIHASDSHESATKEIGLWFHEKELATEYKPIAWDMIMADN

SEQ ID NO: 34259 - protein, 213 aa, Nicotiana tabacum
MPPSSPDSSVLLQRISSNTTPDFACKQSQQLQRRTMPIPCTTQVPDSVVRFHTHPVGPNQCCSAVIQRISAPVSTVWSVVRRFDNPQAYKHFVKSCHVIVGDGDVGTLREVRVISGLPAASSTERLEILDDERHVISFSVVGGDHRLANYRSVTTLHPEPSGDGTTIVVESYVVDVPPGNTRDETCVFVDTIVKCNLTSLSQIAVNVNRRKDS

SEQ ID NO: 34260 - protein, 638 aa, Magnetospirillum magnetotacticum MS-1
MCGFAGFLDLTQATPDRERVVRAMAATLLHRGPDDDGAWVDDGAGVALGFRRLAIIDLSPQGHQPMTSHDGRWVISFNGEIYNHEALRARLGEDIGWRGHSDTEVLLQAVSAWGMERALAEFDGMFAFALWDRQDRVLTLARDRFGEKPLYWTQSGGHLLFGSEIKALRAHPAWTGGIDRDALALYMRLGWITAPHTIHSGVFKLEPGHVMRVSEGQISTQAYWSAAECAAGVENGFTGNAEAAADRLEELLRQSVRLRMQADVPVGVFLSGGIDSSITAALMRQLSSEPVHSFTIGFDQSGLDESPHARAVADHLGTIHTEVRISDAEALAQVPRLPLLYDEPFADAAALPTALLAQVTRKSVTVALSGDGADELFGGYGIYRSIPKDWGRLRGLPGGLKSLGALGARQLAEPAEGLAALAGRFAKRRSHPGHRLRREAERLEVQSLAGLLGLHYSRWRGMPALVPGAREAQSLFSAPTPALKDDALATMVLDACGYLPDDLCVKTDRATMGASLEARLPFLALEIAQFAWSLPTGLKIEGETGKAVLRRVLYRHVPRALVDRPKMGFEVPLRRWLNGQLRDWADDLLSEDRLRRQGFLDTALVAQCWREHRSGAKNWQNEIWHALMFQAWLDSVNP

SEQ ID NO: 34261 - protein, 575 aa, Escherichia coli O157:H7 EDL933
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAIRIAMDRKEILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 34262 - protein, 327 aa, Bacillus subtilis subsp. subtilis str. 168
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 34263 - protein, 457 aa, Bacillus subtilis subsp. subtilis str. 168
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTISPASNAF

SEQ ID NO: 34264 - protein, 364 aa, Bacillus subtilis subsp. subtilis str. 168
MELFKYMEKYDYEQLVFCQDEQSGLKAIIAIHDTTLGPALGGTRMWTYENEEAAIEDALRLARGMTYKNAAAGLNLGGGKTVIIGDPRKDKNEEMFRAFGRYIQGLNGRYITAEDVGTTVEDMDIIHDETDYVTGISPAFGSSGNPSPVTAYGVYRGMKAAAKAAFGTDSLEGKTIAVQGVGNVAYNLCRHLHEEGANLIVTDINKQSVQRAVEDFGARAVDPDDIYSQDCDIYAPCALGATINDDTIKQLKAKVIAGAANNQLKETRHGDQIHEMGIVYAPDYVINAGGVINVADELYGYNAERALKKVEGIYGNIERVLEISQRDGIPAYLAADRLAEERIERMRRSRSQFLQNGHSVLSRR

SEQ ID NO: 34265 - protein, 386 aa, Vibrio vulnificus CMCP6
MSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 34266 - protein, 535 aa, Crocosphaera watsonii WH 8501
MTSKTTKPKKFALTTPLYYVNGVPHIGSAYTTIIADVIARHKRLIGDEVLLITGTDEHGQKIQRTAEEKGLAPQKHCDEIVSSFEELWQKLEIQYDRFSRTTASKHEVIVKEFFERVWENGDIYLAQQQGWYCVACEEFKEKRELLEDGCCPIHTNKKAEWRDEENYFFKLSKYQTKLEELYEKNPQFIQPESRRNEILNFVNQGLQDFSISRVNLEWGFPIPKDPSHTIYVWFDALLGYVTALLEPEAEPTLNNALSTWWPINLHLIGKDILRFHAIYWPAMLMSAELPLPDKVFGHGFLTKDGQKMGKTLGNTLDPFALVDKYGADAVRYYFLKEIECGKDGDFNETRFVNILNADLANDLGNLLNRTLGMTKKYCKGSLPELTAAELPQEHPLKTIGLTLGEKVIKAYETLKFNEGCEEILTLIRAGNKFIDEQAPWRLFKEGKQAEVEQILYGVLESVRLAAYLLAPIIPNLSSKIYEQLGFSVDFNQSDRLNQVIPFTHHSQWGKLAVNQNLSKPQPIFAKLDLPSEENP

SEQ ID NO: 34267 - protein, 91 aa, Brassica napus
LLAFGQYAGRAGLVDFLHGLGQRYLSLGYSTPFLSLGSSYMYSSLAAAKAAVISVGEEIASQGLPLGICPLVFVFTGTGNVSLGAQEIFKL

SEQ ID NO: 34268 - protein, 511 aa, Crocosphaera watsonii WH 8501
MEPRQELNSIVVTTEQMANIEGKIFAGGMPVAALMEKAALLTSQRIQQLYPLHTVDKVGVLVGPGHNGGDALVIARELHLQGYDVCVYCPFTKLKELTQQHANYAHSLGIPYHNDLESLNHCQLIIDGLFGFGLKRPLSGNLAIDVDRLNQWSIPVVSVDIPSGLHTDTGEVLGTAVKATHSLCLGLWKPVYFQDQALAYTGIAEKIDFGIPLKDIFSTIPQPIPLQLLHKTLALGFLPLPRPQLTHKYQQGHLLLIAGSHRYAGASILSSNGAKASGVGMLSVAVPESLKPLLVGKIPDGLVIDCPVSEKGVIASLPPLATDFASYDIIACGPGLTREATEVVTRVLEAKCPLVLDADALNILAQLGTVNRLSKRQNATVLTPHLGEFKRLFPDIHNPEKDRISATKQAASQSGAIILLKGARTIIANPQGKIWIIPESTPALARGGSGDVLTGLIGGLLAQNKTTNHTLEAMVATAAWWHAQAAILAAKERSELGVDAGTLSQYLHTIF

SEQ ID NO: 34269 - protein, 114 aa, Brassica napus
MASGRIIIMVVAIAFFMIGSDNVNVATAQFCGANVSGLMNECQRYVSNAGPNSPPPSRSCCALIRPIDVPCACRYVSRDVTNYIDMDKVVYVARSCGKKIPSGYKCGSYTIPAA

SEQ ID NO: 34270 - protein, 469 aa, Oryza sativa (japonica cultivar-group)
MQRCSSSRSTSPPPPPPAPLPPPACPIATPRFTCTVRMAMEAVLRGNSKSISHGGGVHLKSLVLSLLSLPPMEPSRRLLLSDYDGAIVSPLPSPPPSSATPFRPGVAVVVGILTSVFSITFLLLLYAKHCKRNAAESSGPYGSGGAFGSSGGGGAGERRNSGVDRAVVESLPVFRFGALRGQKAGLECAVCLGRFEPTEALRLLPKCRHGFHVECVDTWLDAHSTCPLCRSRVDPEDVLLLPEPPKPSTTGPPDPPETKVAAAAAAATAKDKEASLAPAAPAPSPAFRGFFSGRHSTGSVRAPGRVGPASRRSADLVGGDGGAVVGCFEAAKVRKDRVLLMEPAAAVAEPDPEAYDRRFGHRILVSTAGGCEDETAPAAKQRWSEVRPSDLMFVRSEMLVTEAGRYSCSAAVHSGNGRSVISARSLSELAGVSRLPPIRASGEPRAGARRWPGSSWWARGPPALNGPST

SEQ ID NO: 34271 - protein, 236 aa, Triticum aestivum
  misc_feature (167)..(167): Xaa can be any naturally occurring amino acid
  misc_feature (169)..(169): Xaa can be any naturally occurring amino acid
  misc_feature (204)..(204): Xaa can be any naturally occurring amino acid
  misc_feature (217)..(217): Xaa can be any naturally occurring amino acid
MSSSPTPAPDAGAAAMAGDDSSETDQLDSMSTEDIVRATRLLDNEVRVLKDELQRNNLELENVKDKIKENQEKIKLNKQLPYLVGNIGEILEMNPEDEAEEDGANIDLDSQRKGICVVLKTSTRQTIFLPVIGLVDPDNLKPGDLVGVNKDSYLILDTLPSEYDSRXKXMGVDEKPTEDLYDIGGLEKEIQELVEAIVVAMTHXEHFQKLGIRPPKXVPFYGPPGTGKTLRVPGWA

SEQ ID NO: 34272 - protein, 220 aa, Vibrio vulnificus CMCP6
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 34273 - protein, 482 aa, Solanum chacoense
MEVEVEAAAAAAEREATNSVICQLADPEGNPLGAALYLPENASPKELNQVVNKLLSNEEKLPYAFYISDEELVVQLGSYLEKNKVSVEKVLTIVYQPQAVFRIRPVTRCSATIAGHTEAVLSVAFSPDGRQLASGSGDTTVRLWDLNTQTPLFTCQGHRNWVLSVAWSPDGKHLVSGSKAGELICWDLQTGKPLGNPLTGHKKWITGISWEPVHLSAPCRRFVSASKDGDARIWDVTTRKCLICLTGHTLAITCVKWGGDGVIYTGSQDCTIKVWETTQGKLIRELKGHGHWVNSLALSTEYVLRSGAFDHTNKHFASPEEMKKVALERYNKMRGNAPERLVSGSDDFTMFLWEPAVSKHPKTRMTGHQQLVNHVYFSPDGQWIASASFDKSVKLWNGTTGKFVAAFRGHVGPVYQISWSADSRLLLSGSKDSTLKVWDIRTKKLKQDLPGHADEVFAVDWSPDGEKVASGGKDRVLKLWMG

SEQ ID NO: 34274 - protein, 1025 aa, Ralstonia metallidurans CH34
MTPLTRKRANNGANDGANHRADHGQTGRLTSRLADSSSQSQSQSQSSGRLSARLAAGLAGAMPTMDRRSFLKRSGIGVGAGLAATQLTMMRRADADDGKGGAGGKGDIVVRRTVCGHCSVGCAVDAVVQNGVWVRQEPVFDSPINLGAHCAKGAALREHGHGEYRLKYPMKLVNGKYQRISWDQALDEISAKLKQIRQETGPDSLFFIGSSKHSNEQSYLLRKWVSFFGTNNTDHQARICHSTTVAGVANTWGYGAMTNSYNDMQNAKAALYIGSNAAEAHPVSMLHLLHAKESGCKVIVVDPRYTRTAAKSDHYVRIRSGTDIAFLFGVLYHIFQNGWEDKKYLSDRVYGMDKVKEEVLAKWTPDKVEEVCGVPEAEVRYVAETMAKNRPSTLVWCMGQTQHTIGNAIVRASCIVQLALGNIGVSGGGANIFRGHDNVQGATDVGPNPDSLPGYYGLAAGAWKHFAAVWGVDYEWIKKQFASQAMMEKSGTTVSRWIDIVTEKPELIDQDHNVRGVFFWGHAPNSQTRGLEMKRALDKLDLLVVIDPYPSATAAMANMPATEGDTPNPNRAVYLLPACTQFETSGSCTASNRSLQWREKVIEPLFESMPDHAIMQAFAEKLGFANELSKNYKLVEVKRAGRTWREPETESILREINAGNWTIGYTGQSPERLKAHMRNMHMFDVRSLRCKGGKDPVTGYDITGDYFGLPWPCYGTPELKHPGSPNLYDTSRNVMDGGGNFRANFGVERDGVSLLAADGSHSLGADITTGYPEFDAVLLKKLGWWDELTDAEKKAADGKNWKTDLSGGIQRVVMKNHGCHPFGNARARAVVWNFPDPIPQHREPLYSTRPDMVAKYPTHDDKMAFWRLPTLYKTVQQRNIENKVYEKFPIILTSGRLVEYEGGGEETRSNPWLAELQQENFVEINPKAASERGIRNGDYCWVKTPTGARIKVRALVTERVGVDTAFIPFHFSGWWQGKDLKPYYPEGAMPIVRGEAVNTATTYGYDSVTMMQETKTTVCQIERFA

SEQ ID NO: 34275 - protein, 220 aa, Nicotiana tabacum
MFLLLLCSIFAVLSTAESSIYEVLESHGLPRGLLPKGVKNFTLDNSGKFVVHLDQACNAKFENEFHYDRNVSGTISYGQIHALSGIEAQDLFLWFPVKDIRVDIPSSGLIYFNVGVVSKQFSLSSFETPRDCTVVQLMDLQDDMHIADAVSKVFSLSGLVLFYVDHFLLEFLLLILFGKIEDSNLATDVSPCNSGTWAKSQSEELRYKFDQGNIGRKAIL

SEQ ID NO: 34276 - protein, 467 aa, Triticum aestivum
MGRRSGGRKLPFFSAASSSSSTKRTRSARRLPSLPKPSSPPPPSPTTPPPAPQTTTSPPAPSPGGSAAVAGVSGKVGKKKAGARLWMRLDRWGSSEILELDKASIIRRAGVPPRDLRILGPVFSHSSSILAREKAMVINLEFIRAIVTAEEVLLLDPLMQEVLPFVDQLRQHLPLRSLVGGNGEHGGDSNGVKQDGSPGDQVPCLNEATGAEHELPFEFQVLEVGLEAVCSTLDSSVADLERRAIPVLDELTKNVSTKNLERVRSLKSDLTRLLARVQKVRDEIEHLLDDNEDMAHLYLTRKQAQNQQVEAIMTSAASNSIVPAGASLPRLNSSFRRSVSIATSIYLDNDVEDLEMLLEAYFMQLDGIRNRILSVREYIDDTEDYVNIQLDNQRNELIQLQLTLTIASFGIAVNTFIAGAFAMNIPCHFYDTDGSFFWPFVGGTSSGCFVISVVLLGYAWWKKLLGP

SEQ ID NO: 34277 - protein, 185 aa, Pinus gerardiana
LVITIDDAPKEGCKHISVLTEADETQCPVVKIHPDDVVALPYSSGTTGLPKGVMLTHKGLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 34278 - protein, 457 aa, Silicibacter sp. TM1040
MLKNDQLDQWDRDNFFHPSTHLAQHARGESANRVIKTASGVFIEDRDGTKLLDAFAGLYCVNVGYGRQEIAEAIADQARELAYYHSYVGHGTEASITLAKMILDRAPKNMSKVYFGLGGSDANETNVKLIWYYNNILGRPEKKKIISRWRGYHGSGLVTGSLTGLELFHKKFDLPVEQVIHTEAPYYFRREDLNQTEEQFVAHCVAELEALIEREGADTIAAFIGEPILGTGGIVPPPAGYWEAIQTVLNKHDILLVADEVVTGFGRLGTMFGSDHYGLEPDIITIAKGLTSAYAPLSGSIVSDKVWKVLEQGTDENGPIGHGWTYSAHPIGAAAGVANLKLLDELNLVSNAGEVGAYLNATMAEALSQHANVGDVRGEGLLCAVEFVKDRDSRTFFDAADKIGPQISAKLLEQDKIIARAMPQGDILGFAPPFCLTRAEADQVVEGTLRAVKAVLG

SEQ ID NO: 34279 - protein, 491 aa, Silicibacter sp. TM1040
MSLSALSARAEISDKALVRSFSYINGKWCASSNGEVVAVHDPATGDFIGDVTAMTAEDSSAAVDAAHAAFTSWALMLPQDRCALLRRWFELMIEHKEDLARLMVLEQGKPLSEARGEIDYGAAFVEFYAEESKRPNIEGVTSHLPDAEVELWREPVGVAALITPWNFPSAMLTRKAAAALAAGCTVVAHPSAETPFSALALAELAERAGIPKGVFNVITGKAPVVVEPWTRDARVRALSFTGSTEVGKLLYRQSAETVKRLVMELGGHAPVIVFKNCDLDRAVAETIKAKFATSGQDCLGANRIFVERDIYDEFCTRFVAATQALSVGKGIDDPDIGPLMNEKAVQKQEEHVADALEKGATLACGGKRHALGPLFYEPTVLTDVPADALILHEETFGPVAPITPFDSEDEVIQRANDSEYGLVAYVHSHDPRRIYRLSRALQFGMVAVNRTKVTGAPIPFGGTKQSGMGREGARLGMEEFTEVKYVCRDWA

SEQ ID NO: 34280 - protein, 140 aa, Rhodovulum sulfidophilum
MAIQRTFSIIKPDATKRNLTGAINAKLEAAGLRIVAQKRIHLSKAQAAVFYAVHKERPFYDELCEFMASEPIVVQVLEGEDAIAKNREVMGATNPAEAAEGTIRKEFALSIGENSVHGSDAEDTAKEEIAYFFSGLELVG

SEQ ID NO: 34281 - protein, 301 aa, Arabidopsis thaliana
MTEEFDTTGVCTGTWWSSSNGMFSGCSLPRSAEIVVDFGEIEWQNIDTLDAKTYNENYLSTSTFLGNANLDTTSQIYVSSPSNVHEEERYNQINSFLEGLFDSSEQLLVPNCPKPELFESFHFFDDVFPNESRMISVFDHQKPKEDMQACKSLTTCKRASEKSGELEDIESSQPLKRPRLETPSHFPSFKVRKEKLGDRITALQQLVSPFGKTDTASVLHDAIDYIKFLQEQITEKVSTSPHLNSIGSGEQKQWSDESSNNTHNQDCSPRQDLRSRGLCLMPISSTFSTPPQHLDTSSFWN

SEQ ID NO: 34282 - protein, 463 aa, Streptococcus pyogenes M1 GAS
MTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 34283 - protein, 194 aa, Fusobacterium nucleatum subsp. nucleatum ATCC 25586
MKIKKADFVKSAVYEKDYPEQLDKMEFAFVGRSNVGKSSLINSLTSRLKLARTSKTPGRTQLINYFLINDEFYIVDLPGYGFAKVPKEMKKQWGQTMERYIASKRKKLVFVLLDIRRVPSDEDIEMLEWLEYNEMDYKIIFTKIDKLSNNERAKQLKAIKTRLVFDNEDVFFHSSLTNKGRDEILNFMEEKLNN

SEQ ID NO: 34284 - protein, 345 aa, Zea mays
MAPAGNGADDHELPLFHPSPCAHYYVQTPSAASHTLSHPASDSMALILSPFPNLHHDADARHSSDGRDHEHDHEEASRLTLSRYSSSRGSNSSFPVGDKKPGRRRHALSGRSSGRHDDGDDDADGEAQRSGAWRYVKLDPEAPCCCIAFQVAWRVAASAALALLVFVLATRPRHPRVSFRVGKVQRFALGEGLDGSGVETSFLNCNSSVDMAVENHSKVFTLRVGPPRLEMSFGRFVFATSQGDGWSHDVGPRGTSTVRLFVAAQDKPMYAAGRGMQDLLESSHGLPLTVTVRARSRYRVVGSLVRLTYRHDSECVVLLRRTPDRSNGIRAAAGSRATTTCSALS

SEQ ID NO: 34285 - protein, 249 aa, Carboxydothermus hydrogenoformans Z-2901
MGELTGKVGIVTGGSKGIGFATAKRIAEEGAKVVIANRNKEEGEKAALQLREKGLEVYSIPCDVGKVADIKKLVSEVYGRYGRIDILVNCAGVNVRKPIEEYTEEDWNYMVDINLKGTFFACIEAGKHMIAQKEGVIVNLASIQAEEVLPERGIYATTKGGVKQLTKALAVEWAKYNIRVNAVSPAFIKTEMVEKVLQDPYWGNLIINKTPMRRPGTPEEVAEAILFLVSPKASYITGINLLVDGGWTA

SEQ ID NO: 34286 - protein, 148 aa, Helianthus annuus
MEQTFIMIKPDGVQRGLVGEIIGRFEKKGFTLKGLKLLTVDQAFAEKHYADLSAKPFFNGLVEYIISGPVVAMVWEGKNVVTTGRKIIGATNPAESPPGTIRGDFAIDIGRNVIHGSDAVESAKKEIGLWFPEGVANWSSSLHPWIYE

SEQ ID NO: 34287 - protein, 149 aa, Saccharum officinarum
MESTFIMIKPDGVQRGLIGEIISRFEKKGFYLKALKLVNVERSFAEKHYADLSSKPFFQGLVDYIISGPVVAMVWEGKSVVTTGRKIIGATNPLVSEPGTIRGDFAVDIGRNVIHGSDSIESANKEIALWFPEGLADWQSSQHPWIYEK

SEQ ID NO: 34288 - protein, 71 aa, Zea mays
  misc_feature (44)..(44): Xaa can be any naturally occurring amino acid
MVLNFHLQGRHGKNRVRVSRVWRRTATAAGDAMVEWNCPASVVXDCLRFYTCSDNFAIVGTDSIRNTVYVK

SEQ ID NO: 34289 - protein, 155 aa, Glycine max
  misc_feature (97)..(97): Xaa can be any naturally occurring amino acid
  misc_feature (124)..(124): Xaa can be any naturally occurring amino acid
MPNDSVLSLFFFVTLFTCLLSANSHDDHIFLPSQLHDDDSVSCTATDPNLNYKPVIGNLTHPGDGASGPLSNATGVSYIAASYGRFVESGGARVIPXLIYDEPPENLNKKARFWSMECFFTGGXAVSGPIFGYLLKTIFKKGFKRKMMVEDHFPK

SEQ ID NO: 34290 - protein, 546 aa, Oryza sativa
MAAAASSVLAYLLVVALLAIVPLVYFGWVARRRGEGGRLPPSPWGLPVIGHLHHLAGALPHHAMRDLARRHGPLMLLRLGELPVVVASSAEAAREVMRTRDIEFATRPMSRMTRLVFPAGTEGIIFAPYGDEWRELRKVCTVELLSARRVQSFRAVREEEVGRLLRAVAATSSSPSPAQAAVNLSALLSAYAADSAVHAIIGSRFKDRDKYLMLLERGLKLFARHTLPDLYPSSRLAMWLSRMPRRMMQHRREAYAFTDAIIREHQENRAAGAGDGDGDDKEDLLDVLLRIQREGDLQFPLSTERIKTTVGIIRVNNMLNNLSQTRHPKNYDITLSHDMFAGGSETAGTALQWIMAELIRNPRVMHKVQDEVRQTLAGRDRVTEDAISNLNYMHLVIKEALRLHPPVPLLLPRECRNTCQVLGFDVPKGAMVLVNAWAISRDPQYWDEPEEFIPERFEDSNIDFKGTNFEYTPFGAGRRMCPGIAFGLANVELMLASLLYHFNWQLPDGMDTADLDMTEEMVVSARRLHDLLLVPVVHVPLPVASS

SEQ ID NO: 34291 - protein, 149 aa, Glycine max
MDEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVESANKEIALWFPEGPANCQSSQHSWIYE

SEQ ID NO: 34292 - protein, 314 aa, Nicotiana tabacum
MADQENCVRVTRLAKKRAAEAMVQHLQQPNKKRVVLGEIRNLSNQIQMFDSEPLKPKCNKQTTKRKVKRSVSVKEREFREEDVDSKLDDDPQMCSAYVSDIYEYLHQMEIEKKRRPLSDYLEKVQKDVTANMRGVLVDWLVEVAEEYKLLSDTLYLAVAYIDRYLSIKVIPRQRLQLLGVSSMLIASKYEEIKPPRVEDFCYITDNTYTKKDVVKMEADVLQSLKFEMGNPTTKTFLRRFTRVAQEDCKNSNLKLEFLGCYLAELSLLDYNCVKFLPSLVAAAVIFLSRFTLQPKLHPWSVGLEQNSGYRACLL

SEQ ID NO: 34293 - protein, 428 aa, Pediococcus pentosaceus ATCC 25745
MRRVRTFDINHILNRGYQSTSYFKVKHFFNVWGPGLIVMLADTDAGCLITAAQSGAQWGYTMILPQILLIPVLYFAQEMTVRLGIVTKKGHGELIREYFGKKWAWISAGTLAISAIGALLTEFVGIAGVGEMFGISKWITIPIATVLLIAIAFSGSYRRVEKVGVMIGLAELAFLVVVVMVKPQLGDMVRGIGTIPWHNSSYIYLVAANVGAVIMPWMIFYQQGAVVDKNLGVESINKEKHDTFVGTLVTQGIMLTFVIAFAATMGLQHQQVALETVSDLASGLSAFIGSYPAKLFTGMSLLGGSLVAALVVALAGTWGVTEVLNWKHSLNEPLQKGSIGFYIIYCLAHIIGAILVLANINLVNLAVSVEVMNALLLPIVLGFLLILEAKVLPEKYRMHGVYRWLVTVLCMVVMGFGLYMVGPIMGIW

SEQ ID NO: 34294 - protein, 128 aa, Narcissus pseudonarcissus
  misc_feature (9)..(9): Xaa can be any naturally occurring amino acid
  misc_feature (13)..(13): Xaa can be any naturally occurring amino acid
  misc_feature (20)..(20): Xaa can be any naturally occurring amino acid
  misc_feature (51)..(51): Xaa can be any naturally occurring amino acid
  misc_feature (58)..(58): Xaa can be any naturally occurring amino acid
  misc_feature (63)..(63): Xaa can be any naturally occurring amino acid
  misc_feature (79)..(79): Xaa can be any naturally occurring amino acid
  misc_feature (102)..(102): Xaa can be any naturally occurring amino acid
ASWTGGKGXRKQXATKAARXSAPATGGVKKPHRFRPGTVALREIRRYQKSXELLIRKXPFQRXVREIAQDFKTDLRFQXSAVAALQEAAESYLVGLFEDTNXCAIHAKRVTIMPKDIQLARRIRGERA

SEQ ID NO: 34295 - protein, 208 aa, Triticum aestivum
  misc_feature (18)..(18): Xaa can be any naturally occurring amino acid
MALALATTPLAHLAVAPXRSPGSQSSLLLLPRRASHAPVSLSLPLRSRLIAAVATKEEPELGGGGSGGDDGAGGSGGGGGSDPKEGGQEGEGEEEKMEQGLSLSQKLTLAYAALVGAGGVMGYMKSGSQKSLAAGGISALVLYFVHTQLPVRPVFASSIGLGIAAALLSVMGSRFKKSGKIFPAGVVFLVSLVMVGGYFHGILRSSHA

SEQ ID NO: 34296 - protein, 830 aa, Frankia sp. CcI3
MKTTVSPDIAASPGVPAPTASGLAPGCAVPLGVTWDGSGVNIAVVAPGAEAVDFCLFDADGRETRHRLPERDGGVWHGYLAGVRPGQRYGLRAHGPYDPERGQRYNPAKLLVDPYTRSVAGTLRTDPAIYGFGGGDPYGFEPDPRDSAPFVPRCVVTGPGRAQRGSAGTRESGFGDPGIGDPGSGSGGLTGHGVHPADNRPTIPWSDTIIYEAHVRGLTKRHPDLPPRLRGTYAGLGHPSVLAHLRRLGVTAIELLPVHTSVSEPALLERGKINYWAYNTLAFFAPHAGYAATDDPIGEFQAMVAALHAVGIEVILDVVYNHSAEGSERGPTLSLRGLDNTTYYRVEPMDPRRYRDVTGCGNTLNTSSPHVVRLICDSLRYWVTEMGVDGFRFDLATALARNPDAFDPAASLLTAIHADPILATVKLIAEPWDVGWGGYQVGGFPAPWAEWNGRFRDTVRDVWNRYTSGVADLGYRVSGSSDLFEHGGRRPWASINFVTAHDGFPLADLVSYNEKHNEDNGEGNRDGEADNRSANHGMEGATDDPAILAIRRRVRRGLITTLLLSTGVPMLLAGDEFGRSQGGNNNAYCQDNAVSWLDWPTDLVGPEDVTGPEGVTGPEGVTGPEDVTGPEGVTGPEDVAEPDHAYPDPAGPDPALCRLVGGLAALRSAEPVLRRGRFFHGGQSAPGRLADITWFRADGAVMSVADWNAPQVETLVAHVAGSPVAGSPVDEDPAGGRGTHDLPAHGAGLVYVFHPDRGDTVVTLPGAPWAARHDLLLNTADDDLAGFPATVAVPGTSYVGGESLTVLGHSVLVLRAHPPGTAASPRCGDP

SEQ ID NO: 34297 - protein, 526 aa, Burkholderia vietnamiensis G4
MRRPWMPARSTFVSFMSAIPNSDPPGSPANPPTLHRALKARHLTMIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 34298 - protein, 116 aa, Glycine max
  misc_feature (34)..(34): Xaa can be any naturally occurring amino acid
  misc_feature (82)..(82): Xaa can be any naturally occurring amino acid
  misc_feature (111)..(111): Xaa can be any naturally occurring amino acid
KIYCPNVSTVNHAGAGMVAPFTGLKSMADFPTRXTNNDITSIASNGGRVQCMHVWPPDGKNKVDTLPYLPDLDDAQLANEGXYLHTKGWIPSLEYELEHGNVYPEHNMSPXYYDGR

SEQ ID NO: 34299 - protein, 394 aa, Gibberella zeae PH-1
MSAHRPNAFNSLRMGEVIREKVQDGITGETRDLQYTQCKIVGNGSFGVVFQTKLSPSGEDAAIKRVLQDKRFKNRELQIMRIVRHPNIVQLKAFYYSNGERKDEVYLNLVQEFVPETVYRASRFFNKMKTTMPILEVKLYIYQLFRALAYIHSQGICHRDIKPQNLLLDPNSGILKLCDFGSAKILVPNEPNVSYICSRYYRAPELIFGATNYTTKIDVWSTGCVMAELMLGQPLFPGESGIDQLVEIIKVLGTPTREQIRTMNPNYMEHKFPQIKPHPFNKVFRKADANAIDLIARLLEYTPTERQSAIDAMVHPFFDELRDPNTKLPDSRHGTGQLRDLPALFDFTRHELSIAPSLNPKLVPAHIRPVLASQGLDIDHFTPLTEQEMMAKLD

SEQ ID NO: 34300 - protein, 502 aa, Streptomyces avermitilis MA-4680
MRPGRQSAMTELVEHGQLFIGGVLADPLGKDVIEVISPHTEEVIGRVPHASTADVDRAVAVARKAFDEGPWPRATLDERIEVVTRIKDAIAVRHEEIARVISSENGSPYSWSVLAQALGAMMVWDAAITVARNFTYEETRDGVLGKIVVRREPVGVVAAVVPWNVPQFVAAAKLAPALLTGCTVVLKPSPESPLDAYLLGEIAREAGLPEGVLSILPADREVSEYLVGHPGIDKVSFTGSVAAGRRVMEVASRNLTRVTLELGGKSAAVVLPDADITTSVPGIVSAAWMNNGQACVAQTRILVPRSRYDEFADAFAAAASALVVGDPLDPATQVGPLVARRQQRRNLDYIRIGQEEGAKILTGGGRPPGLDRGWYVEPTLFGDVDNSMRIAREEIFGPVICLLPYGDETEAVKIANDSDYGLSGSVWTADVEHGIDVARRVRTGTYSVNTFSLDMLGPFGGYKNSGLGREFGPEGYGEFLEHKMIHLPAGYEAPTGVEGAGA

SEQ ID NO: 34301 - protein, 500 aa, Brucella melitensis 16M
MPYCPIALHKETTMKAQPKASHFIGGAFVEDKAGKPLPVIYPATGEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 34302 - protein, 385 aa, Solibacter usitatus Ellin6076
MRSADVIIIGAGIVGSSIAYHLTEAGCTNVLVLERETSQGKGSTGKSMGGVRAQFATPVNIRMSMYSIPFFAAFDEVMGHPAGYRPQGYLFVATKPAHMDYLRENYRAQVEAGLKDVHLLDPAGVSRLAPELRSDDIIGGSFCATDGFVDPHSVMTGFMLKAMERGVELLRDTEVTGIRTDAAGVCGVETSAGFLSSRTVVNATGAWAGSVARLAGVDLPVEPLRRMLVPTEPFDKVSHESPMVVDMNTGFHYRPEGRGLLLAWNDPEETPGFKLNFDRAFIEKVLTRGVDRLPCLEEAEVNPKRAWAGLYEMTPDHHPVIGPVKSLPGFFLANGFSGHGVMHSPATGRILADLIVHGRCDLVDTDLLGFDRFAAGRLLHETAVL

SEQ ID NO: 34303 - protein, 303 aa, Solanum lycopersicum
MEKYEKLEKVGEGTYGKVYKAKDKATGQLVALKKTRLEMDEEGIPPTALREISLLQMLSHSLYIVRLLCVEHIDKNGKPILYLVFEYLDTDLKKFIDSHRKGPNARALPTALIQSFLFQLCKGVAHCHSHGVLHRDLKPQNLLVDKEKGILKIADLGLGRAFTVPMKSYTHEIVTLWYRAPEVLLGSTHYSTAVDMWSVGCIFAEMVRRQALFPGDSEFQQLLHIFRLLGTPTDKQWPGVSSLRDWHVYPQWEPQNLASAVPALGPDGVDLLTKMLKFDPSDRISAKAALDHPYFDSLDKSQF

SEQ ID NO: 34304 - protein, 552 aa, Leptospira interrogans serovar Lai str. 56601
MNPNMKLSKKYTFRSRKVLLIILDGVGYSPKGPESGNAIAGAKLPFLNRVWNQFPTLHIQAHGKAVGMPSDDDMGNSEVGHNVLGSGRIFDQGAKLVSNSIASGDIFNGQAWKEVIGNSKKNNSTLHLLGLFSDGNVHSHIDHTKALISQAILEKVPKIRLHILLDGRDVPEKSALDYLNPFETWLDSLRKSGTDIRIASGGGRMTITMDRYEADWSMVERGWKVHVKGEGRYFSSAKEAIETFRSENPKIIDQYLPSFVISDNGKPVGKIQDGDSVVFTNFRGDRAIEISLAFTEKNFDKFDRGPLPNVLYAGIMQYDGDLKLPERFLVAPPAIDRTLGEYMASSNIPQYALSETQKYGHVTYFWNGNKSGYFDQNSEEYREILSDVIPFDQSPEMKALLITEALEKALNENKQDFYRVNYANGDMVGHTGNYLATVQAMEFLDGCVERLWKTCEKQNIVLLVTADHGNADEMFQLDKKGNVEKDSHGNPIPKTSHTLNPVPISILDPENKIRFNSKLSNPGLANVAATILDVMGYETPEGYHPSLIQNES

SEQ ID NO: 34305 - protein, 387 aa, Arabidopsis thaliana
MLSPPVKKRKIVAPQSQSASASFQSLPDDLILSIVARVPRLYHRTVSLVCKSFRSLLVSPELYKARSVSGHTESCLYLSIACYPDYRMFTLCRKPDQTLTTSEEEEKKKSNGYYLAPVPDPDSHPVYFSSLVTVGSDIYNIAGSHASSNVSILDCRSNTWREAPRLGVELTSVSASVLDRKIFVVGMYADDEESESKNDFFEVLDTETHTWDPQPFNCSETKDKFLNCRTAFIDGKFLVKPWIHRGVVAYNSKESRWEPVQTKMAMSMFNDSYCQIHNVIYLAFDGRIRWYDDALNCWGDVQGLLELGNIPHGPSCVRLADYRGNIAVFWFRYLPDNDDYKWKMIWCAEIALERRTSWEIWGKVLWFDPVLTVPADYEFVKALAATV

SEQ ID NO: 34306 - protein, 773 aa, Pediococcus pentosaceus ATCC 25745
MEENTSYDEGLKVSLSTKDLLVYGITFMIPVAPLAFYGSFLTPANGMVALAYFVGMVAMLFTGFSYATMSRRYPFSGSVYTYVQQGTNAGLGFIGGWGITLDYFLIPTITYLISKSFGESLFPTVPGWAWIIILVIFNTIVNILGANVVTKISWVLFALQGIVLVAFIIGTIRLLLSGAIQPQTISFYNPQHFNIQGVLQATGIVIVSYLGFDAISTLSEEAEDPHRSVGRAIILSILSIGILFVVITVLAGFVAPDYQNLNQNTAFLGILQRVGGTWLVKLADITIILSFGFASGQEGQTAVSRILYAMGRDGILPPAFAKLHKKYRTPIFAIVLVGLASLILSLTLSQDTVSNLVSFGALFGFILLNLSVIWKFYVKGDHGSVFSKERVETKYYEDDTKIYLTLLKKQDILDLDLSRERVKKRVISNISTTGNTKYAEKLISKYYRDFDYVFDMVRAEQALPSKKDNFLKSISEPKPTPRFQIHKYDLVKLIDGRLAIVFSINDANTEYEVRVEKGSESWELITIKQIDIAHVYQHLDSFLSPTKISLSIKDVFFKHDVNFLIEEFPDINVETLCTDSEWFDLENKLEGLLLKYSQISNKQSHNIGIRIQQMLDIIPEKYVDVRLSSVVPPTLEEIDQLEELDVVKLKDGKFATIVFAPPHPYSWDMHFDFDIGDSSTSWATPITEIAEIIFFHSKNLPIHLNKMLTKEAIQNLHVLVPDFDVNKTLSKEEFTKLYDLIDHKLMTQGFDTNDEPTPIGLMAENLLTEFADI

SEQ ID NO: 34307 - protein, 99 aa, Oryza sativa (japonica cultivar-group)
MAAVSCRCSSVVFVGNVSYRATEAELRDACEEIGPVESLRLAVDEDAGNRRRGFAFVEYLDDETARSACRNLDRRALRGRALRVDLADLGCGGGGGETD

SEQ ID NO: 34308 - protein, 181 aa, Photobacterium sp. SKA34
MNQETLNLIKNSIKSIQDYPKPGILFRDVTSLMEQPEAYRATIAILAEKYKDQGITKIIGTEARGFLFGAPLALELGVGFVPVRKPGKLPREVIAESYELEYGKDTLEIHKDAIKPGDRVLLVDDLLATGGTIEATTNLVRRLGGIVDDAAFVINLPDIGGEARLQGLGLNVYAICDFPGH

SEQ ID NO: 34309 - protein, 1491 aa, Ustilago maydis 521
MSASDRHAASDRAAGRSVRSWLRSLLQGPSDQHADRGTYASSQGSAVVSSTGPASVGTDMISFHHTFEDVERPSFAPPPRSFSGGSSNGSLSYDAAAKRTLAQPIATPRAGAAHSSTNLLSANSLATSPSPSASPPKSPRIARTLTSSVASLTDRLHHQRRASETYRRMRSGSTSAEVDSQQIVLSRSLSKTLDRDSPLLASPSAISENEPVSSPPPTHLSHDSQLSPTGSLANPSDSNRYGPETSGVRRSDSSGTTTAIGESLSPSQSSAGAAPSTCEASHELLLPEGEQMLKVTHKKVKPRTFKLDPDRGQILWESKKNNRVNLESIREVRFGPSAASYRTSLNISSAHESRWLTIIYQNNGIYKALHLIALSDQSLSRWRASLLHLQSLRRELLGAVGASSSLENRRHLWMRHHWKDADESNDEKLSIEEVILLCRRLGIESNKAHLRRCFNLADWRNRGFLDFQDFQHFVSLLKQRADIETIFAAWADQPLEQPLEQLRRGSGVTKDDHDLRGQAPELEGSPALSDASSVDTQSCPAPSVMQTSRVMGPEPCRTQAMSIDSFRRFIREEQGNHNFSNGQIDDLFHRHCNSRLSSSHHADAPTERAQMDYDGFLDFLSSSDNPPLLDQLPLFSTIVSNPVDATVLGRPPCSGSIDAVEYSDTQQCSQQQDTDANQCPQQRTPSRAFANTTDELIAAGASDSMANTRKVAAHLRKSTIQHDMTRPLSEYYISSSHNTYLVGGQWKGDSTVEGYIRALLQGARSVELDCWDGPNNVPQITHGRTLTSRVPFQDVISAIARYAFVTSPYPLILSLEVHADPPQQEVMARILIDTLGEMLLSQPIDSQTLPGSTDELPSPEKLKFKVLVKAKNVAAADGHQALPLPKAADGLALSAKQKDGTDVIPTMVLEPPTSATDTTSTTDSEIESRLTSAKQLVCRVTRRSHRVQATSAGQAGYRSGDASDDGTAKASYETPGNGSRSSKATKKMMSTALASLLIYTIGVKCRGFNKKESYATQHMVSLSEKTALKMIRDPISNEALIKHNRSHLTRIYPSMMSFARLHASRNFVPLDMWAAGCQLVALNWQTTDLGFELNQAMFSRNGRCGYVLKPAALRTKEHGKTLQGKVVRFQLDLRIVSAQQLPKKNKAGASKDKDKDKGHSYHDNREPIDPFVVVSLLTPGCWGKQPKGLLQKASTPREAKELPLSPAPPVDHCEAAPDSVIQTRQTSVSEQSSGDGTIAAASSHTDKRLQHSADVGSSSEPSPGPQRAKSSAKTTALAPTHLLRTPTVKGNGFSPEWHTHMSVLIDVPAGASNELAALVEASKASQGAALTYPELERLSRGLLDLCFVRFEVFDDDLDDDVAEEQATSRTTRGSEDTLAPTPSISTAVVESGSRLSLNPTAAIRQSNTEAAADDDAGSKAGSETSSTSSTSSIDAESVAAYSVSVGALQQGYRHLPLYDHQLSQFLFSTLFVHSRLRLVGLVDGVAPGKQS

SEQ ID NO: 34310 - protein, 745 aa, Oryza sativa (japonica cultivar-group)
MRLLVPDGARGGGGGGGGGLLPAAAASPAVGRGRRTVVVGIRRDAASRELLTWALVKVANAGDRIVALHVAAAAAAAAGGGGGGGGGAVGLEERSDAAEDSLVSVLAVYDGFCNLKQINLELKVCGGSSIRKTLVKEAASYGAAHLILGVAKNSLSFSRSSSISVAKYCAKRVPTGCSVLAVNNGKILFHKDAVQQEPYHSASTMTETPRRSYRKLLTSVIGEKLRDECEQDNRSIFRAVTMPPSSPAPTREVSLALVPMKVHRRESPEVATGWSFLRKKFLPDRKPASHDRSKMSVVQWAMRLPSRYSSASPVCSEYRTTTPDGITSASRILRDRVAVPSRSNSGKSSVVIEELDNSSDKEIPEELIALREKFPSVYSTFSHSELAKITSDFSPECIVGQGGTSQVYKGCLENGKELAVKILKYSDEVLKEFVSEIEIVSSLSHKNIISLAGFCFKDTDLLLVYEYLRRGSLEEILHGEKGCDNLFGWTERFNVALGVAHALDYLHGSGNNRPVIHRDVKSSNILISQDFEPKLSDFGLALWDTDATSQITCNDVAGTFGYLAPEYFMHGKVNDKIDVYAFGVVLLELISGKKPLCTGCPKGQESLVMWANSIIQGGKLTQLVDPNLPTEDHANKVERMTLAASLCIRPTPQRRPHIAVVLKLLNGDNGILKWARSEVGLSYESDGDEPVVTLPENNRNIQSYINLAFDVDDDSASVSSNDFIAANTSLEEYLRGRWSRSSSFD

SEQ ID NO: 34311 - protein, 380 aa, Gibberella zeae PH-1
MTYLCFTEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAIARVDMAGRDLTDYLMKILAERGYTFSTTAEREIVRDIKEKLCYVALDFEQEIQTAAQSSSLEKSYELPDGQVITIGNERFRAPEALFQPSVLGLESGGIHVTTFNSIMKCDVDVRKDLYGNIVMSGGTTMYPGLSDRMQKEITALAPSSMKVKIIAPPERKYSVWIGGSILASLSTFQQMWISKQEYDESGPSIVHRKCF

SEQ ID NO: 34312 - protein, 218 aa, Vitis riparia
MNTTSPPYSDPHPLVCNWDSLNLPDSDGGSEELMLASTHPKKRAGRKKFRETRHPVYRGVRRRNSGKWVCEVREPNKTSRIWLGTFPTAEMAARAHDVAALALRGRGACLNFADSAWRLHVPSSRDAKDIQKAAAEAAEAFRPMENDGVMQDERREESEVRTPENVFVMDEEDVFGMPGLLVNMAEGLLMPPPHSVADGYGGDDMAADADMSLWSYSI

SEQ ID NO: 34313 - protein, 111 aa, Mesorhizobium loti MAFF303099
MSGINDYIDNEVKGNDVVLFMKGTPGFPQCGFSGQVVQILDYIGADYKGVNVLDSAELRQGIKDYSNWPTIPQLYVKGEFVGGCDIVREMFQAGELQTFLVEKGVSVKGAA

SEQ ID NO: 34314 - protein, 130 aa, Vitis riparia
MAYQQDPCANPTRQTGKTGGQTDQYGNPVHQTEALGAYGAGTGTGMHGGEHQQQPHQQPGVLNRSGSSSSEDDGQGGRRKKGMKEKIKERIPGMGRKDEQKQTSATSTPGQGQQQKGMMEKIKEKLPGAH

SEQ ID NO: 34315 - protein, 389 aa, Oryza sativa (japonica cultivar-group)
MGCCGGMSSTSRAPRGIREETLLRVPGASVHLLDGAEGPVELARGDLAVVRIAKDGVAVATVARVGRGLGWPITRDEPVVRLDRLHYLFTLPDSTGGGGGGGGGALFLNYGVSFAAPDDALLASLDAFLKANACFSTPSSPAPSRSSATTTTRPAPTTTATADGYWNDFAPRMDSYNNVLAKAIAAGTGQLVRGIFMCSEAYATQVQRGADLIRPQATGSVTKRSGGAGGGGASRTTGQPDAKRGGVNKSLKRVRKLSEMTEKMSQSLLDTVIAVTGSMAAPLLRSKQGKAFLATVPGEVILASLDAINKVMDAVEAAERRSLAATSNVVSGAVSRRYGESAGEATEDAFATAGHAVGTAWNLFKIRKAVTPSSSLPGNMVKSAVRNRK

SEQ ID NO: 34316 - protein, 338 aa, Streptococcus pyogenes M1 GAS
MKAVVVNQASTGVEVVEHDLPNIGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 34317 - protein, 238 aa, Carboxydothermus hydrogenoformans Z-2901
MEEAVKMLLTARHAIAFTGAGVSTESGIPDFRGNSGLWEQYPVEKVASRRALMENPAFFLNFYRERFKSYANVKPNRAHEALARMEKAGIIKGIVTQNIDGLHQKAGSKNVIEIHGTLKRVRCDRCGKYYLPEKLDEEEVPRCNCGGVIRPDVVLFGEALPRREWQIALELAERSDLVLVVGSSLVVTPANQIPGLVLLEGGKAIIVNKDPTPLDDQALVLRGYAGEILSKLADMLGV

SEQ ID NO: 34318 - protein, 367 aa, Prunus persica
MGKGGMSSQGGALEAHVEQENMAAWLVGVNTLRIQPFKLPTVGPNDVRVKIKAVGICGSDVHYLKTMKCADFVVQEPMVIGHECAGIVDEVGSLVKNLVPGDRVALEPGISCWRCEQCKGGRYNLCPDMKFFATPPVHGSLANQIVHPADLCFKLPENVSLEEGAMCEPLSVGVHACRRANIGPETNVLVIGAGPIGLVSVLSARAFGAARIVIVDVDDERLSIAKSLGADDAVKVSTNPQDLEDEVSKISKAMKGGVDVSFDCVGFNKTMSTALSATRPGGKVCLVGMGHGVMTVPLTPAAAREVDVVGIFRYKNTWPLCLEFLRTGKIDVKPLITHRFGFSQKEIEEAFETSARGGNAIKVMFNL

SEQ ID NO: 34319 - protein, 307 aa, Bacillus subtilis subsp. subtilis str. 168
MNEIAEVLPESMKNALSEIPEQQWLEIEEVRIRINRPVELIRRGQPVYLSYAGTAEDAHLILSRLSNYSMYTLEEELKKGYVTIRGGHRVGLAGRVITENGGVKGLRDIASFNIRIARQKLGIAEPLLPYLYQNSWLNTLIIGPPQTGKTTLLRDLARLSSTGKKNMLPVKTGIVDERSEIAGCLRGIPQHQFGQRIDVLDACPKAEGLMMMIRSMSPEVMIVDEIGRMEDTDALLEALHAGVSVIVSAHGWSISDLMKRPSLKRLWEERAFDRYLELSRAKGPGTVSQIYDKDGNVLSRTTGVKTC

SEQ ID NO: 34320 - protein, 151 aa, Brassica napus
  misc_feature (10)..(12): Xaa can be any naturally occurring amino acid
  misc_feature (16)..(16): Xaa can be any naturally occurring amino acid
  misc_feature (21)..(22): Xaa can be any naturally occurring amino acid
  misc_feature (32)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (41)..(41): Xaa can be any naturally occurring amino acid
  misc_feature (47)..(47): Xaa can be any naturally occurring amino acid
  misc_feature (54)..(54): Xaa can be any naturally occurring amino acid
  misc_feature (57)..(57): Xaa can be any naturally occurring amino acid
  misc_feature (60)..(60): Xaa can be any naturally occurring amino acid
  misc_feature (75)..(75): Xaa can be any naturally occurring amino acid
  misc_feature (82)..(82): Xaa can be any naturally occurring amino acid
  misc_feature (86)..(86): Xaa can be any naturally occurring amino acid
  misc_feature (90)..(90): Xaa can be any naturally occurring amino acid
  misc_feature (92)..(92): Xaa can be any naturally occurring amino acid
  misc_feature (98)..(98): Xaa can be any naturally occurring amino acid
  misc_feature (103)..(104): Xaa can be any naturally occurring amino acid
  misc_feature (108)..(108): Xaa can be any naturally occurring amino acid
  misc_feature (110)..(111): Xaa can be any naturally occurring amino acid
  misc_feature (113)..(113): Xaa can be any naturally occurring amino acid
  misc_feature (116)..(116): Xaa can be any naturally occurring amino acid
  misc_feature (118)..(118): Xaa can be any naturally occurring amino acid
  misc_feature (123)..(123): Xaa can be any naturally occurring amino acid
  misc_feature (127)..(128): Xaa can be any naturally occurring amino acid
  misc_feature (131)..(134): Xaa can be any naturally occurring amino acid
  misc_feature (136)..(136): Xaa can be any naturally occurring amino acid
  misc_feature (141)..(147): Xaa can be any naturally occurring amino acid
MASSMLSSAXXXTSPXQATMXXPFTGLKSSAXFXVTRKXNXDITSIXSNGGRVXCMXVWXPVGKKKFETLSYLPXLTEVELXKEDXYLLXAXKWIPCXEFQLXXGLVXRXXGXPPXTXNGRYXTLGXXPLXXXXDXDQVLXXXXXXXRPQF

SEQ ID NO: 34321 - protein, 424 aa, Glycine max
MAVEYTCCSTAFFVHIVVIVLLVLFAGLMSGLTLGLMSLSLVDLEVLAKSGTPQDRKHAEKILPVVKNQHLLLCTLLICNAAAMETLPIFLDGLVTAWGAILISVTLILLFGEIIPQSVCSRYGLAIGASVAPFVRVLVCICFPVAFPISKLLDFLLGHRHEALFRRAELKTLVNLHGNEAGKGGELTHDETTIIAGALELSEKTASDAMTPISETFTVDINSKLDSRELMNEILEKGHSRVPVYYEQPTNIIGLVLVKNLLTIDPEEEIPVKNVTIRRIPRVPETLPLYDILNEFQKGHSHMAVVVRHCEKTGQQSSNNNADVRDVKVDIDGEKNPQENMLKTKRSLQKWKSFPNSNNSNRGGSRSRKWSKNMYSDILEIDGNSLPSLPEKEEAVGIITMEDVIEELLQEEIFDETDHHFEDS

SEQ ID NO: 34322 - protein, 343 aa, Nostoc punctiforme PCC 73102
MTRAINRQFLLAARPVGDIKESDFEYREEPIPSPKDDEVLVRTIYLSLDPTNRIWMSDMEQYMPPVEIGEVMRGGIIGVVEESKNPNFKKGDLVSGLLGWQDYAIALGSSGFSLTRLPNPLPCPLNAFTGPLGATGFTAYFGLLDIGQPKVGETVVVSAAGGAVGSIVGQIAKIKGCRVVGITGSDEKCRWLTEELGFDAAINYKTGDLEKALAQACPNGIDVYFDNVGGIILDAVLTKINLRARLPLCGLISTYNASKPVPGPYNYSQILMKRALVQGFIILDYIPRFHEAIAEIGKWLNQGQIKYALEIVEGLENAPKAILKLFDGNKKGKLVIKVSNEPT

SEQ ID NO: 34323 - protein, 433 aa, Vibrio vulnificus CMCP6
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALAGRAPFNGLKEVKGQA

SEQ ID NO: 34324 - protein, 130 aa, Vitis vinifera
MAYQQDPCANPTHQTGKTGGQTDQYGNPVHQTEAMGAYGAGTGTGMHGGEHQQQPHQQPGVLHRSGSSSSEDDGQGGRRKKGMKEKIKERIPGMGRKDEQKHTSATSTPGQGQQQKGMMEKIKEKLPGGH

SEQ ID NO: 34325 - protein, 424 aa, Rhodopirellula baltica SH 1
MSSAAAASETTQNSDPYIQSLFAERIGGANYGKSTEIYKFEKIKRAKRKALADHPERQLLDFGIGENDSMADASIREVMGREINQVENRGYADNGVAEYKEAAARFMQRQFGVKLDPETQINHCIGSKPAYAMLPACFINPGDITMMTVPGYPVAGTHTRYYGGDVYRLPLLAENKFLPDLDAIPDDVFRRTKLMILNYPNSPTGGTAPKSFFEDVITLAKEKEFVVVNDAAHIMLTFDGKPTSFLEVPGALDVGVEVHSMSKGYDMIGWRMGFVAGHPLVVKAFSDVKDNSDSGQFIATQKAAAAALDDDSIPERIRTKYRRRMEKLVKVLRDCGFEAEMPGGTYFLYTKSPTGTASGETFAAAEDATRFLIEENGIVTVPWDDAGSFLRFSVTYIAEDEAAEDALMAETAARLSGAGFQWKS

SEQ ID NO: 34326 - protein, 556 aa, Photobacterium sp. SKA34
MCSVFGILDIKSDAAALRPIALEMSKKLRHRGPDWSGIYASEHAILAHERLAIVGLNSGAQPIYSPDKKLILAVNGEIYNHKEIRARYEGKYDFQTDSDCEVILALYQDMGEELLEELNGIFAFVLYDEEKDTYLVGRDHIGIIPLYQGSDENGNYYVASEMKALVPVCKTVSEFPPGSYYGSADAEPQRYYNRDWNEYAAVQGNSTSKEELTEALEAAIKRQLMTDVPYGVLLSGGLDSSITSAVAKRFAAMRIEDNDQSEAWWPQLHSFAVGLEGAPDLKAAREVADKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPEDKMCGNGKMEKHILRECFEHYLPESIAWRQKEQFSDGVGYNWIDTLKEVAEEKVTDQQLETAAYRFPYNTPTTKEAYAYREIFEELFPLESAAKCVPGGPSIACSSAKAIEWDESFKNAADPSGRAIAAVHNEAYKK

SEQ ID NO: 34327 - protein, 316 aa, Escherichia coli O157:H7 EDL933
MNELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 34328 - protein, 341 aa, Arabidopsis thaliana
MAAKLISTGFRHTTLPENYVRPISDRPRLSEVSQLEDFPLIDLSSTDRSFLIQQIHQACARFGFFQVKNHGVNKQIIDEMVSVAREFFSMSMEEKMKLYSDDPTKTTRLSTSFNVKKEEVNNWRDYLRLHCYPIHKYVNEWPSNPPSFKEIVSKYSREVREVGFKIEELISESLGLEKDYMKKVLGEQGQHMAVNYYPPCPEPELTYGLPAHTDPNALTILLQDTTVCGLQILIDGQWFAVNPHPDAFVINIGDQLQALSNGVYKSVWRRAVTNTENPRLSVASFLCPADCAVMSPAKPLWEAEDDETKPVYKDFTYAEYYKKFWSRNLDQEHFLENFLNN

SEQ ID NO: 34329 - protein, 667 aa, Escherichia coli O157:H7 EDL933
  misc_feature (114)..(114): Xaa can be any naturally occurring amino acid
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGXLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKDIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 34330 - protein, 160 aa, Taxus wallichiana var. chinensis
QIPVGVAGPLLLNGFEYMVPMATTEGCLVASTNRGCKAIHMCGGATSILLRDGMTRAPVVRFQSAKRAADLKYYIEDPTNAENLSHIFNRTTRFGRLQGIQCAIAGKNLYMRFCCFTGDAMGMNMVSKGVQNVLDYLQTVFPDMDVISVSGNYCADKKPA

SEQ ID NO: 34331 - protein, 129 aa, Nanoarchaeum equitans Kin4-M
MARDIVADFLSHLTNVRRKGEDKTAFFPVSNLIIKLVEIMKREGYIKNYRLVDSSRGKIIEIELSEYFNEANAIKPRFPVEYSELEKYEKRYLPALNFGRLILSTSKGLITNREAKEQKIGGVLIAYVY

SEQ ID NO: 34332 - protein, 388 aa, Nocardioides sp. JS614
MTREHDIVLVGATGFTGGLTAEYLLRHAPAGLRWALAGRNREKLEAVRDRLADIDPVAADLPLLHADTTDPGALADLAAATRVVITTVGPYLEHGGPLVAACAEAGTDYVDLTGEPEFVDRTYVEHHATAQRTGARIVHACGFDSVPHDLGALYTVQQLAATGPVRLRGVVRSGATFSGGTFHSALGQFSRARQMRTAMQERRRAEPRPEGRRSRAVSGKPHRDPLLGYWLVPLPTIDPFVVARSGAALAAYGPDFSYSHYAGTKTLRYAAGGAAAAVAVFGAAQVPPLRRLLLGRIPQGEGPDERRRSKSWFTVDFVGEGDGRTVHTRVSGGDPGYDETAKMLAESALCLALDDNPPTSGQVTTAQAMGDNLLTRLQAAGIRFETLD

SEQ ID NO: 34333 - protein, 137 aa, Brassica napus
MSSKRLNLGSKDFISSLPDCLICHILSFVSTKEAASTSVLAKRWRYLFALTPNLEFNDSIYLNSEIANQRKSTFPWITRKKSKTPRSFVDFVDRVLVLHQNVPLNRFSLKCEDVVHPAIIISWLLKVMDRGVLDLDL

SEQ ID NO: 34334 - protein, 207 aa, Taxus wallichiana var. chinensis
  misc_feature (201)..(201): Xaa can be any naturally occurring amino acid
  misc_feature (203)..(203): Xaa can be any naturally occurring amino acid
CAMEMIHTMSLIHDDLPRMDNDDFRRGKPTNHKVFGEDTAVLAGDALLSFAFEHIAVATSKTVPSDRTLRVISELGKTIGSQGLVGGQVVDITSEGDANVDLKTLEWIHIHKTAVLLECSVVSGGILGGATEDEIARIRRYARCVGLLFQVMDDILDVTKSSEELGKTAGKDLLTDKATYPKLMGLEKAKEFAAELATKAXEXLSSF

SEQ ID NO: 34335 - protein, 208 aa, Triticum aestivum
MDGVVVRRVIPSDNSCLFNAVGYVMEHNKNKASELRQVIAAAVASDPEKYNEAFLGKPNEAYCAWIMDPDKWGGAIELSILSEYYGREIAAYDIQTTRCDLYGQGKNYNERAMLIYDGLHYDALATSPAEGAPEEFDQTIYVVDQNRSIGPVEGLALNLAKEAHRKRSYTDTANFTLRCGVCQIGVIGQKEAVEHAQATGHVNFQEYK

SEQ ID NO: 34336 - protein, 212 aa, Zea mays
MNPFAKKPTPREVMRSSKRDLTNATRGIERDIASLQQEEKKLVAEIKRTAKTGNEAATKILARQLIRLRQQISNLQGSRAQIRGIATHTQAMHANTSVATGLQSASKAMGALNKQMEPTKQMKIMQEFQKQSAQMDMTNEMMSDSIDDVLDDDQAEEETEELANQVLDEIGVDIASQLSSAPKGKIAGKKVQVDESSELEELEKRLAALKNA

SEQ ID NO: 34337 - protein, 361 aa, Xanthomonas oryzae pv. oryzae KACC10331
MSVSFASTRSPSPRSADELSVILAAPGFGLHFTDHMVAISWNNEQGWHDAQVRAYGPLQLDPAASVLHYGQEIFEGIKAYRHADGSIWTFRPQANGERLQRSARRLALPELPVDLFVESLRQLVAVDGNWVPSAPETSLYFRPFMIADEAFLGVRAAHKASYYVIASPAGPYFANGVAPVSIWLSTEYARAAKGGTGAAKCGGNYAASLLPQQKAYAQGCSQVLFLDPVEGKYIEELGGMNVFLVYRDGTLVTPELSGSILEGITRDSILQLARDRGMQVIERKVAIDEWKQGVASGEITEVFACGTAAVVTPIGELKGDGFAVGDLSVPAGEVTMSLRQELTDIQYGRVPDRHGWLVRLS

SEQ ID NO: 34338 - protein, 439 aa, Rhodopirellula baltica SH 1
MNSPANSSAARPAAGPKSVAAFQRASALMPGGVNSPARAFGAVGGTPLFIERAEGPYLYDIDGNRYIDYIGSWGPMILGHAHPEVINAITQAAAKGTSYGAPTEAESRLAEQIIEAVPSIEKVRLVNSGTEATMSALRVARGATGRKKVIKFAGNYHGHVDSLLVAAGSAAATLGAPDSPGVTPGAAEDTLVLSYNDVSGLQNAFAQHGDDIAALILEPVVGNMGCVLPTMEFLNAARDLTTKHGSILIFDEVMTGFRVAYGGAQERFGVTPDMTTLGKIVGGGMPLGAYGGRADIMNQVLPAGKVFQAGTLSGNPVAVAAGSATLRLLKENPPYEQLERLADRLADGLDRAATSAGMAHTVAKAGAMLTLFFNPEPVDCWAVADRCDREAFGRYFWGLIDEGIYMPCSQFEALFFSQQHTEAMIDETIAAAEKVLKSL

SEQ ID NO: 34339 - protein, 1481 aa, Debaryomyces hansenii CBS767
MNSSTHYDDVSQKSSTVNDLADDNKIPEYHGFDKEVSSEVQNLARMMSRPSIDKASSLARTLSNMSQVPGLNPMAKDEGELDPRLDPDSDSFDSKFWVKNLRKMHNSDPAYYKPASLGVAYKDLRAYGIATDADYQANVGNVVYKTISQTIKGFFDKNNDDAKFDILKPMDGLIRPGEVTVVLGRPGAGCSTFLKTISSNTHGFTVAKDSVLSYDGLKPNDIIKHFRGDVVYCAETESHFPQLTVGQTLDFAAKLRTPQNRPEGVSREEYAAHMTKVIMATYGLSHTRNTKVGNDFIRGVSGGERKRVSIAEVALSFASLQCWDNSTRGLDSATALEFIKALKTSATVLNATPMIAIYQCSQDAYDLFDKVILLYEGYQIFFGDCKQAKLYFLEMGYDCPQRQTTADFLTSLTNPSERVVRPGYENKVPRTPEEFYTYWQNSPERKALLGEIDDYLNKTDNEERLQQFKDAHNTKQSNHLRPASPYTVSYGLQVKYIMGRNIMRTKGDPSITLFSIFGNTVMGLIISSIFYNLDDTTGSFYYRTVAMFFAVLFNAFSSLLEIFALYEARPIVEKHKTYALYHPSADAFASIITELPPKLLVSISFNLVLYFMVNFRRNAGNFFFYLLVNFTATLSMSHLFRTIGSATKSLSQAMTPASVLLLALTIFTGFVIPTPEMLGWCRWINYLDPIGYAFEALIANEFHGRDFDCSQFVPSGPGYPTSGNSIICSVVGSQPGSDIVNGDDYIRGSYEYYFSHRWRNWGIVVGFVVFFLFVHIIICEYNKGAMQKGEILLFQRSALKKNKRQRKDIESGNIEKVGPEFNNEKTPDNEIDNKLPSSGDIFHWRELTYQVKIKSEDRVILNSVDGWVKPGQVTALMGASGAGKTTLLNALSDRLTSGVITSGVRMVNGHELDASFQRSIGYVQQQDLHLQTSTVREALTFSAYLRQPKSVPKSEKDSYVDYIIRLLEMEKYSDAVVGVSGEGLNVEQRKRLTIGVELVAKPKLLVFLDEPTSGLDSQTAWSICKLIRKLADHGQAILCTIHQPSAILLKEFDRLLFLQRGGKTVYFGDLGDNCQTLIDYFEKYGAPKCPPDANPAEWMLEVIGAAPGSHASQDYYDVWMNSTEYREVKGELDVMEQELVKKPKDDSPESMKTFAVPMWQQYINVTHRVLQQYWRTPSYTYSKVLMSIFSSLFNGFAFFKANNTMQGLQNQMFSVFMFFVIFNTLTQQYLPNYVSQRDLYEARERPSKTFSWVAFITAQITAEIPWQILTGTLAFFCWYYPIGLYGNAEATDTVSQRGALMWIIIVLFFIYCSTMAQLCISFMEVADNAANLASLLFTMCLTFCGILASPDAMPGFWIFMYRCNPFSYLVSAILSVALQDSSVTCSDKELLRFEPEGGQTCGEYMQSYIQNAGGYLISNDTTGSCEYCTISSTNVFLESVSVDKTKRSRDIGIFFCFIVINMIGTVFFYWLARVPKRSRQK

SEQ ID NO: 34340 - protein, 323 aa, Zea mays
SCDTDLRFSLDAGRMSVDGMGFAWDQPRASWDGYLFGAGAGAGIALGRAPPPLSRLPPILSAMEDSPAGIVERSDGQIPVEDDSQPEPDPDANVPGGSAQTRDYYMDTSSRRRRSLDRSSSVRRSFEVTDPKPVAVPVPVPVPATAPAAMVNGKESPLMGSSEFYHFHHAEDLFDHRFSTNSLVEDFSASLDAAFPGPAKKPPRRWRKAWSLWGLIHRRAAGRGNGADRAFSEPWPELRVRGHSGRMQRCNSNACARSSFSSNSGGGLGSSRRSYVVDAHGHAKRRREEGAALERNRSARHSPGPGTADSGMLRLYLTPVRSA

SEQ ID NO: 34341 - protein, 657 aa, Nanoarchaeum equitans Kin4-M
MEELEKLELEKYLLKKMNEANDILYISLKELEELGLINLIDEILDNPEKAIEQIKTIVKEIQEEYALTKVDYYIAFTDVQYYRNVKIRELRSHHLNKLVAIEGIIKQSSMVKPVLKRAVFRHSCGYEVEKEIKSISDKISKPKKCPKCNKSGDWEIVEEEYIDIQRLVLEELPENLTGGAQPERVTAILKDKLVEPKINDKTVPGARVRIVGIPRTAKLTEKGAIYDILIEVNNIEFLEKNITDIVITNKDLVEIKEIANSNNPLDLLVENFAPSIFGYDYIKKAILLQMVGGVKKIRRDGTKVRGHIHILLVGDPGTAKSTLLKYAAEVAPRGRYVSGTSATAVGLVAVVVRDELLKVWSIDAGPMVLANGGLLALDEIEKLGKNELMILHEAMEQGSVTISKAGIHVTLKTETSVLAAANPKFGRWDDNLSLVEQIAIPPTILNRFDLIFLIRDKPGKDYDEQLAERVLESYVEDVDLAIPVDLLRKYILYVRKNIKPRLSNEAIARIKDFFVSLREKSQELKAVPISTRQLESIVRLAEASARIRFSDIVEKEDADLAIELTKRFLEEAGVDPESKVIDITILESGKPRSKIEKQKLLLQLIKQLDSGEGVSEKELIEKAKEYGLMDSEIEQLLYYLKTSGAVFEIKPGILKAV

SEQ ID NO: 34342 - protein, 680 aa, Arabidopsis thaliana
MTATQMLLHLLLLPLLFLHFSNQVMAEITDELATLMEVKTELDPEDKHLASWSVNGDLCKDFEGVGCDWKGRVSNISLQGKGLSGKISPNIGKLKHLTGLFLHYNALVGDIPRELGNLSELTGLYLNVNNLSGEIPSNIGKMQGLQVLQLCYNNLTGSIPRELSSLRKLSVLALQSNKLTGAIPASLGDLSALERLDLSYNHLFGSVPGKLASPPLLRVLDIRNNSLTGNVPPVLKRLNEGFSFENNLGLCGAEFSPLKSCNGTAPEEPKPYGATVFGFPSRDIPESANLRSPCNGTNCNTPPKSHQGAILIGLVVSTIALSAISILLFTHYRRRKQKLSTTYEMSDNRLNTVGGGFRKNNGSPLASLEYTNGWDPLSDNRNLSVFAQEVIQSFRFNLEEVETATQYFSEVNLLGRSNFSATYKGILRDGSAVAIKRFSKTSCKSEEPEFLKGLNMLASLKHENLSKLRGFCCSRGRGECFLIYDFAPNGNLLSYLDLKDGDAHVLDWSTRVSIAKGIAKGIAYLHSYKGSKPALVHQNISAEKVLIDQRYSPLLSNSGLHTLLTNDIVFSALKDSAAMGYLAPEYTTTGRFTEKTDVYAFGILVFQIISGKQKVRHLVKLGTEACRFNDYIDPNLQGRFFEYEATKLARIAWLCTHESPIERPSVEAVVHELGNCSSCL

SEQ ID NO: 34343 - protein, 875 aa, Arabidopsis thaliana
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGFARVFFSATPTFIRYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKKLNVFICRNLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 34344 - protein, 1463 aa, Debaryomyces hansenii CBS767
MTDDNEVPNYRGFDEGVSSEVQNFARSMSRPSIDKASSLARTLSNVSQVPGVNPMSKEEDIDPRLDPDSDNFDSRFWVKNLRKMYNSDPAYYKPSSLGVAYKDLRAYGIATDADYQSNFGNAAYKVVARTIRRFMDRNNEAAKFDILKPMDGLIRPGEVTVVLGRPGAGCSTFLKTIAAHTYGFTIDKNSVLSYDGLTPKDIIKHFRGDVVYCAETESHFPQLTVGQTLEFAAKLRTPQNRPEGVSREEYAEHLTKVVMATYGLSHTKNTKVGNDFIRGVSGGERKRVSIAEVALSFASLQCWDNSTRGLDSATALEFIKALKTSATVLNATPMIAIYQCSQDAYDLFDKVILLYEGYQIFFGDCKQAKLYFLEMGYDCPQRQTTADFLTSLTNPSERVVRPGYENKVPRTPEEFYTYWQNSPERKALLGEIDDYLNKTDNEERLQQFKDAHNTKQSNHLRPASPYTVSYGMQVKYIIKRNIMRTKGDPSITIFGVFGNIVMGLIISSIFYNLEDNTGSFYYRTAAMFFAVLFNAFSSMLEIFSLYEARPIVEKHKTYALYHPSADAFASIITELPPKIFTCLAFNLVLYFMVNFRRNAGNFFFYLLVNFTATLSMSHLFRTIGSSTKSLSQAMTPASILLLALTIFTGFVIPTPKMLGWCRWINYLDPIGYAFEALIVNEFHGRDFDCSQFVPSGPGYPTSGDSIICSVVGAVAGRDYVTGDAYINEQYVYYWSNRWRNWGIVVAFVVFFLVVHIMICEYNKGAMQKGEILLFQRKALKKNKRRRNDIESGNIEKISPDYNNDNVTDNEMESKLPSAGDIFHWRELTYQVKIKSEERVILNSVDGWVKPGQVTALMGASGAGKTTLLNALSDRLTSGVITSGVRMVNGHELDASFQRSIGYVQQQDLHLQTSTVREALTFSAYLRQPKSVPKSEKDSYVDYIIRLLEMEKYSDAVVGVSGEGLNVEQRKRLTIGVELVAKPKLLVFLDEPTSGLDSQTAWSICKLIRKLADHGQAILCTIHQPSAILLKEFDRLLFLQRGGKTVYFGDLGDNCQTLIDYFEKYGAPKCPPDANPAEWMLEVIGAAPGSHASQDYYDVWINSSEYVTINHELDIMEQELVKKPKDDSPESMKTFAAPFWYQYKYVTQRVFQQYWRTPSYTYSKVLMSIFSSLFNGFAFFKADKSLQGLQNQMFSVFMFFVLFNTLVQQYLPHFVAQRDLYEVRERPSRTLSWFAFITAQITAEIPWQIASGTLAFFCWYYPIGLYRNAEPTDAVAQRGALMWIIIVLFFIYCSTMAQLCISFNELADNAANLSSLLFTMCLTFCGILASSDSMPRFWIFMYRCNPFSYLVSAILSVALANSDVTCDYNELLRFKPEDGQTCGEYMQTYMSFAGGYLISNDTTVTCEFCTVASTNVYLQQVGADYSKKSRDIGIFVCFIAINIIGTIFFYWLARVPKTSRQKNK

SEQ ID NO: 34345 - protein, 418 aa, Chlamydomonas reinhardtii
MLANLRSGIQGRTTSAPQKAAFAPTRRGCAHARTGGRRTTVVVRADGDFYDLLGVPRTADKKTIKQAYRQKARKYHPDVNKEPGAEDLFKKIGEAYEVLSDDNKKAIYDKYGEAGLRGGMGGMGGGPGVEFTNPFDLFESFFGGGMGGMGGMGGMGGGFSQRSRTRAVPGEDDKVDLQLDFLEAVFGCSRELDVDRLTGCDECETTGVRKGTTPSTCPQCQGTGQVVSAVRTPLGTFQQVSLCPRCEGSGQISQPCTKCQGDGRVRETKRISLKVPAGVDAGSRLRVRGEGNSGRRGGEPGDLYVYITIKDHPELRRDGITIHSDVEISYVDAILGTQVKVTTVDGPVELKIPPGTQPGTTLLMAKRGVPRLGSPNVRGDHMVHVRVRIPKALSADERKLVEELKELQSKTKVGPFRF

SEQ ID NO: 34346 - protein, 220 aa, Xanthomonas campestris pv. campestris str. ATCC 33913
MNELNHLLENNRAWADRINREDPEFFAKLSTQQSPEYLWIGCSDSRVPANQIIDMAPGEVFVHRNIANVVVHTDLNCLSVIQFAVDVLKVKHILVVGHYGCGGVFASLTQKRMGLVDNWIRHVTDVADKHEACLHQAGDLSVQHARLCELNVLEQVVNVCRTTIVRDAWDRGQDLRVHGWVYSLRDGRAHDLRMSVDRADILQERYDAALAQIQADHSER

SEQ ID NO: 34347 - protein, 175 aa, Triticum aestivum
MAPTVMASSATSVVPFQGLKSTVGLPVSRRSNGASLGSVSNGGRIRCLQVWPIEGIKKFETLSYLPPISREALLKQVDYLIRSKWVPCLEYSKVGFIFREHNASPGYYDGRYWTMWKLPMFGCTDATQVINEVEEVTKEYPDAYVRIIGFDNMRQVQCVSFIAFKPPGCEESGKA

SEQ ID NO: 34348 - protein, 461 aa, Kineococcus radiotolerans SRS30216
MVEPTERPASREPIDFTVESLGPRTVDSPLAPRLLARRTTHHYIEETDRVLFDDTLSKVSRRDGDLEDLPSLEPTGPRKKIFFDPSKTRVGIVTCGGLCPGINNVIRGLVSELTNHYGVRRIYGFKNGYQGFIPSYGHDVVDLTPESVSDIDGEGGTILGTSRGQQDAVEVVDCLERMGISILFVIGGDGTMRGAQKISAEIKARDLKIAVVGIPKTIDNDIPFIDQSFGFQSAFSEATRSIRSAKVEARTAPNGVSIVKLMGRHSGFIACYAALAQNDADFVLIPEVPFTLAGPGGFLEKLREKVASQGHALVVAAEGAGQELFDDDGLKDASGNKKLQDVGRLLRQAITDDFAAHDLELNMRYIDPSYVIRSVPANPYDSVYCIRLAHAAVHAAMAGRTNMVVGRWRRRFVHIPIALAVSARNQVDPHGDLWWSVLEATGQPWSFGDFAPEHVSAFGGQ

SEQ ID NO: 34349 - protein, 474 aa, Oryza sativa
MAQQLSAPFRAAAAAGSRASAAAADPAKVSPSLPFLLCSLSLTFFPTPPPEFSGLFRVGVRLAEGWDVFVRCVTSCVADTAPRFRLKLGFRESGNLGLGGGGANAGVRFLFIARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 34350 - protein, 794 aa, Silicibacter sp. TM1040
MSQNIEHLRTVEQRLLWLSHWMIHNANHLRAKEDGIKIGGHQASSASMVSIMTALYFSALRPEDRVAVKPHASPIFHAMQYLMGHQTREKMENFRGYGGVQSYPSRTKDIDDVDFSTGSVGLGVGITALASMVQDFITAKDWGGDVTPGRMVALVGDAELDEGNIYEVLQEGWKNDLRNTWWIIDYNRQSLDGIVREGLFGRIEKIFEAFGWDVVRVKYGALQRAAFEEPGGEALRDWIDACPNVEYSALTYMGGANWRKRLMEDLGDQGAVSALIDKRSDAELAALMENLGGNCVETMADTFAAIDHDRPTCFLAYTIKGWGTPIAGHKDNHGGLMTKAQMAEWQTHMGVAEGEEWELMATVSDTKGFQAYLDQVPFFAKGARRHSDARLSVPAVAVDTSREISTQMAFGKILDDLARGDSDLAARIMTTSPDVTGTTGLGPWVNRRKLFAREAQKDAFIEHRIPSTAKWNFDPKGQHLELGIAEMNLFLLLGAAGLSHSLWGKRVIPIGTVYDPFVHRGLDALNYACYQDARFMIVGTPSGVTLAPEGGAHQSVGTPLTGMAQDGLASFEPAFADELAVIMEWAFDYMQRDGEGDPDERTWLRDETGGSVYLRLTTKPLEQPGQRVDDAFRQGAIDGAYWLRKPGPNCSVVIAYQGAVADEAIAAAGLVGEHRRDVAVLAVTSADRLNAGWTAAQRERARGNPQAVSHVERLLGELPAHCTLITAIDGHPATLSWLGSVAGHRVVSHGVEHFGQTGTIGDLYRHFGLDRHSLARSVGELTTGARRIPGGQAG

SEQ ID NO: 34351 - protein, 398 aa, Glycine max
MHYLAFNPSSLWWQLNEFATPHTKTKPLKMSSPSPVATVVSAAALYDRAKAVKEFDETKVGVKGLIDSGIRTIPPFFVHPPETLADLKRGTKPGSAPEIPTVDLAAEESSRAAVVEQVRRAASTVGFFQVVNHGVPEELLLRTLAAVKAFHEQPAEERARVYRREMGKGVSYISNVDLFQSKAASWRDTIQIRMGPTAVDSSEIPEVCRKEVMEWDKEVARVARVLYGLLSEGLGLGTERLTEMGLVEGRVMVGHYYPFCPQPDLTVGLNSHADPGALTVLLQDHIGGLQVETEQGWIHVKPQPNALVINIGDFLQIISNETYKSAHHRVLANYSNEPRVSIAVFLNPSDREKHFGPLPELTSTEKPALYRNFTFHEFMTRFFTKELDGKSLTNFFRQ

SEQ ID NO: 34352 - protein, 447 aa, Sulfitobacter sp. EE-36
MPIEILMPALSPTMEEGTLAKWLVSEGDSVSSGDILCEIETDKATMEFEAVDEGTIGKILIGDGSEGVKVNTPIAVLLEEGEEASDIDSAPAPDVKDSAKEDAPDQDAAPEKGYGRGESDANDTSTSAPAAPKSSDGKRLFVTPLARRIAADKGVDLAELSGSGPHGRIIKADVEAASAGSAKAKPAESTETASAPAATAAPAAGPSADAVMKIYEGRAFEEISLNGMRKTIAARLTEAKQSIPHFYLRRDIELDALLKFRGELNKQLEARDVKLSVNDFIIKACALALQTVSDANAVWAGDRILKLKPSDVAVAVAIEGGLFTPVLKDAEMKSLSTLSAEMKDLATRARDRKLAPHEYQGGSFAISNLGMFGIDNFDAVINPPHGAILAVGAGVKKPVVGKDGELAVATVMSVTLSVDHRVIDGALGAQLLSAIKDNLENPMMMLA

SEQ ID NO: 34353 - protein, 465 aa, Sulfitobacter sp. EE-36
MAIEILMPALSPTMEEGTLAKWLVKEGDTVSSGDIMAEIETDKATMEFEAVDEGTIGKILIDAGTEGVKVNTPIAVLLEDGEDASDIDSASSAAPAEQTKADDSEDAKSDKAPAAAKPDAEAPKAPETDTTPDWPEGTKLKQQTVREALRDAMAEEMRRDEDVFLMGEEVAEYEGAYKISQGLLDEFGAKRIIDTPITEHGFAGIGVGAAFGGLRPIVEFMTWNFAMQAIDHILNSAAKTLYMSGGQMGAPMVFRGPNGAAARVGAQHSQDYAAWYMQIPGLKVAMPYSASDAKGLMKTAIRDPNPVVFLENEIMYGKSFDVPDVDDYTVPFGKARIWREGTDVTIVSFGIGMTYALEAAEKLAEEGIDAEVIDLRTLRPMDTASIIKSVMKTNRLVTVEEGWPQGSVGNYISSVIMQEAFDYLDAPVINCTGKDVPMPYAANLEKLALVTTDEVIAAVKKVTYK

SEQ ID NO: 34354 - protein, 389 aa, Sulfitobacter sp. EE-36
MDLRGKRVLVRVDINVPVENGKVTDDTRIQRIIPTLRDILEQGGTPVLLAHFGRPKGKRVQDLSLRVVLPALEDALGRKVVLAETLEAAEAGTEEINAADVLLLENIRFYPGETENDPDFAKRLAGLGDIYCNDAFSAAHRAHASTEGVARLLPSCAGRLMQAELSALEAALATPKRPVGAVVGGAKVSTKIELLENLVNRLDLLVIGGGMANTFLGAQGADLGKSLSEPDFYDTAKDILAQAEKAGCRVLLPVDGLVAREFAAHAAHEVAALGADTVLAADQMVLDAGPKTVELVKDAFNGLKTLIWNGPMGAFEIAPFDTATVAAAKAAAALTRDGALISVAGGGDTVAALNQAGAADDFTYISTAGGAFLEWMEGKTLPGVAALDA

SEQ ID NO: 34355 - protein, 367 aa, Glycine max
MRDGMNSRILLDAAKSCILASSPVFRRQQFLIRCVGGSTDQRDMQALRSLEVDSQSIIRAITPALDPTRHKGQAGNIAVIGGCREYTGAPYFSAISALKIGADLSHVFCTKDAAPVIKSYSPELIVHPVLEESYNVGEEHKSSIASKVLAEVDKWLERFDCLVVGPGLGRDPFLLDCVSEIMRHARRSNIPIVIDGDGLFLVTNNLELVSGYALAVLTPNVNEYKRLVQKVLSSEVNDIDAPQQLLSLAKQIGGVTILSKGNSDLISDGDTVKSVSVYGSPRRCGGQGDILSGSVAVFLSWARQHILAADSNSNLSCKNPIVLGCIAGSAILRKAASLAFSNKKRSTVTGDIIECLGRSLEDISPAC

SEQ ID NO: 34356 - protein, 449 aa, Rhodococcus sp. RHA1
MSQISVPGKERAVSGARSVVLTCLAITILDGVDLIMFGAVLPTLLELEQWGITTGSAGLIGSLSLFGMMAGAMLAGYITDRIGRRPVVLACIVSFSLFTGLCAIAPNLESFGLFRLLAGIGFGGALPTLIALTQEYVKVDRRQFYNGVIQTGFPIGGCVVAIAAIFIIPAFGWKSMFAVGGLLGVVLFVIAYRKLPESIAFLASKGRHNEARELAQRYSIDAGAESGMALEKSKSGSTGSPSGLRLLFAPGYRIATIMFPLITFFGLLVSYGMNTWIPQMLRSSGYDLGSALTFLLAFNIGSGFGMVVITGLADRLGSRPVISVSFVFGALAVSALTLQPAQALVFGLVLLIGFCASSTTGVYGFVGVFYPAAARGTALGLAVGLGRLGGVCGPILTGMIMSSALGADWAFYAFAFAGVAAAVLVSLVPRKNKAASETDVSVEKATEPA

SEQ ID NO: 34357 - protein, 169 aa, Cryptococcus neoformans var. neoformans JEC21
MSTAAKRRLIRDFKRLTSDAPIGISGSPNPDNIMVWNAVIFGPPETPFEDGSFRLTLTFTDAYPNKPPTVRFISKMFHPNIYANGELCLDILQNRWSPTYDVAAILTSVQSLLNDPNPASPANVDAAQLFKENLKEYERRVKKTVELSWVDNADEIEAEVVEADEGSSS

SEQ ID NO: 34358 - protein, 482 aa, Rhodococcus sp. RHA1
MHQFNSTERIIVSLELYVDGKWIASTSTERIDVVNPTTEERIGSVPAGAAEDVDMAVAAARRALGQWSQTAPHTRAEFVSHLADELERRQDDITDIVVAEVGTPRRVARWAQVGLGIVDLREAVTAAKDFPWEEPLRNSLIVREPVGVIGCITPWNYPLHQITAKIGAALVAGCTVVVKASEVAPFTAHALAEAVEAVGIPAGVFNMVHGTGPIVGEAIAVHPDIDMVSFTGSNSVGKRVLELAAGTVKRVSVELGGKSAAVLLDDLDVEEFAKAVPHTVRACYMNGGQSCNAQTRLLVPRSRLSEAETLAAQAVAAYAPGDPTGGNTKLGPMVTAAQRERVLGYIRAGVKEGAKLVAGSVDAPARTGFFVEPTVFSEVDPDSTIAQEEIFGPVLSIIAYDTTEHAIEIANGTIFGIAGAVWSADAERAKSVARRLRATQIEVNGGKFNGAAPFGGFNQSGHGREGGAFGLEEFVEIKSLQL

SEQ ID NO: 34359 - protein, 306 aa, Vibrio angustum S14
MTSAVSEMWQQRHEGKFTGVKQCELGWVSLTPKRSDKVIIVVNGRVETYWKYQELFYDLVKQGYHVYSFDHRGQGVSERLVADHELGYVEDFDDYVEDLHLFMQNIVKPQGYKQHFILGHSMGGAITSLALARYPTLFDRAVLSAPMHGIYVKPHLKPFAEALIGITELFRRQPHYAIGQKPYYAKPFDGNLLTHSQARYQWFRDLYDVRPELRIGGASNHWVWESIKAARRAIQQANSITIPVLLLQGSEDKIVDNACQHQFHQQLNQGSGHCDFQIIEGSRHEILFESDPLRNQAITALLAHFA

SEQ ID NO: 34360 - protein, 129 aa, Glycine max
EEEMLQWYRERIVWTDKALFMKLMRKGILTRIYAPMIIIQSLKESGVFSSLIAKAAQTKLSKDNFLQSVESSNSTRNSRSEIISSRKIDAGGLSQATARRILEVIDDSLPSAIPPLSPPSLDHADLIIS

SEQ ID NO: 34361 - protein, 425 aa, Oryza sativa (japonica cultivar-group)
MAAPPQPQPEPEPAAGGAGLEALEGLALDTVIAKAGARQAAALACASTRLRDAAGDDALWRRFCADDLALHAPLAPDGRALPSFKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYHDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKYPLLTTGQEEFVYESCTPLPDSPGSVEGSFTFVPGKLSRPEGKPFEVTVAAFPLEIPEYIF

SEQ ID NO: 34362 - protein, 457 aa, Oryza sativa (japonica cultivar-group)
MAAPPQPQPEPEPAAGGAGLEALEGLALDTVIAKAGARQAAALACASTRLRDAAGDDALWRRFCADDLALHAPLAPDGRALPSFKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYREFYDQGVFNMTNLIIVATSWYRPKTFFLNCSDDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKYPLLTTGQEEFVYESCTPLPDSPGSVEGSFTFVPGKLSRPEGKPFEVTVAAFPLEIPEYIF

SEQ ID NO: 34363 - protein, 326 aa, Rickettsia rickettsii
MDIKLGKYKPTKEEYIKSFKDMLLLRRFEEKCGQLYGMGEIGGFCHLYIGQEAVISAVDMVKQKGDSTITSYRDHAHIILAGTEPKYVLAELMGRATGCSKGKGGSMHLFNVPHKFYGGHGIVGAQVPIGTGLAFAEKYNDTHNICFTFLGDGAVNQGQVYEAFNMAALWGLPVVYIIENNEYSMGTSVARSTFMRDLYKKGASFGIKGFQLDGMDFKEMYDGSKQAAEYVRENSFPLILEVKTYRYRGHSMSDPAKYRSKEEVEQYKERDPLVIIRKTILDNKYVTEADLKAIEQSVKEIVKEAVEFSENSPLPDEGELYTQVYC

SEQ ID NO: 34364 - protein, 763 aa, Zea mays
MQGAVLVAIAAAIGNLLQGLDNAAIAAAVLYIKREFHLETDPALEGVVVATSLFGATIVTIFSGPVSDVIGRRPMLIVSSLLYFAGGLLMLWSPSVPVLLVARLVDGFGVGLAVTLVPVYISETAPPEIRGFLNTLPQLTGSLGMFLSYCMIFYMTLGDSPSWRFMLGVLSVPSLAYLALTVLYLPESPRWLVSKGRMKEARAILQMLRGREDVSGEMALLVEGLGSSDDTVIEEYVLGPAAAGDESEHETRDQVTLYGPEQGLSWVAQQVQGARSSVLGSAVGLASRQGSMYEQMKDPVVTLLGSVHDKMPDSGASARASTLFPNLGSMLSVTERHGGDWDEENVPPNDDLDDDEDEEEYLSDDEDAGAGAAARGGGGGGGALHAPLLSRQSTDVDVTSGTSKKDGSHPPESSPMQRYSSITSGEAASTMGIGGGWQLAWKWTEMVGADGVRRGGVKRMYLHEEGGGDGDSSDPAGGYVHAASLVSPSILYTKDVLIGQSPTPAFDSPPPETVANKAGGGPCWRELLEPGVRRALFCGVMIQILQQLSGINGVMYYTPQILDQAGVSVLLSSLGLSADSASILLSGVTMLMMLPCIVVAMRLMDVAGRRSLLLRTIPVLIVSLAVLVLANVVPMAAKVHALLSTACVVVYFCCFVMGFGPIPNILCAEIFPTRVRGICIAVCSLTFWICDIIVTNSLPVMLRTIGLAGVFGSYAFVCCLSLVFVYLRVPETKGFPLEVIIEFFNVGAKAQKPEQHEEEENHD

SEQ ID NO: 34365 - protein, 326 aa, Rickettsia rickettsii
MQITVREALRDAMQEEMIRDDKVFVIGEEVAEYQGAYKVTQGLLERFGPKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAADHKGLMLTAIRDDNPVVFLENEILYGHSFDVPQTIEPIPFGQAKILREGSSVTIVTFSIQVKLALDAANVVQNDNIDCEVIDLRTIKPLDTETIIESVKKTNRLVVVEEGWFFAGVGASIASIVMKEAFDYLDAPIEIVSGKDLPLPYAVNLETLALPSESDVIEAVKKVCYYSI

SEQ ID NO: 34366 - protein, 322 aa, Oryza sativa (japonica cultivar-group)
MASPAKAQRRPEGASVLETLPALPLAIIIAKAGPRCAAALACASSTLRAAASGEALWRHFCSDDFALDAPLAPGDLPLPSFKDAYKAWFQSFGMYPLPLVKRVKIFWSSFRAWLCEYFPEGLRTLGEGVSEAEIAVAECNLGLVLPMPTKLLYRFCNGQLHIGRGEEVSYGVMGGYDYVHQRYTVRLLPLAHHAVQKNSNYIVVATSCFGEKIFLLDCASGRLYVGTKYWNEEREIMACVPKATIRLAVDDDHGMPQDGFLLWLEEHLSRLQDGLIKVQSCKFPMLARHISLYPVQLPYCSSASMHGIKVSKLAFLLVYCHA

SEQ ID NO: 34367 - protein, 331 aa, Arabidopsis thaliana
MGEKDIPRNLKEEEEEEEENQSEETKSLISSLPSDIDCSGTKLYKYQGCWYDKDILQAILNFNKNFQPQETDIIVASFPKSGTTWLKALTFALAQRSKHTSDNHPLLTHNPHELVPYLELDLYLKSSKPDLTKLPSSSPRLFSTHMSFDALKVPLKESPCKIVYVCRNVNDVLISLWCFENSMSGENNLSLEALFESLCSGVNLCGPLWENVLGYWRGSLEDPKHVLFLRYEELKTEPRVQIKRLAEFLDCPFTKEEEDSGGVDKILELCSLRNLSGLEINKTGSLSEGVSFKSFFRKGEVGDWKSYMTPEMENKIDMIVEEKLQGSGLKL

SEQ ID NO: 34368 - protein, 501 aa, Bifidobacterium longum NCC2705
MRLMFEALGPTFVKVGQILSMRSEILPQSFCDELAKLRADADPMPYSTVLDVLAAEYGRPADEVFAHIDPKPLGSASLAQVHRATLKTGEDVAIKVQRPGVRETMAQDVSIMRSIAKAATKVIRTSQIVDLKGVVEELWDTFESETDFLIEARNLAEFKRFAARFKYMDCPTAYTELCTEHVVVMEYIDGISVSHPGRLVDAGYDLKEIGTKLVDNYATQILDDGFFHADPHPGNIIIRGGQIVLIDLGMTGRLDQRTRAVLKEMIFAVAKQDSPALAEGLLRFAGTEADPEDYPALLADLDVIVKEFGTVDLAELDIAAFLTALTQMAGRHNIEVPSTVTTVGRALVTLEGLLDEFIPDVNMIEIISDHIATSKSLKNATKDEIKSLGVEGHQALHATLGTMTELKTVARMLTRGQLRVNMELVGSEEPFQLLSDMVNRLTMALIVVGLFVGSSIVYYAGMKPIIFGIPVIGFMGYVVAFALGVWIVIDIYLKGRKTKKR

SEQ ID NO: 34369 - protein, 481 aa, Gibberella zeae PH-1
MASLPRNFKLGFATASYQIEGAVAEDGRGPSIWDTFCHLEPTRTKGANGDIACDHYHRLDEDLDLLKRYGSDMYRFSISWSRVIPLGGRHDPINEAGIAFYDRVIDGCLARGITPWVTLYHWDLPQALHERYGGWLDVEESQLDFERYARLCYERFGDRVKHWITLNEPWIVSIFGYATGGNAPGRSSINPQSTEGDTSTEPWIVGKALIMSHARAVAAYNKDFRQSQNGSIGISLNGDYYEPWDKNDPQDSEAAERRMQFHIGWFANPIFLGQGYPQCMRDQLKGRLPAFTPDDMQLLRSAETDFYGMNYYTSQFARHRSSPALDTDFIGNLDELQTNKAGEPVGLESGLHWLRSCPDLFRKHLTRVYRLYGKPIIITENGCPCPGEEMMSREESVQDEYRIKYFEDHLDAIGKSVTEDGSVIQGYFAWSLMDNLEWSDGYGPRFGVTFTDYKTLERTPKKSALVLRQIIDRQKGEQLKL

SEQ ID NO: 34370 - protein, 87 aa, Oryza sativa
  misc_feature (10)..(10): Xaa can be any naturally occurring amino acid
LYGGVFMYPXGTKEAKEGKIRLLYESIPMSFVVEKAGGASSNGQHSILKIQPQAIHQRSPVFLGYKEEIAKIEKLYEQYPRGTWAYE

SEQ ID NO: 34371 - protein, 179 aa, Glycine max
LFSAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 34372 - protein, 195 aa, Oryza sativa
  misc_feature (148)..(148): Xaa can be any naturally occurring amino acid
RLTHSNKTSSIELLLYGAHVYSWKAQNKELLFLSDQAIFQQGKAIRGGIPVVWPQFGPGPLPQHGFARVKPWRVTDKSINGDVSVQLQLTHDEETLKVWPNKFKLTLTVRLSENSFSQELKVDNQDEKSFEFTALFHSYFNVDDIKTXKISGLSNVTYLDKVDGGKSKTETNQLVEFTGETDRVYQDAGKKIILS

SEQ ID NO: 34373 - protein, 247 aa, Geobacter sulfurreducens PCA
MRTLVLIRHGESVWNRENRFTGWTDVGLTDKGAAEALRAGRTLKNEGFAFDEAFTSVLKRAIKTLWIVLEEMDQMWIPEHRHWRLNERHYGALQGLNKAETAERHGMEQVHVWRRSYDIPPPPLAAGDPRNPARDPRYAELDPADIPLTESLKDTVARFLPYWHETIAPRILAGRRLLIAAHGNSLRALVKYLDGIGDDAIAGLNIPTGIPLVYELEDDLHPIRSYYLGDPDEVARATQSVADQVKR

SEQ ID NO: 34374 - protein, 359 aa, Plectranthus barbatus
MSLIASPFPTWPLTKLKKPPTNSNLFSSTTKSIRRPSWEFLIPTRPSATVAVLVKEDSNKFSLNNFDFEAYMKEKAERVNRALDAAVAQREPRWIHESMRYSLLAGGKRVRPLLCIASCELVGGDERTAMPAACATEMIHTMSLIHDDLPCMDNDDLRRGKPTNHKVYGENVAVLAGDALLALAFEHVAAATEGVAPERVVRAVVEFGRYIGSEGLVGGQVVDIHSEGLAEVGVEQLEYIHLHKTAALLEAAVVMGAILGGADDEAVEKLRKFARCIGLLFQVVDDILDVTKSSEELGKTAGKDLLTDKTTYPKLLGLEKSREFAEKLRADACDQLVGFDPARAAPLIALANYIAYRNN

SEQ ID NO: 34375 - protein, 248 aa, Sinapis alba
EFFLGWFMGPLTNGTYPQIMIDTVGERLPSFSPEESNLVKGSYDFLGLNYYFTQYAQPSPNPVNSTNHTAMMDAGAKLTYINASGHYIGPLFEENKADETKNIYYYPKGIYSVMDYFKNKYYNPLIYVTENGISTPGDENRNQSMLDYTRIDYLCSHLCFLNKVIKEKDVNVKGYLAWALGDNYEFNKGFTVRFGLSYIDWNNVTDRDLKKSGQWYQKFISPGIKSPLKKDFLRSSLTFEKNKKLADA

SEQ ID NO: 34376 - protein, 503 aa, Xanthomonas campestris pv. campestris str. ATCC 33913
MDPQPAGGSTMHALPSIATPTTATPAWHGCIFNGDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 34377 - protein, 92 aa, Glycine max
ATFTGLKSMAGLPIRKTNRVISCTASNGGRMQCMQVMSPLGTKKFETLSYMTDLDDAQSAKEVEYLFTKGWINCLEIQLEHRVLYLEHNMSP

SEQ ID NO: 34378 - protein, 140 aa, Sambucus nigra
MCVLVFVCLSLLVGGGTAQSASNVRATYHIYNPQQINWDYNRASVYCATWDANRPLEWRRRYGWTAFCGPVGPRGRDSCGRCLRVTNTGTGTSETVRIVDQCANGGLDLEQGVFQRLDTDGRGYARGNLNVNYQFVNCND

SEQ ID NO: 34379 - protein, 377 aa, Oryza sativa (japonica cultivar-group)
MLLLLNPVFLITGKRQHVMRTFQGHNPNTMKVHSRKSQPSKKKPREFYDTVEVHIIDDDSDGDANIHKDYSMEDTSKHLVMYNPEITYDKQGEVEVTEPIDNYTSLNQRYMKPRHGYNTVLPSIGAYTVQCAHCFKWRIIPTKEKYEEIRENICQDVFVCERAREWNRVISCVDPEDISQDGSRVWAIDKASISQTPPGWDREVRIRGEGCSKFADVYYTSPTGKKLRSLVEVGRYLAENPHYIRQGVNLTQFSFATPKPLQEDYVRKHTYAATPELPELLETAQVDPLCWAAPPTRSELLGELGASTSRSVDVSQSEVSYPVDLHQPEESAPLPPRTKKKTMKRGRVSATGSQSTPPGSSKDQSGGCVSDVEFVSL

SEQ ID NO: 34380 - protein, 374 aa, Zea mays
MEVGDARNGSAAAALTKGGADDAARKPLPPCCVKAKARVPETEANCHDTVVSGWFTEPRSRFGEAHSLKVEKILFQGKSPYQEILVFESSTYGNVLVLDGIVQLTDKDECAYQEMVTHLPLCSIPAPKNVLVVGGGDGGVLREIARHDSVETIDICEIDLLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYGWTSVPTYPSGVIGFLLCAKEGRAVNFLTPVNPIEKIEGTTKAGRELRFYNSEIHRAAFVLPTFVRRELEAYTTPSTSAENEKPKESVSEPQKIKILSNNAILTAS

SEQ ID NO: 34381 - protein, 308 aa, Silicibacter sp. TM1040
MNTPQILCLGEPLVEFNQTPEGPFAMGFGGDVSNVAISAARHGAQTGLITRVGDDPFGAALCDLWANEGLVTDHAARAQGEETGVYFVTHDASGHHFTYRRKGSAASRLTPQDLPMNALQTCPIFYASGISLAVSSSMQDAVIEAAQQARAGGGIFAFDPNLRVALWPLEVARETTHRCMQICDVALPGLEDARQLTGLHDAKDIASFYHELGPRIVALTLGAEGVLISVEGTQRVLSGHRVDAKDATGAGDCFNGAFLATLLATNDPFSAAEHANMAAALSTTGYGAVTPIPTLSQTRSALETAQRA

SEQ ID NO: 34382 - protein, 129 aa, Silicibacter sp. TM1040
MTIERIGAERTGAGGQNLPFSPATRAGDFVFISGQVAMNERGEIEPGGIEAQTKRTMENVIAVLAQAGCTLDDVAKVNVWLDDPRDFWTFNRVYASYFPNGAPSRSTVRSQLMVDAKIEIDVTAYKPLG

SEQ ID NO: 34383 - protein, 318 aa, Brassica napus
MEEESEVVKTFAELGVREELVKACERLGWKNPSKIQVEALPYALEGKDVIGLAQTGSGKTGAFALPILQALLEYVNNAEPKKGRRPDPAFFACVLSPTRELAIQIAEQFEALGSDISLRCAVLVGGIDRMQQTIALGKRPHVIVATPGRLGDHMSDTKGFSLKTLKYLVLDEADRLLNEDFEKSLNQILEEIPRDRKTYLFSATMTKKVRKLQRACLRNPVKIEAASKYSTVDTLKQQYRFVAAKYKDCYLVYILTEMPDSTSMIFTRTCDGTRFMALMLRSLGFRAIPISGQMTQSKRLGALNKFKAGECNILVCTD

SEQ ID NO: 34384 - protein, 335 aa, Methanopyrus kandleri AV19
MAYKIAVIPGDGIGPEVIEAALHVIEPLIDAEFVEGEAGDECAEKHGDPLPEDTLELCHEADAILFGAAGETAADVIVRLRQELDLYANIRPVRGFPGLRELTGEPYVRDDVDFVIVRENTEGLYSGIEGRFRDTAYTLRIITEEGTRRIAEVACDLAEERGSNTVTCVHKANVMRETCGLFREVCKEVVESRGLEFEEYYVDAAAMFMITEPERFDVVVTPNMFGDILSDEAAALVGGLGLAPSGNVGDRHGLFEPVHGSAPDIAGKGIANPFATILSAVMMLEWLGEDEAAEAVREAVGEAIREGVVTPDLGGDKKTMEVAEFVREAALNRVQ

SEQ ID NO: 34385 - protein, 506 aa, Silicibacter sp. TM1040
MTTPKPVVLCILDGWGSAEPGPANAPYLAKTPTLDAIMQSCPTARLVTHGPDVGLPSGQMGNSEVGHTNIGAGRVVAMDLGQIDLAIEDGSFYDNDALQAFIAKLKETGGAAHLMGLVSDGGVHGHVTHILAAIKAIRDAGVPVWLHAITDGRDVAPKSALTYLDQLEAGMAPGAQIATVTGRYFAMDRDNRWERVSEAYDAMVKGAGQFTAATARDAVENAYGRDELDEFVKATVVEGFDGIKEGDGFFCLNFRADRAREILRAIGEPGFAEFDTGPRPALAALLGMVEYSEGHNAYMTTAYPKRAIVNTLGEWVAKQGKRQFRLAETEKYPHVTFFLNGGKETPEVGEDRFMPKSPKVATYDLQPEMSAPEVTAKFVEAIRAGYDLIVTNYANPDMVGHTGDLDAAIKACEAVDQGLGEVVAALKDAGGAMIVTADHGNCELMVDPETGGAHTAHTTNLVPVALVGGPEGTALKDGRLADLAPTLLALMGLDQPEEMTGESLLV

SEQ ID NO: 34386 - protein, 458 aa, Listeria monocytogenes EGD-e
MAQTSTIQNDTKAAEEYAARVFETIKQRNPGETEFHQAVEEFLNSVIPALAKEPKYEANGILEQLTEPERLISFRVPWVDDSGTVHVNRGYRVQFNSAIGPYKGGLRFHPSVTGSIVKFLGFEQIFKNSLTGLPIGGGKGGSDFDPKGKSDSEVMRFCQSFMTELQKHIGPDTDVPAGDIGVGGREIGYLFGQYKRLRGAYDAGTITGKGLSYGGSLARTEATGYGLVYFTVEMLEAAGETIRGKKIVVSGSGNVAIYAIEKAHELGAKVVACSDSAGFVYDKEGIKVETVKQLKEVERKRISEYTTIHPSAEYYAGGDVWSVPCDIALPCATQNEINADQARALVKNGVIAVAEGANMPSTLDAVDIYHENKVLFGPAKAANAGGVAVSALEMAQNSTRMSWTFQTVDEHLQNIMKDIYKNSSNAASEYGAPGNLVIGANIAGFLKVADTMISQGII

SEQ ID NO: 34387 - protein, 103 aa, Listeria monocytogenes EGD-e
MLNDLYEEIKLRKTQPREGSYTNYLFDKGLDKILKKVGEEATEVVIAAKNDNQELIAEVSDLAYHLLVLLAEKNIPLVAIQTELQKREGKLSTTRDRKEINDL

SEQ ID NO: 34388 - protein, 712 aa, Arabidopsis thaliana
MVVATTIALYASPASTVCSTAHQINAHISCDLDLNSRSSSASSSTSSPTIGGLSLLFSGASVKSSSSSSSSHPSVGEELASIRHDRSEDRTLSGSFCYSPSKFIGSSYLKRDHQSPVSVLHGPISSGNSPPMRISRDRNLDGGSALRVGSSRLFNGFVRKAIGSCVDYDTDSVLVDEQLPFTMDDGFEGERRQPYARDLLRRAQLKHKIFEDESVIKAFYEAEKAHRGQMRATGDPYLQHCVETAMLLADIGANSTVVVAGILHDTLDDSFMSYDYILRTFGSGVADLVEGLSQLSKLARENNTACKTVEADRLHTMFLAMADARAVLIKLADRLHNMMTLYALPPVKRQRFAKETLEIFAPLANRLGISSWKVKLENLCFKHLHPDQHHEMSDMLEDSFDEAMITSAIEKLEQALKKEGISYHVVSGRHKSLYSIYCKMLKKKLTMDEIHDIHGLRLIVDNEKDCYKALGVVHKLWSEVPGKLKDYISHPKFNGYQSLHTVVMGDGTIPLEVQIRTKEMHLQAEFGFAAHWRYKEGDCKHSSFVLQMVEWARWVVTWHFETMSKDGSSICSSEPLCSFPSHAEDCPFSYKPSGNQEGPVYVIVIENEKMTVQEFPENSTVSDLLRRAGPGSSRWSMYSIPAKEELRPRLNQTPVSDLKCKLKMGDVVELTPAIPDKSLTEYREEIQRMYDRGLAFSRPHRAATGTMVGWGS

SEQ ID NO: 34389 - protein, 105 aa, Listeria monocytogenes EGD-e
MISVDFSKGLVPTIILDDQNGDVLMLAYMNEESYQKTLETGYTWFFSRSRNELWNKGATSGHTQKVKQIWTDCDNDTLLIRVTQIGPACHTGKKSCFFNLIKEDF

SEQ ID NO: 34390 - protein, 286 aa, Thermosynechococcus elongatus BP-1
MPKISGQTQLLGVIGDPIEHTLSPAMHNAALEYLGLNYVYVPFWVKPQQLGVAIAGLEALNVVGFNVTIPHKETILPYLADVSDLAQQVGAVNTVYRSEKGWVGTNTDVHGFLAPLRQQSCLWSEIAVLVLGYGGAARAVVTACYDLGCRQIYISGRQRERLGAFVASWPQITLHPLLWSERATCLAKISLVVNTTPIGMSPHTGATPLTAEDLAKLPATAIVYDLIYKPRPTLLLQLAMARGLQTFDGLAMLLHQGAAALEYWLGQPAPTAIMATALETALGTEK

SEQ ID NO: 34391 - protein, 245 aa, Zea mays
FLYALIWQHLLFSVTEPSQRVKPVAASDIMWAEAMGKLECMDSADRERLWPQLVQGFKDLSHRLKLQDEVLVSDTDRLSMTHSNVKKLQRHFQADTYPWIQRLKQQELAIQRRLLRFVRIVEALENRGYRCPLTKEEADLYERLVVILKRLKGHNADLSKRVNTLVSTSRLLASSGGAGGSVYIPSSAKVDERSVTELLEALQQQTEAVAKLGNVLKRDIRDMEIIQSEGTDMAEDNVGRRAQKI

SEQ ID NO: 34392 - protein, 194 aa, Listeria monocytogenes EGD-e
MRTATKTRVTAETSIELSINLDSQVESTISTGVGFLDHMLTLFAKHSRVTLNVKADGDTYVDAHHTVEDIGITLGLCLKEALADKASINRYGSAYVPMDESLGFCALDLSGRSYLVFDAELTNPKLGDFDTELVEEFFQAVAFNTEMNLHLRVLYGKNTHHKIEALFKAFGRALREAITINPEIKGVNSTKGVL

SEQ ID NO: 34393 - protein, 243 aa, Arabidopsis thaliana
MRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 34394 - protein, 382 aa, Brassica napus
MYTEEKKKDKNYGSIFAYCVLCFVLIVEVARFAKPYYGNLQNLMETEALVVEEGFVDVMNSGKLPCPFKTSRSASARSHEKLSGLIRREDRARPPSSYCVKFQNFATMAKLVKDNGDKYESRPFSVGGYNWTLLIYPNENKPVGSGGYVSMYVRIDNSSLIANPHDVYAEITFLTYKSTIDRYHFLQETDAQRFHLFKQQYGQLNFLEIGYYKDPGHGFIFDGGQSVFGVDILVANPFEKWEVFSYEENIRDPLFNWKLTKFSTCNLDYYTSGSFSSGGRDWVLKVYPNGVGHATGNSLSLFLLSASNEKGYVKAKLRVIDQIRSNHLEKQVEGWPNATENGWGFEKFISFADLNDSTKGFLADDAIKFEVEILSFSKTDTL

SEQ ID NO: 34395 - protein, 322 aa, Xanthomonas oryzae pv. oryzae KACC10331
MTASPSKLAQLRELSVVVADTGDYDAIKRLQPVDCTTNPTLVKKALDLPVYADLLERELTWGRAHGGDDRTTTVDEVADRLTIGVGVKLSALVPGRVSTEVDADLAHDTQATIAKARKFVAMYAERGVPKDKILIKIAATWEGIEAARQLQLEGIDCNLTLIFNRAQALACAEANVFLISPFVGRILDYYVAQGQTPASIDEDPGVVFVRTVYNAFKQRGSSTVVMGASFRSTAQIEALAGCDRLTISPDLLEKLDAEHGELPRKLSPGNANNAQITPIDSDSFASGLAADPMATEKLASGIDTFAKDLHALRKTIADKLAG

SEQ ID NO: 34396 - protein, 117 aa, Vibrio vulnificus CMCP6
MSNIIKALEQEQMKQDLPKFAPGDTVVVQVKVKEGNRERLQAYEGVVIAIRNRGLHSAFTVRKISNGEGVERTFQTHSPVVDSIEVKRRGAVRRAKLYYLRERSGKSARIKEKLAKK

SEQ ID NO: 34397 - protein, 188 aa, Triticum aestivum
AYLGDTIEQVCTKKQAGTGPEFPGYRRPTRPSLSVARRGEADRYIQMEGLQRSSSTFRRSGSSGLVWDERFLTEGAEAKAAGEGGTDEAQPEMRRSRSTGGVGMMLRRGGDDKKQQQQKKKEQQGQKKDEERDPQVFRTKEVAPDVDPPSPKVSGCILCAIFGGSSSGPGAAARRGRAKPKRRQRSAV

SEQ ID NO: 34398 - protein, 654 aa, Geobacter sulfurreducens PCA
MAIRYIDEISELKDKKVFIRVDFNVPLDEHQNITEDTRIRAVLPTINFALDAGAKVVLASHLGRPKGERKPKYSMAPAAKRLSRLLGKEVLLAPDCIGSEVRQMIDAMKSGDIIMLENVRFYEGEEKNDENFARELANGCEIYVNDAFAVSHRAHASVEAITKFFPVVAAGFLMKNEMNYFEKAMQKPIRPLVAILGGAKVSGKLEVLESLLNKVDKIIIGGGMAFTFLKALGYNVGKSLVEEDLIETARSTYAKAREKGIKFYLPVDCVAADRFNPEAETKVTTIQEIPEEWMALDIGPATVALFTEALQSAKTIIWNGPMGVFEMDAFSRGTFAMVTAVANSYALTIVGGGDTDSAVHRAGEYAKISYISTGGGAFLELLEGKKLPRHQGAGRKRKIGGAAMRTPVIAGNWKLFKKRAEARELVNGLVSLVKDVQGVEIVVAPVFTVLAAVKGALDGSAIKLAGQDCFWEEEGAYTGEISPGMLVDAGCSHVIIGHSERRQYFGETDETVNRKIKAALKAGLAAIACIGESLAEREAGTTFDVLRTQLNGGLAGLSADDLKDVIIAYEPVWAIGTGKTATDAQAQEAHAFIRGVVSELLGKPAAEAVRILYGGSVKPENIKGLMTQPDIDGALVGGASLKADSFAAIASFSM

SEQ ID NO: 34399 - protein, 333 aa, Geobacter sulfurreducens PCA
MALRVAINGFGRIGRSVLRAAAKEKGIEIVAINDLTDAKTLAHLLKYDSVHGPFPGKVEVGDGAIVVNGKPITIIAERNPELLPWKKMKIDVVLEATGLFTAREKAELHLKAGAKKVIISAPATNEDITIVMGVNHDAYDPKKHNIISNASCTTNCLAPVAKVLHETFGIEKGLVTTVHSYTNDQQILDLPHKDLRRARAAAMSMIPTTTGAAKAVSLVLPELKGKLDGMAIRVPTPNVSVVDLVVTLKKKTDAEKVNAALKKAAKGSLKGILRFEEEPLVSIDFNGTTHSSIVDALSTKVIDGTMVKVLSWYDNETGFSNRVVDLMKLIASK

SEQ ID NO: 34400 - protein, 219 aa, Arabidopsis thaliana
MRPPMRGGGGFRGRGGRDGGGGGRFGGGGGRFGGGGGRFGGGGGRFGGFRDEGPPSEVVEVATFVHACEGDAVTKLSQEKIPHFNAPIYLENKTQIGKVDEIFGPINESLFSIKMMEGIVATSYSPGDKFFIDPYKLLPLARFLPQPKVVNCIKLHLTACLCSSRGQSTGGRGGAGRGRGDSRGRGRGGSFSRGRGAPRGGRFPPRGGSRGSFRGRGRF

SEQ ID NO: 34401 - protein, 338 aa, Bartonella rattimassiliensis
TASCESKITYIDGDKGILLYRGYPIDQLAEKGDFLESCYLLLYGELPTQQEKSDFDQCIMQHTMVHEQFARFFHGFRRDSHPMAVMVSCLGAMSAFYHDSIDITDPQQRMIASIRLISKVPTLAAMAYKYSIGQPFVYPRNDLSYAANFLRMCFAVPCEEYKTNPVLARAMDQIFILHADHEQNASTSTVRLAGSSGANPFACIAAGVACLWGPAHGGANEACLKMLQEIGSIKRIPEFIARAKDKNDPFRLIGFGHRVYKNYDPRAKIMQKTCHKVLKELNIQDDPLLDIAIELEKIALSDEYFIEKKLYPNVDFYSGIILKALGFPTEMFTVLFAL

SEQ ID NO: 34402 - protein, 219 aa, Aquifex aeolicus VF5
MLIAVPLDDTNFSENLKKAKEKGADIVELRVDQFSDTSLNYVKEKLEEVHSQGLKTILTIRSPEEGGREVKNREELFEELSPLSDYTDIELSSRGLLVKLYNITKEAGKKLIISYHNFELTPPNWIIREVLREGYRYGGIPKIAVKANSYEDVARLLCISRQVEGEKILISMGDYGKISRLAGYVFGSVITYCSLEKAFAPGQIPLEEMVELRKKFYRL

SEQ ID NO: 34403 - protein, 544 aa, Fusobacterium nucleatum subsp. nucleatum ATCC 25586
MTDIQIAQAAKKENIVEIAKKLGLTEDDIEQYGKYKAKVNLDVLQKNKRPNGKLILVTAITPTPAGEGKSTVTIGLTQALNKMGKLSAAAIREPSLGPVFGMKGGAAGGGYAQVVPMEDINLHFTGDMHAIGIAHNLISACIDNHINSGNALGIDVTKITWKRVVDMNDRALRNIVIGLGGKANGYPRQDSFQITVGSEIMAILCLSNSITELKEKIKNIVIGTSVTGKLIKVGDFHIEGAVAALLKDAIKPNLVQTLENTPVFIHGGPFANIAHGCNSILATKMALKLTDYVVTEAGFAADLGAEKFIDIKCRLGGLKPDCAVIVATVRALEHHGKGDLKAGLENLDKHIDNIKNKYKLPLVVAINKFITDTDEQINMIEKFCNERGAEVSLCEVWAKGGEGGIDLAEKVLKAIDNNKTEFDYFYDINLTIKEKIEKICKEIYGADGVIFAPATKKVFDVIEAEGLNKLPVCMSKTQKSISDNPALLGKPTGFKVTINDLRLAVGAGFVIAMAGDIIDMPGLPKKPSAEVIDIDENGVISGLF

SEQ ID NO: 34404 - protein, 334 aa, Bartonella rattimassiliensis
TASCESKITYIDGDKGILLYRGYPIDQLAEKGDFLESCYLLLYGELPTQQEKSDFDQCIMQHTMVHEQFARFFHGFRRDSHPMAVMVSCLGAMSAFYHDSIDITDPQQRMIASIRLISKVPTLAAMAYKYSIGQPFVYPRNDLSYAANFLRMCFAVPCEEYKTNPVLARAMDQIFILHADHEQNASTSTVRLAGSSGANPFACIAAGVACLWGPAHGGANEACLKMLQEIGSIKRIPEFIARAKDKNDPFRLIGFGHRVYKNYDPRAKIMQKTCHKVLKELNIQDDPLLDIAIELEKIALSDKYFIEKKLYPNVDFYSGIILKALGFPTEMFTV

SEQ ID NO: 34405 - protein, 376 aa, Aquifex aeolicus VF5
MTYLMNNYARLPVKFVRGKGVYLYDEEGKEYLDFVSGIGVNSLGHAYPKLTEALKEQVEKLLHVSNLYENPWQEELAHKLVKHFWTEGKVFFANSGTESVEAAIKLARKYWRDKGKNKWKFISFENSFHGRTYGSLSATGQPKFHKGFEPLVPGFSYAKLNDIDSVYKLLDEETAGIIIEVIQGEGGVNEASEDFLSKLQEICKEKDVLLIIDEVQTGIGRTGEFYAYQHFNLKPDVIALAKGLGGGVPIGAILAREEVAQSFTPGSHGSTFGGNPLACRAGTVVVDEVEKLLPHVREVGNYFKEKLKELGKGKVKGRGLMLGLELERECKDYVLKALEKGLLINCTAGKVLRFLPPLIIQKEHIDRAISVLREIL

SEQ ID NO: 34406 - protein, 493 aa, Arabidopsis thaliana
MADQISGEKPAGVNRFALQCAIVASIVSIIFGYDTGVMSGAMVFIEEDLKTNDVQIEVLTGILNLCALVGSLLAGRTSDIIGRRYTIVLASILFMLGSILMGWGPNYPVLLSGRCTAGLGVGFALMVAPVYSAEIATASHRGLLASLPHLCISIGILLGYIVNYFFSKLPMHIGWRLMLGIAAVPSLVLAFGILKMPESPRWLIMQGRLKEGKEILELVSNSPEEAELRFQDIKAAAGIDPKCVDDVVKMEGKKTHGEGVWKELILRPTPAVRRVLLTALGIHFFQHASGIEAVLLYGPRIFKKAGITTKDKLFLVTIGVGIMKTTFIFTATLLLDKVGRRKLLLTSVGGMVIALTMLGFGLTMAQNAGGKLAWALVLSIVAAYSFVAFFSIGLGPITWVYSSEVFPLKLRAQGASLGVAVNRVMNATVSMSFLSLTSAITTGGAFFMFAGVAAVAWNFFFFLLPETKGKSLEEIEALFQRDGDKVRGENGAA

SEQ ID NO: 34407 - protein, 83 aa, Glycine max
  misc_feature (20)..(20): Xaa can be any naturally occurring amino acid
FVDNVIAGVMDHLNMQIHPXVRIDLFHIILLHALIIDERYVNCTLHVARCHGQKAALPFIESVEISYLDMEDNKASNLDHHPL

SEQ ID NO: 34408 - protein, 294 aa, Thermosynechococcus elongatus BP-1
MLGQLHPDLIQEWLEAAATEIPRGEPLQRLPKVGSEAFAFAVVTPEQEFTLGRSRLRFPLMSAIKPFLLLYALTLWQEQVWTWVGQRPSDYPYNSVLQLTLDQGWPRNPMINSGAIALAGQLAYVGGATAFQTWLNECAGTQFEVDQEVLGAVHRHPNWQNRTLAHFLVESGRIADAEVALEIYNQVCCFQGTVEEVARLGLLLALPQAKVSDRHRQQVNVLMLTCGLYEDSPRYGLEIGLPMKSGVSGVMLAIVPRQGAIACYSPPLDKSGNSILGLYLLQRISRHLGLSPLG

SEQ ID NO: 34409 - protein, 464 aa, Listeria monocytogenes EGD-e
MTYKFPENFWWGSAASGPQTEGAADVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPTDLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGANCHGYHLWTFMDCWSWANAYKNRYGLVEVDLDNDFKRTVKASGHWYKELAENNGFED

SEQ ID NO: 34410 - protein, 425 aa, Nocardioides sp. JS614
MSARTLSDKVEVAQPHADVLIVGGGEAGLGVADELRALGFAGTITMAGEEPRLPYQRPPLSKGYLSGDSDDESLELRAPEYLREQGIDVWLGRRVASVDLTDQGGSAVFDDSTSVAFDRLVLATGAVARELPVPGAELAGVHSLRSVADAALIRDALRAGGPLVVIGGGFIGLEIAATARARGLSVTVVEAAGRLLERVCAEPLSDFCLRTHRAAGIDIRLDAAVVELVGTDVGAVSGVRLADGTLLPAEVVIVGVGAVPATGIAEKAGLECRRGIVVDPAGRTTHPRVVAAGDCTEQPHPHLEGELLAIESVNNAVEQSKAAAHTLLGLDPPARGVPWFWSDQGGMKIQIAGVSHGHDGYVVREEAERITVLYFRGGTLIAADVANNPRDFMAVKRAVAERRTVDRERAGDLTRSVKDLLREGA

SEQ ID NO: 34411 - protein, 556 aa, Mycobacterium sp. JLS
MTSEPDASEPSHTEQPYLARRQNWTNQLARHALMQPGDTALRFMGRTTTWGELDDRVTKLAGALSRRGVGFGDRVLILMLNRTEFIESFLAVNKLGAIAVPVNFRMTPPEIAFLVSDCAARVVVTEAVLAPVATAVRDLDPTLETVIVAGGATDDGILGYDDLIAEPGEAPAPVDIPNDAPALIMYTSGTTGRPKGAVLTHVNIAGQAMTFLFTNGVDLNHDVGFIGVPLFHIAGIGNTIVGLLLGRPTVLYPLGAFDPGALLDVLAEEKVTGIFLVPAQWQAVCAAQRAKPRDLKLRVLSWGAAPASDTLLRDMAETFPGAQILAAFGQTEMSPVTCMLLGEDALRKLGSVGKVIPTVAARIVDEDMNDVPIGQVGEIVYRAPTLMAGYWNNPKATAEAFEGGWFHSGDLVRQDEEGYIWVVDRKKDMIISGGENIYCAEVENVLAAHPAIAEVAVIGRAHEKWGEVPVAVAAVRGAEDAAKPPALSLADLDEFLTERLARYKHPKALEIVDALPRNPAGKVLKTELRQRYAGPKPIDAGESSTAPTGSAAGPGS

SEQ ID NO: 34412 - protein, 194 aa, Lactobacillus johnsonii NCC 533
MTKVAVVFADGCEEVEGLSVVDVLRRLDIDCDMVGLDKKEINGDHHILLTCDKVVDDSLLEYDLVAFPGGRTGALNLRNNEKLAKLMIQRNKEGKWDAAMCAAPIALGHYGLLEGANYTCYPGFEKEIEKECPNGHFSTDITVVDKEHKIITSRGPATAWAYAYTIAQTLGYDTKELEKAMLYDYLAKNINQSL

SEQ ID NO: 34413 - protein, 886 aa, Vibrio vulnificus CMCP6
MSDMKHDVDALETQEWLQALESVVREEGVERAQYLLEQVLDKARLDGVDMPTGITTNYINTIPANQEPAYPGDTTLERRIRSIIRWNAIMIVLRASKKDLELGGHMASFQSSAAFYETCFNHFFRAPNEKDGGDLVYYQGHISPGIYARAFVEGRLTAEQLDNFRQEVDGKGIPSYPHPKLMPEFWQFPTVSMGLGPISAIYQARFLKYLEGRGMKDTSEQRVYAFLGDGEMDEPESRGAISFAAREKLDNLCFLINCNLQRLDGPVMGNGKIIQELEGLFKGAGWNVVKVIWGNNWDSLLAKDTTGKLLQLMNETIDGDYQTFKSKDGAYVREHFFGKYPETAALVADMTDDEIFALKRGGHESSKLYAAFKNAQDTKGRPTVILAKTVKGYGMGEAAEGKNIAHQVKKMDMTHVLHLRDRLGLQDILTDEAVKELPYLTLEEGSKEYEYLHARRKALKGYTPQRLPNFTQELVIPAVEEFQPLLEEQKRDISTTMAFVRTLNVLLKDKNIGKNIVPIIADEARTFGMEGLFRQIGIYNPHGQNYTPQDRDIVSYYKEATSGQVLQEGINELGAMSSWVAAATSYSTNDLPMIPFYIYYSMFGFQRVGDMAWMAGDQQARGFLLGATAGRTTLNGEGLQHEDGHSHIMAGTVPNCISYDPTFAYEVAVILQDGIRRMYGDQENVFYYLTLMNENYAMPAMPEGAEEGIRKGIYKLETYTGSKGKVQLLSSGTIMNEVRKAAQILSDEYGIASDVYSVTSFNEVTRDGQACERYNMLHPEAEAQVPYIQTVMGTEPAIAATDYMKNYAEQVRAFIPAESYKVLGTDGFGRSDSRENLRRHFEVNAGYVVVAALTELAKRGDVEKSVIAEAIKKFDIDTEKTNPLYA

SEQ ID NO: 34414 - protein, 236 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 34415 - protein, 487 aa, Vibrio vulnificus CMCP6
MSKEIKAQVVVLGAGPAGYSAAFRCADLGLDTVLIERYNTLGGVCLNVGCIPSKALLHVAKVIEEAKALAEHGIVFGEPQTDIDKIRLWKEKVINQLTGGLGGMAKMRKVNVVNGFGKFTGPNTIEVEGEDGKTVVNFDNAIVAAGSRPIKLPFIPHEDPRIWDSTDALELKEVPGKLLIMGGGIIGLEMGTVYHSLGSQIDVVEMFDQVIPAADKDIVKVYTKRISKKFNLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITYLPNAKAKKKKIIFLASRQNKNR

SEQ ID NO: 34416 - protein, 235 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 34417 - protein, 340 aa, Corynebacterium glutamicum ATCC 13032
MKLAVIGGDGIGPEVTAEALKVLNAVRDDIETTDYDLGARRYLKNGELLTDEDLASLREHDAILLGAIGAPGSVPPGILERGLLLKMRFALDHHVNLRPSKLYDGVESPLRNPGKIDFVVVREGTEGAYTGNGGAIRVGTPHEIANETSVNTRYGAERVIRYAFELAQSRRKKLTLVHKTNVLVHGGGLWQRTVDEVAKEYPEVAVDYNHIDAATIYLVTDPSRFDVIVTDNLFGDILTDEAGAVSGGIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 34418 - protein, 590 aa, Burkholderia mallei ATCC 23344
MSFTLHGIPVSRGIAIGRAYLIAPAALDVAHYLIEAERIEAEIERFRTALGAVRRELDVLRADLTDDTPTEVAAFIDVHAMILGDAMLVQETIDLIRTRRYNVEWALTEQLDVLAGHFDDIEDEYLRERKADIEQVVERVLKALAGAPSAAQALDRAAGNGRDEMIVVAHDIAPADMMQFKTQSFQAFVTDLGGRTSHTAIVARSLGIPAAVGVQHASALIRQDDLIIVDGDQGIVIVDPAPIVLEEYSYRQSEKALEQRKLQRLKFSPAQTLCGTKIDLLANIELPDDAKAAVDAGAVGVGLFRTEFLFMSKVRMPEEEEQFAAYKRAVELMHGMPVTIRTIDVGADKPLDVYDEGYETAPNPALGLRAIRWSLSEPQMFLTQLRAILRASAFGQVKILVPMLAHAQEIDQTLDLINEAKRQLDAAGLAYDPNVRVGAMIEIPAAAIALPLFLKRVDFLSIGTNDLIQYTLAIDRADNAVAHLYDPLHPAVLHLIAFTLREAKRAGVPVSVCGEMAGDPALTRLLLGMGLTEFSMHPSQLLVVKQEILRAHLKALEKPTADVLASFEPEEVQAALARLASAEPRADVAA

SEQ ID NO: 34419 - protein, 643 aa, Desulfovibrio gigas
MCGIAGFVLLQDAPPVTDHQARDVLAAMAGRIAHRGPDGRGHHVGLPAAFAHCRLAIIDLSTGAQPMAAEDGAAVVTFNGEIYNYQEVRRELQALGRTFQTRSDTEVLLQAYLEWGVACLDRLEGMFAFALWDVRRRTLFAARDRFGKKPFFYTIQQGVFAFASELSALEAVPWAAFSIRASTLARFLAYEYVPTPESIYAEARKLPPAQYLELHEDGTLLVERYWETPMPRPEGSKGFGRADEPALCEELRRLLTQAVRRRLIADVPVGVFLSGGVDSSSVAAMAGQLAPGIKTFSIGFTEASYDESAYAGRVAAQLGTDHQLELLSADACADLLPEVVSRFDEPMADPSIVPTYLLSQITRRQVTVALGGDGPDELLAGYEYYPGFKATQYWERLPAWLRRAAVAASGLLPGSAGYVNPRHVAQTFLAAAEAPAWLRTQRMLTALTPEAQRALWKSPGDMLEPTRLFASTKRLWEALPDWPPMARVFHLFAQQITYGYILVKVDRCTMLHGLEARAPFLDRDLAEFCFRLPVSMKLRGATRKYLLKEAMAGLLPQDILHRPKRGFLIPTAAWLRGRLRPLVDDLLHERRLREQGLFHPAAVRRLVEEHASGKKDHRKGLWTMLVLQLWLAGKPAVRIDPER

SEQ ID NO: 34420 - protein, 203 aa, Methanopyrus kandleri AV19
MIQSPDGTYVVRLALPPGFVKAEILRTVAELAERYASGEVHITVRQGLEIPEVPPSKLDDLLRKLRELGLEPGSTGPRVRQVTCCPGTRTCANALTDPVPLARKLHEEFLDVWVPAKVKIAVSGCPRGCTRPSENDLGLVAVGGDEWELLVGGYRVARLPEQDVIDAVELTLEWYASEAPPGTRLHRFVTDRVSELRDVLERL

SEQ ID NO: 34421 - protein, 194 aa, Oryza sativa (indica cultivar-group)
MNIFKKKVDPKEALRTSKREMSVATRGVEREIGSLQMEEKKLVAEIKKTAKTGNEAMYAGTSISAGMKGASKAMAAMNKQMEPTKQIKVMREFQKQSNQLDMTLEMMSDAIDETLDKDEAEEETEELTNQVLDEIGVDVASQLSSAPKGRIAASNRKAESNQARNAAPPRNNVEPESSAEVDDLERRLASLRRI

SEQ ID NO: 34422 - protein, 378 aa, Aspergillus nidulans FGSC A4
MAIDGAYPPATLPAGDTKTESESAAITAAAHPLSALPTPVLLRSLLIATISSKPSLLIPSLSALSFLCKPRAGPLLNVDRNPILHFILKATFYRQFCAGETPDEVRSTIRQLAGMGFQGTIMTYAKESVFDAKTKMQTGLGVSTKMSGKQEVTEPTLARGEAFCPQIEAWRKETVETIELLGANDYLALKLAYLKSTPATIARHLQAASDVGFTLGLKLVRGAYIFSDERSLIHETKADTDAAYNGIAQGVLCRQLGAFGTEKPFPSVELFLASHNKESVMKAHALRLQRLKEGLPTVPVGFGQLHGISDEVSFRLLTLKNERNEPMVYKCSTWGRLSECLAYLVRRAVENRDAVGRTEDEYRALKREMARRSWYSLL

SEQ ID NO: 34423 - protein, 451 aa, Vibrio angustum S14
MAKHFDYICIGGGSGGIASANRAAMYGAKVAIIEAKALGGTCVNVGCVPKKVMWHGAQIAEAMHLYAKDYGFDVDVKGFDWSKLVESREAYISRIHTSYDNVLGNNKVEVINGFAKFVDAKTIEVNGEHYTADHILIAVGGEPTIPAIPGAEHGIDSNGFFELNEQPKRTAIIGAGYIAVEIAGVLSALGTDTHLFVRKESPLRSFDPLIVETLVEVMATEGPTLHTHSVPKEVVKEADGSITLHFENGESHNTDVLIWAIGRHPTTDKINLEATGVATNDRGYIKVDEYQETNVKGIYCVGDIMEGGIELTPIAVKAGRQLSERLFNNKPDAKMDYSLVPTVVFSHPPIGTIGLTEPEAIAQYGEENVKVYKSGFTSMYTAVTSHRQPCKMKLVCAGDDEKVVGLHGIGFTVDEMIQGFGVAMKMGATKADFDSVVAIHPTGSEEFVTMR

SEQ ID NO: 34424 - protein, 229 aa, Lactobacillus johnsonii NCC 533
MKRKLAKLVLVRHGESVANRDNVYTGWNDVPLSKKGIAQAKNAGLKVEKIAEFAPTHIHTSVLSRAIMTANIIADVCSFLYLPITKTWRLNERHYGALRGINKDVSKKIFGTNQVLEWRRGFDSVPPLLTQPVQDRRYQKYDMRLMPQGESLHQTQERLMPYFWDHIAPELMAGHDQLVVAHGSSLRALIKKIEDISNEDIVKVEVPNAEPIVYTFDTDLHIVKKEILH

SEQ ID NO: 34425 - protein, 242 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRSSSRKLRSDQVAAPAHRSQPTTGLTMVLHASSIELSHYFQFLLKFVLLAYAVLCLTELLHRWSNGSVLSLWSA

SEQ ID NO: 34426 - protein, 539 aa, Arabidopsis thaliana
  misc_feature (93)..(93): Xaa can be any naturally occurring amino acid
  misc_feature (108)..(108): Xaa can be any naturally occurring amino acid
MASRIINHSKKLKHVSALLRRDHAVAVRCFSNSTHPSLVGREDIFKARLNYSSVERISKCGTGNVTMLSGISTTSTKLSSPMAGPKLFKEFIXLPDAISERIFIQFRXPPHQEIGMPSLSPTMTEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 34427 - protein, 402 aa, Pisum sativum
MESRVLSRATTLSSLPTLNKLHRLPLANASLPSVKSFGSVSDGGNLVWGRQLRPELCSPVLKKGASLLRPCPATAGGNDSAGEEKVAPVGFFSRYPALTTGFFFFTWYFLNVIFNILNKKIYNYFPYPYFVSVIHLAVGVVYCLVSWTVGLPKRAPIDGNLLKLLIPVAVCHALGHVTSNVSFAAVAVSFTHTVKALEPFFNAAASQFILGQSIPITLWLSLAPVVIGVSMASLTELSFNWLGFISAMISNISFTYRSIYSKKAMTDMDSTNIYAYISIIALIVCIPPALIIEGPTLLKTGFNDAIAKVGLVKFVSDLFWVGMFYHLYNQVATNTLERVAPLTHAVGNVLKRVFVIGFSIIIFGNKISTQTGIGTGIAIAGVALYSFIKAQIEEEKRQAKAA

SEQ ID NO: 34428 - protein, 404 aa, Spinacia oleracea
MESRVLSRTTAIAALPKLFRPSREAASFGFATGVKTPVGLVKDGGSLTWGRQLRPVLLLEPVQTGPVCSRREKTAVQPCRAASGSSGEAKTGFLEKYPALVTGSFFFMWYFLNVIFNILNKKIYNYFPYPYFVSVIHLFVGVVYCLASWSVGLPKRAPMDSKLLKLLIPVAVCHAIGHVTSNVSFAAVAVSFTHTIKALEPFFNAAASQFVLGQSIPITLWLSLAPVVIGVSMASLTELSFNWLGFISAMISNVSFTYRSLYSKKAMTDMDSTNIYAYISIIALFVCLPPAIIVEGPQLMKHGFNDAIAKVGLTKFISDLFWVGMFYHLYNQLATNTLERVAPLTHAVGNVLKRVFVIGFSIIAFGNKISTQTAIGTSIAIAGVALYSLIKAKMEEEKRQMKST

SEQ ID NO: 34429 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFPQHSNGMLAGWKFSNFKDGVFGEYFHVNDADMNLAILPKDMPLENAVMITDMMTTGFHGAELADIQMGSSVVVIGIGAVGLMGIAGAKLRGAGRIIGVGSRPICVEAAKFYGATDILNYKNGHIVDQVMKLTNGKGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 34430 - protein, 1049 aa, Bacillus megaterium [sequence omitted]

SEQ ID NO: 34431 - protein, 404 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 34432 - protein, 192 aa, Aquifex aeolicus VF5
MREAEVFRETRETKIKLYINLDGSGNYEVNTPVGFLTHMLESFAKHGRFDLKVEAEGDVHVSHHHTVEDCGIVLGQAVLKALGDKKGIRRYGYSIIPMDEALVLSSIDISGRPLFFYEDKDLRGKITEFDFELIWEFFKGFALESRSTLHIKVLDGKILHHVAEACFKSFAITLKEAVKVEGSGVPSTKGVI

SEQ ID NO: 34433 - protein, 305 aa, Bifidobacterium longum NCC2705
MVKNIAYATEEETLMGNGVNLRTLTNDGGSAVISDYGAHLLRWAPAGQPDVIWTPRTWHFEAGQPVGGGVPVCFPWFGPGFVHGGQTAKRPIHGFARLRQWALDEGAFTSARVRYVLDSERLTTGEVPWIEDEPNVRFHAAYEVCASDTLTMTLTVTNTGGEPMSYEAALHSYLHVGDVLGARLVGLRGATYLDATEAGFPPKLQEQPSVMFGDQPVDRVYYSDAALELQDHVLGRVIRIGKTGSPQTVVWNPGEQGGNAIAHAKTGEWRGFVAVEAAACRDRIVALSPGESYMLSQSIAVMPLG

SEQ ID NO: 34434 - protein, 660 aa, Bacillus thuringiensis serovar konkukian str. 97-27
MTEENKSFYITTPIYYPSGKLHIGHAYTTVAGDAMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKANVTEFDETLVTFAKDTLKKVEEAMENMEFSVALSSIWQLVSRTNKYIDETQPWVLAKDEDDREKLASVMAHLAEVLRQTGIMLMPFLTVAPSKMFAQLGLTDEAHTSWGSLSTIGCIPAGTKVEKGQPIFPRLEMDVEVAYIKEQMKASAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNLPNGTKIK

SEQ ID NO: 34435 - protein, 499 aa, Methanopyrus kandleri AV19
MFITSKEMRRIELNSRWLGFEEDFMMENAGAGVARVVIGEYSPNDVLVVCGTGGNGGDGFVTARHLDSEGVDVDVLLVGRREAIKNEAAELNLRRLDRAGIPVQEVRDSEDLESVDFERDVVVDALLGFGIRGRLREPVRSAVLRINEASRAGTRVVSIDIPTGLDPDSGETPDVAVEADLVVSIHRHKRGVRKLRDVFLRRVNAGIPEIAERICGPGDLITSDIWRRDPWSHKGQHGRVLIIGGSRKYVGAPQLAARGALRAGVDLVFLLTVDAVPKNDPNVIYRAVPAERLEPEHLDEVDLEGVDTVVVGPGLGADADSVGILRELAESFDGMIIVDADGLRGISGVNVDDRFVLTPHAGEFRREFGEELGRSLEDRSEAVRRVSEELGCTILLKGRVDVIGSPDGEIRWNVTGTPAMTVGGTGDVLAGVVAGVAARCREGFEAACIGAFVVGSAGCLAERRLSQGLTAEDVAEYVPKVLRNPWAAEPEAVTEVRRD

SEQ ID NO: 34436 - protein, 113 aa, Corynebacterium diphtheriae NCTC 13129
MNLLDKVDAASLRDDIPAFRPGDTLNVHVKVIEGSKSRIQVFKGVVIRRQGAGVRETFTIRKVSFGIGVERTFPVHTPNIDKIEVVTRGDVRRAKLYYLRDLRGKAAKIKEKR

SEQ ID NO: 34437 - protein, 493 aa, Nocardioides sp. JS614
MTTTTDASDLAVYDLFVDGRWQPSRTGRTSERTSPGDGRLVGRYARGDGADVDLAVAAARRAFDEGPWPTIDATKRAAIMRRAADLLRERADTIGRRIALELGKPISMARNEVVLTAEVFDYYAALALDQRGELISQHTASALGMIVKEPVGVVGMITPWNFPLLLLSWKVAPALAAGCTMVAKPASLTPGSTLDLASVLADAGVPDGVYNVVTGGGAEVGDALAQHPGIDKIAFTGSTEVGQTVMRAAVGTVKKVSMELGGKSPNIVFADADLKQAVRGAYWGIFLNSGQACQAGSRLLVQREVHEEFVSSLVEMARSSKVGDPLDEGTQIGPMVDQAQLDTVLDYIGKGREAGAALVAGGNRLGGELADGLYVEPTIFDNAAPDHAISREEIFGPVLAVTPFDTLDEAVRLANDSPYGLASAVWSTNIDTAIKTSKRLRAGTVWINAYHDAGLPFCMPMGGYKSSGIGRELGREGLAQYFETKAIHLRLGR

SEQ ID NO: 34438 - protein, 344 aa, Cryptococcus neoformans var. neoformans JEC21
MTSPQKNVQIILNERPQKGPVTDTTFKSKTVDVPELKDGEILARVDYASVDPTMRGWINEGRSYMPPVEIGAAMRANGLGTVIASKAKDFKAGDKVLGLLNWQEYYVGPTEGLTKRETPEGARDVDHLGLFGMTGLTAYFGMIEVGKVKDGDHVVISGAAGAVGLVATQIALAHPNCKVTVIAGSKEKLDYLKKLGAHNALNYKDDDFKEQFKKVGLIDVYFDNVGGKILDMALAQLNPFARIVACGAISQYNATVPDPIYNYFNIISMKATMRGFIVFQFADRFPEGIKYLSDLVKKGKMEFNYHIIDGLDSCVQALREMFEGKNLGKTVVRVSNEAAKGSKL

SEQ ID NO: 34439 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKALPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 34440 - protein, 250 aa, Acidovorax sp. JS42
MTQKKKLIAGNWKMNGSLQANAALLQALRDGLGAPGCGVAVAVPAPYLAQVQALVAGSEIALAAQDVSQHERGAFTGEVSVGMLRDFDARYALVGHSERRQYHGETDAVVAAKAQRALSGGVTPIVCVGETLAEREAGQTETVVKRQLAAVIHAVGHCVSEIVVAYEPVWAIGTGRTATPEQAQQVHAVLRAQLAAATESADRVLILYGGSLNAANAAELLAQPDIDGGLVGGASLKAADFLKIIAAAHS

SEQ ID NO: 34441 - protein, 313 aa, Geobacter sulfurreducens PCA
MPFSEPGKTKFQVDLRRHLRNQDISDNLVHLICEIAEASKYVINAVRTGDLGVAGTSNLYGEEQLALDVLSDRIIRKRLIHSGVVCNIASEEMDEIFQAQADADGLYSVAYDPLDGSSLVDVNLAVGTIVSIYEGCNLLQKGRNQVAAMYILYGPRVSLVYSVGKGVHEFTMNHLMEYTLSRENVTMKPDGDIYSPGGLRKKYLPETEKFVQHLESKGSKLRYSGGFVPDINQVLMKGKGIFMYPALNGSPNGKLRVLFELNPMAYLIENAGGAATDGKTPILDIEPQSLDQRAPIFIGCSNDVATAMEFMGG

SEQ ID NO: 34442 - protein, 175 aa, Oryza sativa (japonica cultivar-group)
MAAEAETKAMITLRSCEGQVFEVAEAVAMESQTIRHMIEDKCADTGIPLPNVSAKILSKVIEYCSKHVEARGGAAAAADGDAPAPAAVEANKAVEDELKTFDAEFVKVDQSTLFDLILAANYLNIKGLLDLTCQTVADMIKGKTPEEIRKTFNIKNDFTPEEEEEVRRENQWAFE

SEQ ID NO: 34443 - protein, 600 aa, Mycoplasma mycoides subsp. mycoides SC str. PG1
MDKSKIRNFSIIAHIDHGKSTLADRILELTNTVEKREMQDQLLDSMDIERERGITIKLNSVQLKYHSKDNQDYIFNLIDTPGHVDFTYEVSRSLAACEGAILVVDASQGVEAQTLANVYLAIDSNLEIIPVINKIDLPSADVDKVKHEIEEIIGLDCSKSPLISAKTGLNVEDVLQAIVEKIPSPSDAIDNAPLKALIFDSYYDKYLGVVMSIRLKQGMLKVGDKIKLMSTNAEYEVTSLGIKTPKIVKKDFLEAGEVGWVAASIKTIKDVNVGDTITSVLNPADEPLDGYKKLKPMVYCGIYPIDTNKYQDFKEALEKIELSDSSLVYEPETSQALGFGFRCGFLGLLHMEVIQERLEREYNLELIATAPSVVYKVHLTNKQVIELDNPALLPEAQKISKIEEPFVEIKIATPSEYIGDLMNLCQNKLGIYKNMEVIDNNRRILIYQMPLAEIIFDFFNKLKSISKGYASFEYELIGYKESKLVRMDIKLNGEMVDAFSMIVNQKFAYQRGSALTLKLKELIPRQNFEVPVQATIGNKVISRETIKAYRKDVTWKLHAADKSRRKKLLEKQKEGKKKMKEIGTVEVPQEAFVAILKIDD

SEQ ID NO: 34444 - protein, 360 aa, Methylococcus capsulatus str. Bath
MTIKIAVLPGDGIGPEIVAEALKVLDCLRSDFGLAVETEHALIGGAAYDAHGTPFPKETLELCRAADSILLGAVGGPKWEPLDYSLRPERGLLGLRSELELFSNLRPAVLYPQLVSASTLKPEVVAGLDIMIVRELTGGIYFGKPRGRRINEDGEREGYNTLVYSESEIRRIAHSAFQIARKRNRRLCSIDKANVLECTELWREVVIEVGKDYPDVALSHMYVDNAAMQLVRNPKQFDVMLTDNMFGDILSDCAAMLTGSIGMLPSASLAESGKGMYEPIHGSAPDIAGRGIANPIATILSLAMMLRYSFDDAVSAERIGKAVQTALDQGFRTADIASEGTVEVGTAAMGDAIVAALRAV

SEQ ID NO: 34445 - protein, 514 aa, Pseudoalteromonas tunicata D2
MTLKKKPLVLIILDGWGYREDPESNAILAANTPVMDKLWQTCPSTLISGSGLDVGLPPGQMGNSEVGHVNLGAGRIVYQDFTRITKSIADGDFFENPTFVNAIDQAVKNNKAVHLMGLLSPGGVHSHVDHILATIELAAKRGAKAVYLHAFLDGRDTAPRSAQESIDLVDKKFNELQCGRIASLIGRYYAMDRDNRWDRVEKAYNLMTQASAEYHFNDATSALKAAYNRNENDEFVAATSITPAKQDTAQINDGDAVLFLNFRADRARQMSRVFVDKNFDGFVKQKAPELAAFVTMTEYAKDIPAPSAFPSVALTNVLGEWLAKHNKTQLRISETEKYAHVTFFFSGGREALFEGEDRILIPSPQVATYDLQPEMNSEMLTDKLVEAIHAGQHDVIICNYPNGDMVGHSGVFSAAVKACEAVDHCIGRVIEALTQTGGEALITADHGNAEQMQNEETGQAHTAHTSEPVPFIYFGRQAQAYSDKKLSDVAPTMLHLLGMAQPEEMTGTTIMQVQ

SEQ ID NO: 34446 - protein, 404 aa, Zea mays
MSALGTLSGGAAGVSGLIRLRRRVAPALAAPSHHAAGTLNCAALPDAAPLVWGRQLRPSLLLPATLLPSSSQGARRHTPRRPAAAAGEAKSVGFLEKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDMDSTNVYAYISIIALIVCIPPAVIFEGPRLMQHGFSDAIAKVGLTKFVSDLFLVGLFYHLYNQIATNTLERVAPLTHAVGNVLKRVFVIGFSIVVFGNKISTQTGIGTSIAIAGVAMYSYIKAKIEEEKRKKSA

SEQ ID NO: 34447 - protein, 474 aa, Bacillus thuringiensis serovar konkukian str. 97-27
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERMDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 34448 - protein, 587 aa, Corynebacterium glutamicum ATCC 13032
MTPTQNEIHPKHSYSPIRKDGLEVPETEIRLDDSPSGPNEPFRIYRTRGPETNPKQGLPRLRESWITARGDVATYQGRERLLIDDGRSAMRRGQASAEWKGQKPAPLKALPGKRVTQMAYARAGVITREMEFVALREHVDAEFVRSEVARGRAIIPNNVNHPESEPMIIGRKFLTKINANIGNSAVTSSIEEEVSKLQWATRWGADTVMDLSTGDDIHTTREWIIRNSPVPIGTVPIYQALEKVNGVAADLNWEVFRDTIIEQCEQGVDYMTIHAGVLLAYIPLTTRRVTGIVSRGGSIMAGWCLAHHRESFLYEHFDELCEIFAQYDVAFSLGDGLRPGSLADANDAAQFAELKTIGELTQRAWEYDVQVMVEGPGHVPLNMIQENNELEQKWAADAPFYTLGPLVTDIAPGYDHITSAIGAAHIAMGGTAMLCYVTPKEHLGLPNRDDVKTGVITYKLAAHAADVAKGHPGARAWDDAMSKARFEFRWNDQFALSLDPDTAIAYHDETLPAEPAKTAHFCSMCGPKFCSMRISQDIRDMFGDQIAELGMPGVGDSSSAVASSGAREGMAEKSREFIAGGAEVYRR

SEQ ID NO: 34449 - protein, 71 aa, Glycine max
  misc_feature (50)..(50): Xaa can be any naturally occurring amino acid
LCGAAVTTVNRAGACMVSPFTGGKSMAGFPTMNTNTDITFIVSNWGRVAXMQAWPPVGQKMFETLAYLPDL

SEQ ID NO: 34450 - protein, 590 aa, Methanopyrus kandleri AV19
MPVVTIHYDKLVKILGREVSFEELAHNLIPMLGSDVERIDEREMVIETEFFPNRPDLYSVEGVARALKGFLGIETGIPEYNVRRSDVEARVEESVLDARPCLAVAVVRGVEFEDERDLEHLMEFQEHLHWVIGRDRKKAAIGIHDFEAVEPPLRYFLADPNDRSWAFEPLDHPGEEMTPAEVLRRHEKGRQYAHLVSDGAPILADEEGVISFPPVINSERTRVTQDTTDLLIDVTGTDWRSVLDALHVIVCNLAERGAEILTVEILGAYERTTPTMELDVWDVPVSEARKLLGIDLSGEQLEELLERARHGAIFVPEGERELREYPLPDVYHIEADWREIPPILYEEDVVRVFVGPRRTNILHEWDLIEDAGIMYNYDRFEPTVPDFYTPSRADREREFINVVRDTLARMKFVEVNSLTLISPEENYRKMRLEPDGRAVKLANPIQKEYTIVRTWILPSLMRFLADNKHRPYPQRVFELGEVIERDEDAETGAKDRWKLALAIAGPGVGFSEIKSVVEALLRELDVTGWEITERKHRSFINGRCAAVLADGRELGFFGEIHPEVLTEFDLEVPVVGGEFDVAALRTAAGW

SEQ ID NO: 34451 - protein, 468 aa, Glycine max
  misc_feature (103)..(103): Xaa can be any naturally occurring amino acid
  misc_feature (113)..(113): Xaa can be any naturally occurring amino acid
MGKKGGSWFSSVKKVFKSSSSKDSPLPEKKKENNKEEQWQQHVAPEEVSVEHFPAESSPDVINEGSATSSTPVTEDRNPAVAFAAATAAAAEAAVAAAQAAAXVVRLAGYGRXQSKEERAAILIQSYYRGYLARRALRALKGLVRLQALVRGHNVRKQAQMTMRCMHALVRVQTRVRARRLELTEEKLQRRVYEEKVQREVDEPKQFLSPIKMLDMDGWDSRRQTSQQIKDNDLRKHEAVMKRERALAYAFNCQQQLKQHMHIDPNGDDIGSYSTERERAQLDWNWLERWMSSQSPNLRPRETLYRTLATATSTTDDMSEEKTVDMDMGATLDSTHANMGFINGESFDTSPISNRYHQRHHSAGVPSYMAPTQSAKAKVRSQGPQGPFKQRGSPGPHWNSSTRRSSAIGLGCDSSSSGGPTSAHVSPRSPNPKINEIRLQSRRISGGSPDNVHIEDWALPLGATNGWP

SEQ ID NO: 34452 - protein, 490 aa, Leptospira interrogans serovar Copenhageni str. Fiocruz L1-130
MRKFDKTLFHEFRRIYKFMPESYDLTVIGAGPGGYVAAIRAAQLGMNVCIIEKDKPGGICLNWGCIPTKALLESAHLLEKLHSAKEYGINLSDPKPDFAAIIRRSRNVAEGMASGVEFLLNKNKITRKKGTAVFKDPNTIWLPDSSKEEITSKYFILATGARARELPDLPFDSHTVLSSKTAMIQDKIPESLLIVGAGAIGVEFADFYSTMGTKVTLVEMMDQILPVEDKEISTFLEKSFVKRGIRVLTGVGVSDPKIVNGKVKVLLKGKNLPEAVESFEAEKILVSIGLVPNTDSMHLEEIGIFLQKGFVKTDTKYKTSVPHIYAIGDCNGAPLLAHVASMEGIKAVEAISIHAGNPHHLSYIPIDYNAIPGCTYCHPEVASIGFTEKKATDMGYTISVGKFPFVASGRAKAMGDTGGFTKVIVDKTSGEILGAHLIGPGVTELLPAVSLGITQELTAKEIASTIFAHPTLSETVMESFGAALGEAINL

SEQ ID NO: 34453 - protein, 280 aa, Aquifex aeolicus VF5
MRDIVFIERDPYAPIRHCYTVSKILYQGKSPYQEIQVIESPEFGRMLILDGVVQLDEKYEFLYHEYLAHVPLHAHPNPRNVLIIGGGDGGTLREVLKHDIVERAVLVDIDKEVIEVSKKYLPTLSVGFQDPRAIVVNEDGYKYVQDYENEFDVIIVDSTDPVGFAHVLTTEDFFRHVYKALKEDGIFVAQTESIHYHLEMVSNIQQRLKKVFPIVDLYTSVIPIYAGYWWTFSIASKKYPVRTPAREVKVQTKIYDADMHEYAFLPESFYNKIVNGEYKY

SEQ ID NO: 34454 - protein, 499 aa, Coccidioides immitis RS
MADRLLKKIPYTFKDPSLLDTRSLIGGKWVEARSGKTFPVFDPEDNKEVCQVTDLDVDDVCAAIDAASEAFKTFKNAPHRERRWLMRRWADLIKENKDDLAAICTLELGKPFTESLVTVKYGTDFLDWFEGEIERVYGETIPAARGNNRIFTIKQPQGVVAAITPWNSPIAMVTRKVGAAIAAGNTVICKPAPETPLCAIAVAKLFERAGGPPGVLNIITSSPETTPAVGAELCSNKLIRHLSFTGSTAVGRYLHTECSKTFKKTSMELGGNAPFIIFEDANIDKAVDGLISSKFRSSGQTCVCANRIFVHSSIISQFASRLHTRLGETFTYGSVWDRNVNFGPLYSPKAFDKLTRQTKDALERGGELIGEDPAKLQAQYGPNFYPPTIVTNANKDMLFMKEETFGPLAFLVPFETEEEAVAMANNVDAGLASYFYTEDISRMYRVSEALESGMVGCRVGLISACEQPFGGIKDSGMGREGGKGALDEYLNIKSVTVGI

SEQ ID NO: 34455 - protein, 538 aa, Zea mays
  misc_feature (70)..(70): Xaa can be any naturally occurring amino acid
RHSPRHSLSVVAPHQSSPPVRGQIKRWPRRFTSPPRRRRRRVARQRRQTTRATASATDRPREVVSPKRRXLPLRKVPGDYGPPVLGAIRDRFEYFYGPGGRDGFFNSRVRAHGSTVVRLNMPPGPFVARDPRVVALLDAASFPVLFDTSLVDKTDLFTGTFMPSTELTGGYRVLSYLDPAEPNHGPLKTLLFYLLSHRRQHVIPKFREVYGDLFGLMENELARVGKADFGHYNDAAAFSFLCQALLGRDPAESALQGDGPKLITKWVLFQLSPLLSLGLPKHVEDSLLHSFRLPPALVKKDYDRLADFFRDAARRVVDEGERLGVAREEAVHNILFAMCFNSFGGMKILFPSLVKWLGRAGGRAHGRLATEVRDAVRAHGGEVTMKALAEMPLVKSAVYEALRIEPPVAMQYGRAKQDMVVESHDYGFEVREGEMLFGYQPMATKDPRVFARAEEYVPDRFLGEDGAQLLRHVVWSNGPETASPTLQDKQCAGKDFVVLIARLLVAELFLRYDSFDVQVGASALGSSVTITSLKKATF

SEQ ID NO: 34456 - protein, 417 aa, Acidovorax sp. JS42
MAEIKNYSLNFGPQHPAAHGVLRLVLELDGEVVQRADPHIGLLHRATEKLAEHKTYIQSLPYMDRLDYVSMMCNEQAYCLAIEKMLGIEVPLRAKYIRTMFGEITRLLNHLMWLGSHGNDCGSSTILIYTFREREDLFDMYEAVSGARMHAAYFRPGGVYRDLPDSMAQYKVSKIKNAKAIEELNRNRQGSLLDFIDDFTQRFPKCVDEYETLLTDNRIWKQRTVGIGVVPAERALNLGMTGPMLRGSGIAWDLRKKQPYDAYDRVDFDVPVGVTGDSYDRYLVRVQEMRESNRIIKQCVDWLRANPGPVITDNHKIAPPSREAMKSNMEELIHHFKLFTEGFRVPAGEAYAAVEHPKGEFGIYMVSDGANKPYRLKIRAPGFAHLATLDEMARGHMLADAVAIIGTMDIVFGEIDR

SEQ ID NO: 34457 - protein, 279 aa, Mycobacterium sp. JLS
MASTRSERHFDGVGGVRIVYDTWTPDAPARGVVVLSHGYAEHARRYDHVAQRFGEAGLIVYALDHRGHGRSDGKRVYLRDIAEYTGDFHTLVGIAAREHPDLPRIVLGHSMGGGVVFAYGAEHPGDYAAMVLSGPAVYAQSAVKPWLVTVAKLLGRIAPGAPVEQLDADAVSRDPEVVAAYKADPLVHHGKLPAGVARGLFTVGETMPQRAGALTAPLLVVHGEKDRLIPVEGSHRLVDRVASQDVHLKVYPELFHEVFNEPERATVLDDVISWIEVRL

SEQ ID NO: 34458 - protein, 553 aa, Aspergillus nidulans FGSC A4
MPSFSQAVELPAWKELQDHHGSVGRNIVLKECFEKDPQRFEKFSRTFQNTVDNNEILFDFSKNFLTEETLALLVKLAKQAGVEELRDQMFAGEPINFTENRAVYHAALRNVSNQPMQVNGKSVVEDVNSVLEHMKEFSEQVRSGEWKGYTGKKINTIINIGIGGSDLGPVMVTEALKPYGHPDLKLHFVSNIDGTHIAEALKDSDPETTLFLIASKTFTTAETTTNANTAKSWFLEHAKDGAHIAKHFVALSTNAEEVAKFGIDTKNMFGFESWVGGRYSVWSAIGLSVALYIGYDNFHQFLAGAHAMDKHFRETPLEQNIPVLGGLLSVWYSDFFGAQTHLVAPFDQYLHRFPAYLQQLSMESNGKAITRTGEYVKYTTGPVLFGEPATNAQHSFFQLLHQGTKLIPADFIMAAESHNPVEGGKHQRMLASNFLAQSEALMVGKTPEQVKAEGAADNLVPHKTFLGNRPTTSILAQKITPAALGALITYYEHLTFTEGAIWNINSFDQWGVELGKVLAKKIQKELETEGEGSGHDSSTSGLLLAFKKKAKLA

SEQ ID NO: 34459 - protein, 855 aa, Sorghum bicolor
MAFSPRSPWSRPKRNDVYSTFVVHGDDDEDDARGSRRGRGPSTRAEEDEEEDPSSLPPLLQRLPKDFGGPSFDEDEDAYSSDPDDASLSATVVFKSGAPASARSPFLDLRRSSPRATDDDPYSTFVVHSTARSGGTSSSPRGSASGTFIRRSGGSSSPHESVSGTFIRRTSTPSSPRDSVSGTFIRRPGSPSSPRGSFSGTFIRHTSGGSSSYESASGGGGGFGSSFWSPAVEQTEELRQPSPLMQQQQQQHSRRKPSVSSAPDSVTREDPSTKYELLHELGKGSYGAVYKARDLRTQELVAVKIISLTEGEEGYEDIRGEIEMLQQCSHPNVVRYFGSYQGEDYLWIVMEYCGGGSVADLIGITEEPLDESQIAYICREALKGLAYLHSIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDPRLRPAASEMVKHKFIEKCNSGASKMLAKIKEAKKIRATLAVQNELSDPDNTMQDVPVRINEDYGETVPTNSQQHMNHGTYNDCQAGDFGTMIVHTEDGDEVAESPIFPRTEFIPGLGSINSFTHDPKRAELISSFWAENTGDSDANKDRDLDDRPDIQESKAIPPLTGTVKKHIGAEGTIRRHDNQVNLSPGFANTTKLNSSPSRKAFSVQDKLWSIYAAGNTVPIPFLKAIDISPLALVSENEAGNGLAGSSTNDALEAVRELFSGDGQAKKGRKGQNEVPLPPGVHHRLMTSPTLMNLAQALAYHKTCYEDMPLQDSQATQEQQTIQNLCDTLRTILRL

SEQ ID NO: 34460 - protein, 175 aa, Glycine max
  misc_feature (73)..(73): Xaa can be any naturally occurring amino acid
  misc_feature (112)..(112): Xaa can be any naturally occurring amino acid
MDFESNYDIAASANFIHTHNFIKVALQFPDNLLKHSTRVVTALRNTLQSTEVGLFVMADTAYGSCCIDEVGSXHINADFVIHYGHTCFSPTTTLPVFCVFGKASICVADWVXSMSKYALTNSKPIMVLFGLEYAHSMQRIKEALLESSMSCRFDPKSEVHFADVPSSVMFPSKDI

SEQ ID NO: 34461 - protein, 170 aa, Acidovorax sp. JS42
MAAVAASASFSIKDFFKSFMLWELAKGMALTGRYTFRRKVTVQFPEEKTPLSPRFRGLHALRRYENGEERCIACKLCEAVCPAVAITIESDVRADGSRRTTRYDIDLTKCIFCGFCEESCPVDSIVETPIFEYHGEKRGDLYFTKDMLLAVGDRYEPEIAAAKAADAKYR

SEQ ID NO: 34462 - protein, 143 aa, Zea mays
MVHGTLEVLLVGAKGLENTDYLCNMDPYAILKCRSQEQKSSIATGKGTTPEWNENFIFTVSDRTTDLVIKLMDSDTGTADDFVGEATIPLEAVYTERSIPPTLYNVVKGEKYCGEIKVGLTFTPEDTRQRGLPEDFGGWKQSS

SEQ ID NO: 34463 - protein, 277 aa, Synechococcus sp. PCC 7002
MTVATSQKLPLDWTTIIYFSLIHLVALLAFLPGNFSWQAVGVFLLFHWITGGIGITLGFHRLVSHRSFEVPKWLEYFLIFCGTLACQGGPIDWIGLHRIHHKHSDNTPDPHDSNKGFWWSHIGWMLFEIPARGDIDRYIKDIKDDPFYNFCQKYMVLIQVALGLALYAWGEAWVGNGWSFVIWGVFLRLAVVFHCTWFVNSATHKFGYKSHESNDHSKNCWWVALVTYGEGWHNNHHAYQYSARHGLNWWEIDMTWMTIRFLQALGLAKNIRLAPAK

SEQ ID NO: 34464 - protein, 475 aa, Rickettsia montanensis
MNLLKNITGKNYINGEFIEFGKQISVINPATLKEIATVPNLGLSEINSAINNTVTSFSSWSQSSFEARIAILRRWYNLVIENIEELSHILTLEQGKVLAESKKEILYGVSFIDWYTYAIHNIHSTIKPGNSKAHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGSTNVGKILYQNAANTLKRLSLELGGNAPFIITADNNLEKVVSDLITAKTRNSGQSCISPNRIFIEESIYEKFIEILKAKFTKLKAGDGFDKESDVGPLINSAAIEKIQKLLADAQSKGAKLICGGKAVDNFIEPTIIIDCLDNMDIFRTEIFGPVVACYKFKDLDEVIERANNTEYGLQGYVYSNNISVVQMIASKLDFGMVSINDPLPANAKAPFAGRKASGFGVEGSFEGIFEYLNTKYINLQH

SEQ ID NO: 34465 - protein, 1053 aa, Sorghum bicolor
MVAARRGTASTYALLLLLLLTAAVSVSSSSGLRRGEDQDRSALLQIKNAFPAVELLQQWSPDSGGPNHCSWPGVTCDSSSRVVALEVLSPSRRSGHGRELAGELPAAVGLLAELKEVSFPLHGLRGEIPGEIWRLEKLEVVNLPGNSLRGVLPSAFPPRLRVLSLASNLLHGEIPSSLSTCEDLERLDLSGNRFTGSVPRALGGLTKLKWLDLSGNLLAGGIPSSLGNCRQLRSLRLFSNSLHGSIPAGIGSLKKLRVLDVSRNRLSGLVPPELGNCSDLSVLILSSQSNSVKSHEFNLFKGGIPESVTALPKLRVLWVPRAGLEGTLPSNWGSADRFGNKMTYMFVVDHNKFSGSLDSILLEQCSNFKGLVVSFRDNKISGQLTAELSRKCSAIRALDLAGNQISGMMPDNVGLLGALVKMDMSRNFLEGQIPASFEDLKTLKFLSLAGNNLSGRIPSCLGQLRSLRVLDLSSNSLAGEIPNNLVTLRDITVLLLNNNKLSGNIPDLASSPSLSIFNVSFNDLSGPLPSKVHSLTCDSIRGNPSLQPCGLSTLSSPLVNARALSEGDNNSPPDNTAPDGNGSGGGFSKIEIASITSASAIVAVLLALVILYIYTRKCASRPSRRSLRRREVTVFVDIGAPLTYETVLRASGSFNASNCIGSGGFGATYKAEVAPGKLVAIKRLAIGRFQGIQQFQAEVKTLGRCRHPNLVTLIGYHLSDSEMFLIYNFLPGGNLERFIQERSKRPIDWRMLHKIALDVARALAYLHDNCVPRILHRDVKPSNILLDNDHTAYLSDFGLARLLGNSETHATTGVAGTFGYVAPEYAMTCRVSDKADVYSYGVVLLELISDKKALDPSFSPYGNGFNIVAWACMLLQKGRSREFFIEGLWDVAPHDDLVEILHLGIKCTVESLSSRPTMKQVGLLAVLVTATAGNVPNKLVAITHQLFKYHFSTGPQAGHSWYLTLIGYVIMHYCMDHDIASMPLQASIEDDDWMSHGRPSICLAVQLFRHNLPCCSPDRRSTTLSHWNNIYLSKQSQYIWQLWGDLSLEMACH

SEQ ID NO: 34466 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQFEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 34467 - protein, 271 aa, Leifsonia xyli subsp. xyli str. CTCB07
MNDWIVAPSESDDKYSRGVLGVVTGSGRYPGAAVLGVEAAARTGVGMIRYLGAAHTAAEVLRRRPEAVTAPGRVQAWLLGSGMDAASRTPDDTRRLRDALADGTPLVIDAGALDLVPEAAGPVVITPHARELALMLAGGDDPDAITADGIRSGPAVWAARAAASFGVTVLLKGHTTHIATPGGTHRTVTAGTPWLATAGSGDVLGGVLGALVATHADAVRDQGHDALAALAATAAWLHGRAGLRASGGGPIAALDIAEALPAVVRGLLSAR

SEQ ID NO: 34468 - protein, 448 aa, Corynebacterium diphtheriae NCTC 13129
MSPIDEKVQGYYELLLKRNPAEPEFHQAVNEVLDSLKIVLEKDPHYADYGLIQRLCEPERQLMFRVPWVDDNGVVQVNRGFRVQFNSAIGPYKGGLRFHPSVNLGIIKFLGFEQIFKNSLTGLPIGGGKGGSDFDPKGKSDVEIMRFCQSFMTELYRHIGEYRDVPAGDIGVGGREIGYLFGQYRRLANQHESGVLTGKGLTWGGSLVRTEATGYGLVYFTAEMLAHHGQSFEGKKVIVSGSGNVAIYAIEKAQELGATVIGFSDSSAWVETPNGVDVAKLKEIKEVRRERVSSYVDEVEGAILHTEGSIWDLTCDVALPCATQNELDGEHAKKLADNGCAFVAEGANMPSTADAIEVYRERGIHFGPGKAANAGGVATSALEMQQNASRDSWSFEYADQRLREIMKGIFKNCESTAREYGHEGDYVVGANIAGFKKVADAMLAQGVI

SEQ ID NO: 34469 - protein, 177 aa, Glycine max
MAITTNPLVVGRVIGDVLEPFASSIPLRVVYNNNKEVINSGELKPSQIINPPRVEVGGDDLRTLYTLVMVDPDAPSPSDPNMREYLHWLVTNIPATTSASFGQEVVSYESPRPTSGIHRFIFVLFRQPRRMSIPAPGWRQNFITRDFAEYYNLGLPVAAVYFNCQRQGGSGGRRLML

SEQ ID NO: 34470 - protein, 310 aa, Kluyveromyces lactis NRRL Y-1140
MTLKSTVDDYTKEKKAGEGTYAVVYLGTKKSTGRSIAVKEIKTSQFKDGLDMSALREVKFLQELKHVNVIELVDVFMANDNLNLVLEFLPADLEIIIKDTSIMFSPADIKSWILMTLRGVHHCHRNFILHRDLKPNNLLLAPDGQLKIADFGLARLMASPQEILTSNVVTRWYRAPELLFGAKHYTSAVDIWSVGVIFAELMLRIPYLPGKDDVDQINVTFRALGTPTDADWPEVSSFSNYNKIQIYPPPSREELRRRFIAATENALELISGMMIMNPKKRWDAVKCLQSQYFQELPEPTLPQDLPKLNK

SEQ ID NO: 34471 - protein, 447 aa, Acidovorax sp. JS42
MKHQSVGHFLEQVAQRNPGQPEYLQAVTEVMESLWPFIEKNPRYAEQGLLERLVEPERVVMFRVSWFDDHGNVHINRGYRIQHSMAIGPYKGGLRFHPSVNLSVLKFLAFEQTFKNALTTLPMGGGKGGSDFDPKGKSPAEVMRFCQAFVTELFRHVGPDTDVPAGDIGVGGREVGFMAGMYKKLANNAASVFTGKGLAFGGSLIRPEATGYGTVYFADEMLKTRGRSFDGLRVSVSGSGNVAQYAVEKAMQLGAKVITVSDSSGTIIDEDGFTPEKLAILMDVKNHHYGRVSDYAARTGVKFEAGVRPWHVKVDVALPCATQNELDENDARTLIKNGVLCVAEGANMPSTNEAAKLFEQAGVLYAPGKASNAGGVATSGLEMSQNAMRLSWTRDEVDARLLQIMQGIHAACLQYGKRADGSVSYINGANVAGFVKVAEAMLAQGVV

SEQ ID NO: 34472 - protein, 336 aa, Aspergillus nidulans FGSC A4
MSTSKSRWADEDPETEALIAQRKREKEEKRRAKAEKQRLEEQAKAQAAAERQAGDSRLNGDPSEAPPKKRRRLSNEQQPGSSGEQAAKQGKPTTLLQFPALEWGPCRHVDNFERLNHIEEGSYGWVSRAKELTTGEVVALKKLKLDNSPDGFPVTGLREIQTLLEARHQNVVYLREVVMGNKMDEVYLVMDFLEHDLKTLLDDMREPFLPSETKTLLLQFISGLDFLHSQWIMHRDLKTSNLLLNNRGELKIADFGMARYYGDPPPKLTQLVVTLWYRSPELLLGAESYGPEVDMWSVGCIFGELLTKEPLLQGKNEVDQVSKVCTVLFFFFSFKI

SEQ ID NO: 34473 - protein, 258 aa, Brassica napus
PTRPKDQCCSSCCGDCLSPAMACSCATAIGGFAYTKDGLLQKDFLEECISEARNPQKQVVQYCKECPLEIAKNEETLEPCKGHLKRKAIRECWISCGCTKKCGNQVVQHGLHTKLQVFFTSNGRGWGLRTLEKLPKGAFVCELAGEILTISELVQRSSSEKLTSPVILDAHWDSEEVSGVKRALCLDGTHYGNISRFINHRCVDANLIEIPVHVENMDLHYYHLGLFTTRDIEAMEELTWDYGVKFNDQVYPTRPFHC

SEQ ID NO: 34474 - protein, 720 aa, Xanthomonas campestris pv. campestris str. ATCC 33913
MATRKFTQRSRIREGRPNPLGATWDGLGVNFALYSRNATRVELCLFDERGREQERIPLPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPENRGTFSALKTDELIDHISSLGVTAVELLPVHAFVDDQYLLEKGLRNYWGYNTLGFFAPQGRYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISANYGAEGETDNPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGNEMDEAAWHDPEARALMLRLDGRSPTTGLREIAANVTLLMLINAAPTSVAFTLPAMHDEHWRVLVDTARHGGRVVAGGSEWKAPAHSLTLLAVERDRIASSARIVSEGAR

SEQ ID NO: 34475 - protein, 259 aa, Leifsonia xyli subsp. xyli
MRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 34476 - protein, 496 aa, Oryza sativa (japonica cultivar-group)
MAELPLAAGLLDLRPCKLAPPPPPPLPVSPSPRHHRRPHSTATACRAAPDLHSSTELADGSIVFRFARPRDDDDEEQQQRRADAVAPEAAAVVESGLDGDAAAAAEPEARDGGGEGEVTATATGLDAEEVVASGGAEATATSGLEDAGEEASDGSTARDSDTDVDTESSASTAADDDQPAEFAVPPPPAEEVCNKVDWEKDTSEVKNTDRMVPVASSTLVLASGAAILPHPSKVLIIALRVLFYAVYLWTLVYLDPITEANSFKAATGGEDAYFIACDGWFGVADGVGQWSFEGINAGLYARELMDGCKKFIMENQGAADIKPEQVLSKAADEAHSPGSSTVLVAHFDGQFLNASNIGDSGFLVIRNGEVYQKSKPMVYGFNFPLQIEKGDNPLKLVQNYTIELEDGDVIVTASDGLFDNVYEQEVATMVSKSLQADLKPTEIAEHLAAKAQEVGRSAAGSTPFSDAALAVGYLGFSGGKLDDIAVVVSIVRKSEI

SEQ ID NO: 34477 - protein, 116 aa, Corynebacterium diphtheriae NCTC 13129
MDDPASYELDPSIAQRVKFNSAGLVPAVVQSTDGEVLMLAWMDAHALAYTIATRKGTYFSRSRNEYWIKGLTSGHTQQVTGLQLDCDGDTVLMTVVQQGGACHTGDRTCFDADVII

SEQ ID NO: 34478 - protein, 456 aa, Micrococcus luteus
MRHPIPDYLASLVTELGAVNPGETAQYIPVLAEADPDRFGIALATPTGRLHCAGDADVEFTIQSASKPFTYAAALVDRGFAAVDRQVGLNPSGEAFNELSLEAESHRPDNAMINAGALAVHQLLVGPEASRKERLDRAVEIMSLLAGRRLSVDWETYESEMAVSDRNLSLAHMLRSYGVLQDSAEEIVAGYVAQCAVLVTVKDLAVMGACLATGGIHPMTGERMLPSIVARRVVSVMTSSGMYDAAGQWLADVGIPAKSGVAGGVLGALPGRVGIGVFSPRLDEVGNSARGVLACRRLSEDFRLHLMDGDSLGGTAVRFVEREGDRVFLHLQGVIRFGGAEAVLDALTDLRTGAEKPGTGWDAAVYPRWQEAAADRAALSAATGGGAVHEAAAAAARDENDGPIRTVVLNLARVDRIDDVGRRLIAEGVRRLQADGVRVEVEDPERILPLEEAGAH

SEQ ID NO: 34479 - protein, 594 aa, Pisum sativum
MASKQKQTYSVCFCCRRRFKLGISEAPSQIRELYHNYSDESAIMTASHLQRFLIEVQGDENITENEAQSIIDGHKHLSIFHRRGLNLESFFKFLFSDNKPPLLASRGVHQVMSLPLSHYYIHTGHNSYLTGNQLSSDCSDAPIIVALQGGVRVIELDIWPNGSKDDIEVLHGRTLTTPVALIKCLRSIKEYAFVASEYPVVITLEDHLTPDLQAKVAQMVTQTFGDILFCPSSESLKEFPSPDSLKRRIIISTKPPKEYLEAKEVQEKEELTKGKSSGDEEAWGKEVPSLRGGTISDYKNNDDDDEDDLNEEEDSEEAEKSRQNGSGEYRRLIAIHAGKPKGGLVEGLKVDPDKVRRLSLSESQLEKAAETYGKEIVRFTQRNILRVYPKGTRITSSNYNPLIGWMHGAQMVAFNMQGYGRSLWLMQGMFKANGGCGFVKKPDFLLKTGPNNEVFDPKASLPLKTTLKVTVYMGEGWYYDFDHTHFDQFSPPDFYARVGIAGVPFDTIMKKTKTVEDSWLPSWNEVFEFPLSVPELALLRIEVHEYDMSEKDDFGGQTCLPVWELRTGIRAVPLHSRKGGKYNNVKLLMRFEFI

SEQ ID NO: 34480 - protein, 393 aa, Oryza sativa (indica cultivar-group)
MAAASSLHAAPRVGSSSSFSSSSSAGRRSASAARSVRVAAAAGSCAARRAGGRMSKAESPASAASSKSDGHEVLLFEALREALIEEMKEDPTVCVFGEDVGHYGGSYKVTKGLAEMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYVLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAAPLEDATVVQPAQIVAAVEQICQ

SEQ ID NO: 34481 - protein, 202 aa, Corynebacterium diphtheriae NCTC 13129
MATQPRIGSISRVTSESDIRVEINLDGTGTVEIDTGVPFFDHMLTAFGVHGAFDLKVKATGDTHIDAHHTVEDTAIVLGQAIAQAVGDKRGIKRFGSFQLPMDETLCEAIVDFSGRPYFVTKGEPDYLVHSVIGSHYPTVLNEHFFESLALNAKITLHVLCRYGRDPHHITEAEFKAVARAIREAVGPDDRLTGIPSTKGAL

SEQ ID NO: 34482 - protein, 496 aa, Bradyrhizobium sp. BTAi1
MMSIAYEYERSSALSSDLTKPLQLLIGGRHVPSVSGRTFTTLNPATEQPLATIAEGNAEDVDLAVAAARRAFEGPWRTMRAAERGAILLKWAQLVRDRSAEIVELESLDAGKPVSAILRQDLPAAIDTLTYYAGWADKISGEVVSTRDDALTYTVREPVGVVAAIVPWNFPLMIGMWKLAPALACGCTVVMKPAELTSLSALRIAELALEAGLPPGVLNIVTGPGRIVGEALVNHPDVDKVTFTGSPGVGRGIMKAAAGNFKRVSLELGGKSANIIFDDANIEAAAKAAASGIFFNAGQVCSAGSRVLVQERAYDEVVERLTARARALRIGDPLDRATSLGPVISERQMKTILDYVDIGRREGATLVTGGERAAARGYFISPAVFAGVTHEMRISQEEIFGPVVSVIKFKDEADALRMANGTAYSLAAGVWSRDLGRVQRFAKRLRAGTVWINTYGYTDVRLPWGGDRDSGLGREHGTAALDNFTEPKAVWMNLAV

SEQ ID NO: 34483 - protein, 131 aa, delta proteobacterium MLMS-1
WPGDHLQVHDPAVVTLQYPRQTFKMAPRYRGHIDLIFDAEAESGNKCIACGMCQRNCPSDCITLKSEKPEGAKKKVLTGYQLDFTKCSLCGLCVESCPTDALEFSKEYNLAGLKAEDYVFDLLKRCEERRR

SEQ ID NO: 34484 - protein, 748 aa, Pseudomonas putida
MTADNSLADAMERCAQEPIQVPGSIQPHGFLLVLDATDLRVLQASENVEHWLGLPARELIGCHFADLVHEGFDLHAHLTRLPEDEVFPFHIGDVRLRQGAPISALLHMLVHCHDQVLIAEFEPPRLPADLVGQGDYYPLVRSFVASLQVASSIEDLLQQTVLQLKRITGFGRVKAYRFDAEGNGQVLAEVVDPGYPSYAGLCFPAADIPRQARELYRVNRIRVIEDANYQPSPLLPATNPRTGKPLDMSFAALRSVSPVHLQYMRNMGTLASMSLSIVVDGQLWGLISCHHQQPRPVDLRTRTACELLASVLSLQIESRESHASTRKLLTLRQHIVRMISSMADHDSVSDGLRDLPEVLLAFADAQGAAVISAERCDLIGQTPPEAQVTALVHWLGQRDEDKVFHSDNLRRDITELPELANHAGGVLAVAISQIHSHYLLWFRPEQIRTVNWAGQPTKQVGPQGNLDPRHSFERWQEEQRGYSQAWDPLVIEGVIELRAAVLGIVLRKAEELAQLAGELRRSNKELEAFSYSVSHDLRAPLRHIAGYTELLGEIEGQGLSERGKRFLQHIGEAAHFAGSLVDNLLNFSQMGRSALRLSDVDLNALVEAIRSELAPDYEGRAIVWDIAPLPKVIGDPAFINMALHNLIANAIKYTRGRTPARIEISAVQHPEETEVCIRDNGVGFDMAYANKLFGVFQRLHRMEDFEGTGIGLASVRRIIERHDGRVWATGQVDQGASFHFTLPRNTAT

SEQ ID NO: 34485 - protein, 140 aa, Bradyrhizobium sp. BTAi1
MAIERTFSIIKPDATERNLTGAINALIEKAGLRIVAQKRIRMTREQAETFYAVHKARPFFGELVDFMISGPVVVQVLEGEGAILKYRDVMGATDPSKAADGTIRKLHAKSIGENSVHGSDAAETAAIEIAQFFSGNEIVG

SEQ ID NO: 34486 - protein, 750 aa, Cyanidioschyzon merolae
MFTAGFILAVLAVIAFGTLIFTYRLYEYLIGCPEGPQSMRDVARPIQEGASGFFKVQYSTIASIAGIFALVIYFFGTGGAGGTTQASPFFNAAAFLLGGTLSALSGVLTMYLAVRVNVRVAAAASRSYAEAMKVCFRGGLFGGLLILSNCLVGFILLYWFALVTGMAAGDITQVPVLFVGYAFGASFVALFAQLGGGIYTKAADVGADMVGKVDTGIPEDDPRNPATIADLVGDNVGDASGRSCDLFESISAELVGASILGGTLARTANLSGASQAAYVLFPLCVHAVGLVCSALGGVTVRVSSGVARDEERSLLRTDDAFETRLEDPMSIMKRGFRVTMVLAAISIWVLCWLLLRVGNVAPSAWWHYALCGMIGLAVSYLYVLITEYYTDTKFRPVRSIAEASEYGHGTNVIRMLAVGLESSALPAIVVSAAILGAYWLGATSGMPDRNAAGIFGTAVATMGMLSSAGIVLAMDVFGPVADNAGGIAEMSGADPSVRRITDRLDAAGNSTKAFTKGFAVGSAALAGYLLFSSFMEEMSAQLPEKMVFNSVDLAKPEVFVAGLLGAAVVFLFSSLAMTAVGRAAQGVVAEVRRQFRDHPGIMAGTEKPEYERCVALVAASALRQMVLPGLLPVLAPIMIGMLFRFIGNMTGRPLLGLECAAGLLMVATIAGILMALFMNNAGGAADNAKKYIEDGHYGGKGSQAHKASVTGDTVGDPLKDTAGPSLHVLIKMLSTLTMVFGPAFVGSIGA

SEQ ID NO: 34487 - protein, 288 aa, Arabidopsis thaliana
MPLHMKIQPIDESDVSEEVPYPETMRQMPKSRLKRLFERQFTNKNVSEKFTGSDVEAPLSRGNSGDFEPSSVCLAKMVLNFMEDNNGGEKQRCGRSRCNCFSGSGTESSDDETECSSGEACEILKSLVLCKSIRVRNLLTDVTKIAETSYDAALCKSRWEKSPSCPAGEYEYVDVIMKGERLLIDIDFKSKFEIARATKTYKSMLQTLPYIFVGKADRLQKIIVLICKAAKQSLKKKGLHVPPWRRAEYVKSKWLSSHVRVDQNSNGEVKQESVEVIAESVSSIVFGV

SEQ ID NO: 34488 - protein, 212 aa, Oryza sativa (indica cultivar-group)
MGFVTAAADAVVALLSLTMAVAAPLFDAQVVLPRGLYAAPLVGIHRWFAAEFGHYLVADPPPFFRGLVWLDLAFLWPVCVANLYGILARRPWSAATSIMAGVYVLTYMFCVVSAHAQHRLLLLHLMPQLLGRKGSRSDEYREIPKEVPIMVTSWIRYEDGCHAQCQGWWCNMGAGHPMGAAAISYGVGTQLPIGDLKDGWTIHEGKQSNLSF

SEQ ID NO: 34489 - protein, 341 aa, Pseudoalteromonas tunicata D2
MKALSKLKAEPGIWMTEAAKPEVGHNDLLIKIRKTAICGTDVHIYKWDEWAQNTIPVPMVVGHEYVGEVVDMGQEVRGFKIGDRVSGEGHITCGHCRNCRAGRVHLCRNTIGVGVNREGSFAEYLVIPAYNAFKIPDNISDELASIFDPFGNAVHTALSFDLVGEDVLITGAGPIGIMAAAVAKHVGARYVVVTDVNEYRLDLARKMGATRAVNIANEKLEDVMKELGMTEGFDVGLEMSGVPSAFKNMLSNMNHGGKIAMLGIPPSDMAVDWNQVIFKGLVIKGIYGREMFETWYKMASLIQSGLDLSPIITHQFPIDQFQQGFDTMLSGQSGKVILDWC

SEQ ID NO: 34490 - protein, 433 aa, Nicotiana tabacum
MAGQTIIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELSVRIKPMLDGNARSAMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTIIGKRVRGELREYWINDGLYGSMNCVLYDHATVNATPLAVLSNRSNVTCGGSKTFPTTVFGPTCDALDTVLRDYQLPELQVNDWLVFPNMGAYTKAAGSNFNGFNTSAIVTHLAYSYPS

SEQ ID NO: 34491 - protein, 496 aa, Arabidopsis thaliana
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEHLRSLGCGAVLVSGNELRLALLAVFDHVFGVDEMNRCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPTPPEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 34492 - protein, 261 aa, Nicotiana tabacum
MEAANHNNDNGCTNESPYISSVLPGWFSEISPLWPGEAHSLKVEKILFQGKSDYQNVMVFQSSTYGKVLVLDGVIQLTERDECAYQEMIAHLPLCSIPNPKKVLVIGGGDGGVLREVSRHSSVEQIDICEIDKMVVEVSKQFFPDVAVGYEDPRVNLHIGDGVAFLKNVAAGTYDAVIVDSSDPIGPAQELFEKPFFDSIARALHPGGVVSTQAESIWLHMHIIEEIVANCRQIFKGSVNYAWTTVPTYPSGMIGFMLCST

SEQ ID NO: 34493 - protein, 229 aa, Thermococcus kodakarensis KOD1
MNVEEMKKAVAKEALKFIEDEMVVGLGTGSTTAYFINYLGKLLMEGELEDVYGVPTSHQARLLALEAGIPVVSLDEVDAIDIAVDGADEVDPHMNLIKGRGAALTMEKIIEYRAGMFIVLVDESKLVEYLGQKMPVPIEVIPAAWRAIAEELEVFNATAELRMAVKKDGPVVTDNGNFILDAKFARIEDPLDLEIELNTIPGVVENGIFADIADIILVGTPEGVKRMER

SEQ ID NO: 34494 - protein, 735 aa, Corynebacterium diphtheriae NCTC 13129
MNDSPVTSDRQIWPGQSYPLGSKYDGAGTNFAIFSDVAEKVELCLIDAECNEERILLDEVDAHIWHCYLPGVKPGQRYGFRVHGPYNPAEGKRCDPSKLLVDPYARAFDGEFDGHPSLFSYDINDPENPEGRNTEDSLEHTMKSVVVNPFFDWGSDRSPNTPYNETVIYEAHVKGMTMRHPDVPESLRGTYAGLAHPSIIEHLKDLGITAIELMPVHQFLQDDRLRDLGLRNYWGYNTFGFFAPQQDYAAAQEPGGAVSEFKGMVRAFHEAGIEVILDVVYNHTAEGNHMGPTIAFRGIDNEAYYRLVDGDKAHYMDYTGTGNSLNVRDPHPLQMIMDSLRYWVSEMHVDGFRFDLASTLARELHDVDKLATFFDLVQQDPIVSQVKLIAEPWDVGEGGYQVGNFPPLWTEWNGKYRDTVRDFWRGEPSTLGEFASRLTGSSDLYANNGRRPTASINFITAHDGFTLNDLVSYNHKHNDANGEDGRDGESHNRSWNCGEEGPTEDPRINKLRARQRRNFLTTLLLSQGTPMIAHGDEMARTQDGNNNVYCQDNETSWMDWELADKNAALMEFTKRLITIRRNHPVFRRRRFLAGGPLGSEVGDRDIAWLVPSGKLMGQSDWDFAFGKSLMVYFNGKAIQEPDARGQRIEGDSFIMMFNAYHEPIDFTLPDTEFGPAWKLIVDTNVDTGYPDEAKTLRAGDSITVEARSTLILRLVDTTHKSQTVEKDRRDDDYSD

SEQ ID NO: 34495 - protein, 297 aa, Campylobacter jejuni RM1221
MQKIDELIKQFLQELGYEPILNMLSNVKSGKKLRSKLLLTIADESEIAFKICAAIELIHLASLLHDDIIDESELRRGARSVNAEFGTKNALMLGDILYSKAFYELSKMDARFASIISDAVVKLAIGELMDVDLGEKFNINKEAYLKMIYNKTAVLIEASARCGAILAGLYEKDFAEYGKNLGLAFQMIDDILDIKSDEKILGKPAMNDFKEGKTTLPYIYLYENLQEQDRIYLQTLFKKDLNENEKEWLKTKFEEQKALEKAILEAKTYAKKARKAIEKYDNNKLNDIIKAMIDREF

SEQ ID NO: 34496 - protein, 1016 aa, Rhodobacter sphaeroides
MRLPSLAARPTGPRRTGVPSRLRWTGSVRHIPTRGRMCWPAPPRPSRRSSNGSPLLWQPGGYDRPPPPCRSLPHVCQNFVVRGCLMTISGGTFDPSICEMEPIATPGAIQPHGALMTARADSGRVAHASVNLGEILGLPAASVLGAPIGEVIGRVNEILLREARRSGSETPETIGSFRRSDGQLLHLHAFQSGDYMCLDIEPVRDEDGRLPPGARQSVIETFSSAMTQVELCELAVHGLQLVLGYDRVMAYRFGADGHGEVIAERRRQDLEPYLGLHYPASDIPQIARALYLRQRVGAIADACYRPVPLLGHPELDDGKPLDLTHSSLRSVSPVHLDYMQNMNTAASLTIGLADGDRLWGMLVCHNTTPRIAGPEWRAAAGMIGQVVSLLLSRLGEVENAAETLARQSTLSTLVERLSTGDTLAAAFVAADQLILDLVGASAAVVRLAGQELHFGRTPPVDAMQKVLDSLGRPSPLEVLSLDDVTLRHPELPELLAAGSGILLLPLTSGDGDLIAWFRPEHVQTITWGGNPAEHGTWNPATQRMRPRASFDAWKETVTGRSLPWTSAERNCARELGEAIAAEMAQRTRAELARLRHYDPLTGLANRSYLQERLAQDGQSAAALLFIDLDRFKAVNDSMGHGVGDGLLIEVARSLVATVRPHDLVVRLGGDEFVVLCHRLDAAGIVSLAERLRQVLEQPFEVAGRKCHISASIGIAMADSIGDLDLVRAADIAMYAAKKNGGNRGELFRPSLYEETTQLVELDNDMRGAIESEQFHLVYQPIFALNPETERLVGFEALLRWDHPLHGALQPGIFIPLAERLGHIHAMGNWVLRRAILQLQAFRSAGPELDLKMNVNVSPLQLARPDFLARLADLLAQVPDLPRHALCLEITETSLSDEAVSEALISIRALGVRIAIDDFGTGFSSLACLRRLPVDVAKLDRAFLGGGHTAAQDHRFFAAVTGLVHAADLKVVQEGIETLDQLALVRAAGADFAQGFHLAAPLSIAAALGLIAASRKE

SEQ ID NO: 34497 - protein, 421 aa, Thermococcus kodakarensis KOD1
MVEIDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPWTDIPAPDVYTNPKIMAWMMDEYETIMRRKGPAFGVITGKPPGVGGIVARMDATARGAAFTIREAAKALGWDDLKGKTIAIQGYGNAGYYLHKIMSEEFGMKVVAVSDSKGGIYNPDGLPPADEVLKWKKEHGSVKDMPGTQNITNEELLELEVDILAPSAIEGVITKENADNVKAKIVAEVANGPVTPEADEILHEKGILQIPDFLCNAGGVTVSYFEWVQNINGFYWTVEETRKRLDDKMTKAFWDVFNTHKEKNIHMRDAAYVVAVSRVYEAMKHRGWVKK

SEQ ID NO: 34498 - protein, 357 aa, Vibrio fischeri ES114
MSKQQKILFIDRDGTLIVEPPVDFQVDRLDKLKFEPLVIPSLLSLQDAGYRLVMVTNQDGLGTDSYPQDEFDAPHNMMMEFFESQGVKFDDVLICPHFEEDNCSCRKPKLGMVKEYLQGGRVDFQHSVVIGDRQTDLQLAENMAIRGIQYHPETMNWPAILKDLTVNARTAEVIRTTKETDIKVFVNLDEQGGNEITTGLGFFDHMLDQIATHGGFQMKINVEGDLHIDDHHTIEDTALALGEALKEALGDKRGIGRFGFSLPMDECLAQCALDLSGRPYLKFDAEFSREQVGDLSTEMVVHFFRSLTDTLACTLHLSSSGYNDHHIIESLFKAFGRTLRQAIKVEGNELPSSKGVL

SEQ ID NO: 34499 - protein, 206 aa, Vibrio fischeri ES114
MSQQELATRIDWEKVDGLVPAIIQDFGSSQVLMMGYMNQDALAKTLETEKVTFFSRTKNRLWTKGEESGNSLNLVNISLDCDNDTLLIKVNPVGPTCHTGTTTCWDGDKTEETQLVWLHQLEQLLAERKNADPDSSYTASLYARGTKRISQKVGEEGVEVALAATSGDKAELVCESADLIYHLFVLLQDQGLSFDDVINKLKERHK

SEQ ID NO: 34500 - protein, 151 aa, Oryza sativa
  misc_feature (50)..(51): Xaa can be any naturally occurring amino acid
  misc_feature (55)..(55): Xaa can be any naturally occurring amino acid
  misc_feature (59)..(59): Xaa can be any naturally occurring amino acid
  misc_feature (61)..(61): Xaa can be any naturally occurring amino acid
  misc_feature (63)..(63): Xaa can be any naturally occurring amino acid
  misc_feature (82)..(82): Xaa can be any naturally occurring amino acid
  misc_feature (86)..(86): Xaa can be any naturally occurring amino acid
  misc_feature (95)..(95): Xaa can be any naturally occurring amino acid
  misc_feature (98)..(98): Xaa can be any naturally occurring amino acid
  misc_feature (100)..(101): Xaa can be any naturally occurring amino acid
  misc_feature (105)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (116)..(116): Xaa can be any naturally occurring amino acid
  misc_feature (121)..(122): Xaa can be any naturally occurring amino acid
  misc_feature (124)..(124): Xaa can be any naturally occurring amino acid
  misc_feature (127)..(127): Xaa can be any naturally occurring amino acid
  misc_feature (130)..(131): Xaa can be any naturally occurring amino acid
  misc_feature (134)..(134): Xaa can be any naturally occurring amino acid
  misc_feature (137)..(137): Xaa can be any naturally occurring amino acid
  misc_feature (140)..(140): Xaa can be any naturally occurring amino acid
  misc_feature (148)..(149): Xaa can be any naturally occurring amino acid
FVPPRVDPPRYIHRRDRADISSRIGSRPARAAFAHPSAQADAHRAWGEKXXSDGXPVLXGXDXVGNENDLHLVDLARFAVTXHNKXANSLLEFEXLVXVXXQVVXGXLXYFTIEVXEGDAXXLXESXVWXXPWXDFXELXDFKPVHAXXNA

SEQ ID NO: 34501 - protein, 175 aa, Pseudomonas syringae pv. phaseolicola 1448A
MTTANTAISALVVMGVSGCGKSAVGAEIARNSGGRLIEGDAFHPPANIEKMSAGTPLNDDDRAGWLTRLGEEMAAALANGEHPVLTCSSLKLIYRQRLRDAVPGLGFVFLELTKELAAERCSHRPGHFMPASLVDSQFATLEPPYGEPLTLIVDASQPIDVIGKQAAAWWKDSHA

SEQ ID NO: 34502 - protein, 365 aa, Pseudomonas putida
MPAHSFRIAAIPGDGIGLEVLPEGIRVLEAAALKHGLALEFDTFEWASCDYYLQHGKMMPDDWAEQLKQYDAIYFGAVDWPDKVPDHISLWGSLLKFRREFDQYVNIRPVRLFPGVPCALANRKVGDIDFVVVRENTEGEYSSLGGIMFENTENEIVIQESIFTRRGVDRILKYAFDLAEKRERKHVTSATKSNGMAISMPYWDKRTEAMAAHYPHVSWDKQHIDILCARFVLQPERFDVVVVASNLFGDILSDLGPACAGTIGIAPSANLNPERNFPSLFEPVHGSAPDIFGKNIANPIAMIWSGALMLEFLGQGDERYQRAHDDMLNAIERVIADGSVTPDMGGTLSTQQVGAAISDTLARLD

SEQ ID NO: 34503 - protein, 201 aa, Methanopyrus kandleri AV19
MNSVRTADVKRTTKETEVEVSVNLDGSGRAKVDTGLPFFDHLLHQFAFHGRIDVEIKARGDLEVDDHHTVEDVGICLGKALNEALGDREGIRRIAWALVPMDEALVECAVDISGRPYFVLKGYRPRRNRIGSPPLSTENVSHFWKSFCDHAGVTMHVVVRWWDNDHHAIEAMFKAVGRALGAAKEIVGDGVPSTKGTLRRG

SEQ ID NO: 34504 - protein, 498 aa, Yersinia pestis CO92
MSEYHEKNNALFKSITALDGALFINGEFRKGAGGRLPVENPATGKVIGHLAAATPEEIEEAVAAARRAFPAWAAERPKARANALHRLGDLIAGDALNMARNMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVTACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYVYARDLAAIHRLSAALDYGNVAINNVDASMMNAPYGGRKQSGVGYEHGREGLLEYFNFKHIRLYHGIGD

SEQ ID NO: 34505 - protein, 557 aa, Burkholderia mallei ATCC 23344
MSTPTDISPPIALERDAVLDQAHVGDIKGAFGTIAHHDTAPRSGWWARVRTLLAILGPGLIVMVGDNDAGAFGTYTQAGQNYGTSLLWTLLLVPVLFVNQEMVLRLGAVTGVGHARLIFECFGKFWGAFSVIDLFILNALTIVTEFIGITFVLDFFGVSKVAGVCIAAALTMAAVSTGDFRRFERFAVALCVLSLLLVPVLVSIHPPVHQMARDLFVPTWPAHAKRSDVMLLVIGIVGTTVAPWQLFFQQSYVIDKRITPRFIKYEKADLWIGIVLVMIGAIAMISFSAALYAGRSEAGGFTDAGGVIAGLAKYAGPTSATLFAIALLDACIIGAAAVSLATAYAIGDVFRIRHSLHRGVSDAKGFYLVYFGIVAAAAALVLMPGSPLGLLTEAVQTLAGVLLPSATVFLLLLCNDRAVLGPWVNSARLNLFTGAVVWVLVMLSIILTASVMYPDMSGEAMLEVLAGGTLFAALGLAATFVLRRRAGCADRANVAHDARDAHVDRAARDTWRMPPLDALPAPRVTLSTRIWMGVLRGYLVLAVGLVIVKVVQMAFFR

SEQ ID NO: 34506 - protein, 236 aa, Yersinia pestis CO92
MSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 34507 - protein, 321 aa, Bordetella bronchiseptica RB50
MNLPELIAPIADDMKAVDAVIRDRLNSDVVLIRTIGDYIIGAGGKRMRPAMVLMVARALGYQGTHHQLLAAVVEFIHTATLLHDDVVDESDLRRGRDTANAVFGNAASVLVGDYLYSRSFEMMVEADSMRIMQILSQATTVIAEGEVLQLLNVHDPDVSQERYLQVVRYKTAKLFEAAAQVGAVLAGASPEQETAAAAYGRHVGAAFQLVDDVLDYSGDAHALGKNVGDDLREGKPTLPLIRVMETGTPEQRELIREAIKTGQADFAAVAQAIQATDALAHARQAAENEAELARQALSAFPVSLYQKSLLEFCAFAVNRDR

SEQ ID NO: 34508 - protein, 81 aa, Oryza sativa
MSGRGKGGKGLGKGGAKRHRRVLRDNIQGITKPAIRRLARRGGVKRISGLIYEETRRKTVTAMDVVYALKRQGRTLYGFGG

SEQ ID NO: 34509 - protein, 469 aa, Aquifex aeolicus VF5
MPKYTPEEVLDLIQKEGVQYVDLRFSDPFGQWQHLTIPAYEISKETFEVGRGFDGSSIRGWQSINESDMLAKPDPNTAFIDPFIEPKTLVMICDIYDPVTGERYGRDTRYIAQKAEQYLKQTGIGDTAYFGPEAEFFIFDSVEFGTAANYAFWRVDSEEGWWNREVPSSGYKIPHKRGYFPAPPVDKMMQLRNEMVSIMSDLGIIVELHHHEVATAGQGEIDIRYDSLLNQADKLFLYKYIVRMVAAKHGKYATFMAKVLPNDNGSGMHTHFSIWKNGENLFAGSEYAGLSKTALYAIGGILKHGPAIAAFTNPTVNSYHRLVPGYEAPVRLAYSARNRSAAIRIPMYSQNPKAKRIEVRFPDATSNPYLAFAAILMAAIDGIENEIDPGEPFDKDIYSLPPEELEGIPQLPGSLEEALKALEEDYEFLLKGNVFTEEFIQLWIESKRAEIDELRFIPHPKEFELYWDI

SEQ ID NO: 34510 - protein, 218 aa, Triticum aestivum
MEWAYSGGGHSSSGTKSPAAGGREEGSYMTVSSAPPKRRAGRTKVRETRHPVYKGVRSRNPGRWVCEVREPHGKQRLWLGTFDTAEMAARAHDVAALALRGRAACLNFADSPRTLRVPPQGAGHEEIRRAAVEAAELFRPEPGQRNAATTEAPAASPADAGNAELVANSPYHLMDGLEFEMQGYLDMAHGMLIEPPPMAGPSTWIEEDYDCEVSLWNY

SEQ ID NO: 34511 - protein, 463 aa, Listeria monocytogenes EGD-e
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPLYPVLPIVSFLLCAFLISRLSVHTWILCGIWFVIGLIVYFAYGRKHSELLKK

SEQ ID NO: 34512 - protein, 118 aa, Calonectria pteridis
RSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTLQSKDIQL

SEQ ID NO: 34513 - protein, 247 aa, Mycobacterium sp. JLS
MLGHMTDSKIILVTGASSGIGAAVATHLARAGHHVIAGARREDRLRELADGAADLERGSLSVRRLDVTDRAEMAAFVDDAVSTHGRIDVLVNNAGIMPLSRLDALLVDQWDAMIDVNVRGLLNGIAAALPHFHRLGGGHFVTVASIGAHEVVPTSAVYSATKYAAWAITEGLRQESDPSIRVTTVSPGVVESELASTITDPGAAAAMQEYRAAAITPDAIARAIAYAISEPEEVDVNEVIVRPARQR

SEQ ID NO: 34514 - protein, 231 aa, Brassica napus
MWRYVWSLLLLFVVCKDTIFMAKSAAILLPSQTGVDDSVCSAPDPSLNYKPVIGILTHPGDGATGRLNNDTNASYIAASYVKLAEAGGARVVPLIYNEPEELLFQKLELVNGVIFTGGWAKKGLYFDVVKKIFTRALERNDGGEHFPVYAICLGFELLTMIISQNTDIFEKVDAKNAASSLQFVEIVSIQGTVFQRFPPELLKKLTTDCLGMQNHQFGISPDNFEGNIALS

SEQ ID NO: 34515 - protein, 517 aa, Aspergillus nidulans FGSC A4
MLFLSVLLAFAAYLLIYQYAMTNWNHARRARLWGCSPLPRYPTDILGLATLRESLKADKEKKIPLLLQNRLKRMSAREKRPVTTFVIRQMGLDNIFTCDHGNVQAILATKFKNFELGVGRRHTLYPMFGVGIFTSDGETWSRSRALLRPQFTRDQISDLDLEESHVQQAMRAMNVDPATGWTSSIDIQAIMFRLTIDSATEFLFGESAGSQAEALRNGGTLPLNHFSGDFDLGQWYVAQRSRFEKFYWLVDNRESRAVVKRVHEYVDRFVHAVLTTAEDRIEKSQSSSYVFLEALAASTKDPIELRSQLLNILLAGRDTTASLLSWSILMLARYPEVFTKLRSVILADFGSYTSSRDKITFASLKSCRYLQYFLNEVLRLYPAVPINRRVATTATTLPKGGGPAGDKPIYLRAGQVVTYSPFVTHRRTDLWGEDAEVFNPERWVNKKVGWEYLPFNGGPRVCIGQQFALTEAGYVIVRLLQRFDAIMDCFPEREIRYGLTLTLAPADGVFVRLHAAE

SEQ ID NO: 34516 - protein, 149 aa, Arachis hypogaea
MAEQTFIMIKPDGVQRGLVGEIISRFEKKGFYLKGLKLITVDRPFAERHYSDLSAKPFFNGLVEYIISGPVVAMVWEGKGVVATGRKLIGATNPLASEPGTIRGDFAIDIGRNVIHGSDSVESATKEIALWFPEGPANWQSSLHSWIYE

SEQ ID NO: 34517 - protein, 1696 aa, Coprinopsis cinerea okayama7#130
MLAFVHPSGSSAHSPSSSSSATSSSSSAASAAMNGAKHLPIVHRKPSSGGAFRSSSSTSMHTPAYSSSSSTPSASTSTGHSPSSSTTSRHRPAVQFAYPGPPSSRASTSSSRHSDPIQNQAPAHASSSSATTSNVSSSSSTTSAGPPAPSPSPTPSSSSTSYDISAYSSTDLLKLLASLLTQIAATNDALTSSSSSSSSSSPTSPHPPSTNRSPRSSSFPHSSSSSHPSTPSSSSATHHNQRQHPPIWYTLTTASRTALSTPTSTLTFHARNIPSISLEAYLLRILKYCPTTNHVFLSLLVYFDRMARLSGEIEGDIDEDAEDEFGSVGTHGIGDEGDRDVEMRGGSVTGDSSTKMDVDTDLSASAVAPPRKRAKRRRPQRSFVIDSYNIHRLVIAGVTVASKFFSDVFYTNGRYAKVGGLPLHELNQLELQFLLLNDFRLVISGAEMQRYAEQLILFSKSQSNPIVLRMERSLGEAGSLNGSSYHKRSGSSGSTVSRDGKGEKDGNKEKRLNGTHSHHHPSHSSSTSSQSHQYSYAGGRNAAVASTSSNPVFVTQPQPPSMARGSQDGVVESRHTHVPLPPPPASSSSHQPSSSSSLAQPKGVQTPKFGAQAHRPTLTNGHHPHSFQHHQRQGEFSHYDASSDDEDDDHSYSERGFETGTESGSGFDTGTETETETEGETDAGETDASGSTTSDEPTVRPRKAYVRGRRESMGSMMGGGDEEGGVGGSEVRGEGEGSGGGEGEGRERGNERTPEVGRRSEDRDVGMDLLFTYSYSIYVGLHHGDLPAKTVIWNIMSTQSQSNSEGDFNSSSSSPFPSSNESAVGPDTPAVESSSDAPSGPVTTVSETTPPVSLSHSDVVSQNAQNLDRTDADTDEPPKKKLKITACNGREALQRVRMGGSTASGSRLSRSGKSNTSARRVKKEDGDDNGDKKKGGEKVVKEGVTDASGRVAKPRRRMGKLAGLVDLPLDVIYEIFSHLTPQDLLHLSRTTKDIRRRILSKNAVGVWKRVLEVQEEENEVPPCPGDMSPPAWASLVYEAYCHNCKTKNVRSVEWMLRTRLCDKCAKVLYRLMNEDQLDLEKKIDKLIRVCVPFQFRKMGKWCLISAKNAFVKELEAMEGDRDAFVEQRKQEVKELRKVGVHASLCARWTAKQEKIRRVELNKVHLDRKDFIMEKLKELGFEQEFEFLFALENMTPGKLAAPIPHSVLRFNWHPEIKISKPLSERVWNNRVKAVMVKYMEGIRPHREANDRSLQKAERRRQFAEKWLQWRTSPEIVKRYRPGVSLSPSIADVLEMSCVEEVIDWTPPTEEEKEEWDGPFRSIADTFYSNWRPSEDPLPTFFEDKNKLQALRSSIGSWQLGLVTKFLEISPFDDLFGLYRMNIDTQVHCISLAICVFECKHTYSDRHFYFAHAHDPDLRMEQFYSDKKNRHTCLWFPDILEHGCARFGKQTYDEKKVRWDEHLFTPHIFSGPDLTPSQQPTGYAVHERRKLKRTPFNLESMMFSKAASMVVKNILTACGFHWADTTTSMMDKENPRVVCLKCSFGNRCDGERSFKVYTWRNAVNHALAAHLDPRSVQWERISDEDEKTVKRREWLEHLIRDVEVPSRRDVKCLLCWGGKDEHGLMTEDEMKEHLKTIHGKTDEQVNAAEAKGTLWFEEQNIPPQQPRFVITHKPRAIPEGPQVPKTKQTFTRGKDWIC

SEQ ID NO: 34518 - protein, 122 aa, Arabidopsis thaliana
  misc_feature (114)..(114): Xaa can be any naturally occurring amino acid
VSKGAKEEEKKKEVVRVSSMLSSAAGVTSRAQATRVVPLTGWKSSVAFRVTGKTNKDIISMASKGGRVSCMKVWPPMGKKKLETLSYLPDLSDVEWVKEVDYLLRQPRWISLGXIELEHGLV

SEQ ID NO: 34519 - protein, 573 aa, Pseudomonas syringae pv. phaseolicola 1448A
MSRRKRRLEKMTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMDNLLDFQKRLAQKTADVSGWTAGTEAFPQLLDVVTNAGATVLIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLEAIERNFWLPGYRAYRRRSV

SEQ ID NO: 34520 - protein, 164 aa, Arachis hypogaea
MSVRSRTRMAAELEQVFHKFDVNGDGKIDASELGAVMGSLGQKATEQELINMLREVDGDGDGYISLQEFIELNTKGVDSDEVLENLKEAFSVFDIDGNGSITAEELNTVMRSLGEECTLAECRRMISGVDSDGDGMIDFEEFRVMMMMGSRHDTTNRVLPDPDY

SEQ ID NO: 34521 - protein, 283 aa, Rhodospirillum rubrum ATCC 11170
MTEWFSETLHPHWRQSFAADRVLLREQTAHQDLVILENQTFGRVMVLDGMVQLTERDEFVYHEMIAHVPLFGHGAARRVLIIGGGDGGTLREVLRHKTVERATMVEIDATVVEMARDHMPMVSDGAFDDPRAELIIADGIAFVAGAHQPYDVIIIDSTDPFGPAEGLFTPAFYGACRQLLTPGGVLVVQAGVPFLQPREIAHVNAALSAAFPEVAFYAIAVPTYVGGLMTLGWASEDAGKKVPDPAVLAARVAASGLAFGYYSPEGHAGAFALPPHIRAAARG

SEQ ID NO: 34522 - protein, 853 aa, Oryza sativa (indica cultivar-group)
MAYLGGDPGRGGGAPPGMTPWPGPPPQPGQPAVVYTALHQGAYQPGVAQVVYWAPSPGAPSLGGIRAPPAPYQPAQVAAPQAAAPFAAALAKEVEQKLFVTENALGPPAAAAAVSKKGPAHPGRPGYGAAGKKVMIHENNFLHNVVDNNLFHNDEMINGGTEEPRFCGGLIQMCNVENALRDVQRRTTELPVRYAQGSHKSEKIHSGTVLDSQIGLLGEIDSNINATGLQHTHDLMKKMKFAASATPHPRRVLAVALALMVAFAVGPMVALAKCEQQAHAVASLCGGTGIYARCCFALKRSLDGGDPLCLCSLANNREVAEMGLNSTRILSLYRKCEGNVFPVLPAGGCEEVPALSPSPPPLHGSVMPPPLPPATVEPVISAPMVEPPPPPAMITPLPPSTPVFTLPPPPPVTTAPSTALPAGASAAAPSTGVLRRIYQALIGLLCLVAGFLLVAVFVVVRKYWKPQLNNDVEMGSSNAADQSAIENAKKAAAEAQSSAEAAASAAAGSLATAQAASGAAQAAQAATEEVVTVQANAAEQAVLFVEALGRAAQQISTCTITLGQLLQLVSQIIQAVRAAQGGAASAAAAITGLFARFGEIFGRVGAATAFVEAQAVAAQGAPSDLIDIDCINRPGGDRGVSSFDEGGSNEDEDEANVERSTSRTSNRIRKSNVRYSEDVWVLDPPARASITEGTQLSRDPDLPDAAYHRLPQPKDSERVKNYIPKHPAVTPASFPQIQAPVVSNPAFWERMGGDSLSTVLFFAFYYQQNTYQQFLSARELKEQSWRFQRKYNTWFQRHVEPQVTTDELSAKSLTHNLWKKTAKSDGCRNSNSSRTKLEFRETKNRVKQSVCAA

SEQ ID NO: 34523 - protein, 262 aa, Mycobacterium sp. JLS
MKLTGYTALVTGASGGIGEEFATRLAADRVNLILVARRTERLEELRGRLLERHPGIDIDVLSADLGVPGAAAALAQQVDALGRRVDVLINNAGIGLHGSFAEQDPAANAAQIQLNCVTLVELTGYFLPAMIAAKRGVVLNVGSTAGFQPVPSMAVYGATKAFVLSFSEALWQETRGSGVKVLTLCPGATETEFFDRTGKSFMTRGRQSSAQVVDTALKALDRPFPTVVSGLHNRILALGYRIAPRPVLAMVSEQLMKASGQR

SEQ ID NO: 34524 - protein, 308 aa, Arabidopsis thaliana
MMMMTSLGGGAGGGGGGGGSGGGRFVTYPPPLSVPPSAPQSPNFSGGLRSQPSFLVEQEKYLSELLAERHKLTPFLPVLPHVCRLMNQEILRVTTLLENALSQSRFDHPSPLASGGIFQNSRADMNGWASQFPSERSVSSSPAPNWLNSPGSSSGLIVKRTIRVDIPVDKYPNYNFVGRLLGPRGNSLKRVEASTDCRVLIRGRGSIKDPIKEDMMRGKPGYEHLNEPLHILVEAELPIEIVDARLMQAREILDDLLTPVEETHDFYKKQQLRELALLNGSLREEGSPMSGSISPYNSLGMKRAKTRS

SEQ ID NO: 34525 - protein, 176 aa, Burkholderia sp. 383
MSSRRIAVRRSGVHGKGVFAVAPIKAGERVVEYKGERISWKEALRRHPHDPSEPNHTFYFALDEGGVIDGKIDGNSARWINHSCAPNCEAEEVKGRVYIHALRDIGAEEELFYDYGLVIDAKLTKTLKREYACHCGAASCRGTLLATTDEGGKKKKKKDKKDGKSEPRSKDKKSKK

SEQ ID NO: 34526 - protein, 203 aa, Arachis hypogaea
MAKTLTFFSTLTVLFFLFSSYVTAKQPRFYRSISPTSLGLRKEKLSHLHFYFHDIVSGPKPTAIRVAEAQVTKHSPTLFGAVVMIDDPLTVGPEPTSKLVGKAQGIYASASQNDMGLLMVMNLEFSEGKYNGSTLSLLGRNAVLHTIREMPIVGGSGLFRFAHGYAQAKTHWDQYHFRGRHCRVQCLPVPLIDPSIFLCFFSV

SEQ ID NO: 34527 - protein, 275 aa, Cyanothece sp. ATCC 51142
MRFRTLLIAFLALCLGLITACSEGPANAVNPQDLTYDEILNTGLANKCPQISEFTRGSIPIEPGQTYFVDDLCLEPQEYFVKEEPVNKRQEAEYVPGKLLTRYTTSLEQISGKITVDEDGVVTFYEEGGIDFQPVTVQLPGGEQVPFFFTIKNLVGKTEPGFSSINSSIDFEGDFRVPSYRGATFLDPKGRGLATGYDNAVALPATADKEDYANVKQTPIGKGSISLQVTKVDQATGEIAGVFDSEQPSDTDLGAKEPVEVKIRGIFYARVTPEA

SEQ ID NO: 34528 - protein, 444 aa, Bacillus cereus ATCC 10987
MFKWLKPAPAIERLPADMIDRVYRLLRIRVLIGISVGYAAYYLVRSNFTLSSTYLVQEYGFSTAQIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADHANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKAA

SEQ ID NO: 34529 - protein, 352 aa, Cochliobolus heterostrophus
MYQNKSLIFKNPPIGWPKPDVDFGVECRPIDINGDIPLGGVILKNCYVSLDPYQRGRMRAPTVDSYSPPFTIGDPMEGHVISRVIRSASTKLQPGDFVSGVGPIQEFSVLSAGVVDGFTRIENPYNLNLEIFLGPLGMPGLTAYSSFYEIGKPKKGETIFISAASCAVGQLVGQLAKREGLYVIGSVGDDEKVEFITKGLGFDVGFNYKKEVIGEALMRVAPEGIDIYFDNVGGQTLESALYAMRPRGRIVVSGMISQYNLQPSELYGVKNLFMVITNRITIQGFIVTDSDMGPKYSAEHLKNVSQWIYDGSLKPKIHVDTGMDHACQSFINMLKGRKIGKAVLQIADLNGD

SEQ ID NO: 34530 - protein, 167 aa, Coprinopsis cinerea okayama7#130
MEDMEKRSNFTQAELERLKKRFMKLDSDGSGSIDRDEFLSIPQIATNPLASRMIAIFDEDGGGTVDFQEFVGGLSAFSSRGGREEKLKFAFKVYDVDRDGYISNGELFLVLKMMVGNNLKDQQLQQIVDKTIMEADLDGDGKLSFEEFAQTVSNTDIVKQMTLEDLF

SEQ ID NO: 34531 - protein, 392 aa, Pseudoalteromonas tunicata D2
MSEAQAVSGIAQGNTTKKKINLLDLNREGMRELFVSFGEKPFRGDQVMKWIYHFGVDNFDEMSNINKKLKARLERECEIVAPEISAKQVAADGTIKYALLLEGGQEVETVWIPEKERATLCVSSQVGCALECTFCSTAQQGFNRNLKVSEIIGQVWRVAKDIGLYGDSTRRPVTNVVMMGMGEPLLNINNVVPAMELMMDDWAFGLSKRRVTLSTSGVVPALDILKERIDVALAISLHAPDNALRDVLVPINKKYPIEEFLAACRRYIDGSKANKDVTVEYVMLDGINDSMEQAHQLVETLKGTPSKVNLIPFNPFPGNEYGRSSNSRIDRFSKILQAAGITCIVRRTRGDDIDAACGQLVGDVVDRTKRLAKRQLQKENEIAVTMVSNPNS

SEQ ID NO: 34532 - protein, 143 aa, Pseudoalteromonas tunicata D2
MALERTFSIIKPDAVAKNHIGAIYNRFESAGLKIVASKMVHLSKEKAEGFYAEHSARPFFGALVSFMTSGPVMVQVLEGENAVLKNREIMGATNPADALAGTLRADYADSIDENAVHGSDALESAAREIAYFFSDEEICPRTR

SEQ ID NO: 34533 - protein, 307 aa, Corynebacterium glutamicum ATCC 13032
MSNSTGTDIVVVGSINADLTAKVQRHPEPGETLLGSGGTVSAGGKGANQAVAAAQLGAKVTMIGAVGTDQMAGEALTHLRQSGADMSAIATVDGPTGLAIITVSDDGENTIIVIPGANASVTAEFVDKHSQLIENAGIVLLQGEIPADGFERAVDLSQGRVVINLAPVVPVGHDQLRRADPLLVNEHEGALVLDMLGTPATTSDPQSLVTELLEQGFTSVVMTLGAEGALVGTPGQLTAIPTPKIQAVDTTGSGDAFAGALVAKLSEGAGLIEAATFAARVGAYAATRPGAQASYPTLTTDLPSTTH

SEQ ID NO: 34534 - protein, 503 aa, Yersinia pestis CO92
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 34535 - protein, 449 aa, Pseudomonas syringae pv. phaseolicola 1448A
MFGFFRPARHQAPLPEEKVDSTYRRLRWQIFAGIFIGYAGYYLLRKNFSLAMPYLIDEGYTRGQLGVAMSAIAIAYGLSKFLMGIVSDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDASHEEEFSAREIFVKYVLRNKFLWYIAMANVFVYLLRYDVLDWAPTYLKEAKHFTVDKTSWAYFLYEWAGIPGTLLCGWMSDRIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMAFLAPTLRHKQVASTSRDTKD

SEQ ID NO: 34536 - protein, 355 aa, Yersinia pestis CO92
MGQQLLSHQSVSSQWLANQSATSTLPLLDLSLLSGSDTERQAFLTALRHAARDVGFFYLTGHGIDTSLLRQIQILSRQFFALSDEEKLSIAMIRSPHFRGYNRAASEFTRGQPDWREQFDIGAERTPLPQIAGAPSWTRLQGPNQWPTALPELKPVLLQWQEEMTRMSLRLLRAFALALDLDEQAFDALYGDKPNEHIKLIRYPGREATQSGQGVGAHKDSGFLSFLLQDTQRGLQVEVEEGQWIDAVPREGTFVVNIGELLELASNGYLRATVHRVETPPAGIDRLSIAFFLGARLDAVVPLYPLSAALAAEARGPASDPHNPLFRDVGLNYLKGRLRSHPDVAERYYSDALCS

SEQ ID NO: 34537 - protein, 1271 aa, Arabidopsis thaliana
MAEAVVSFGVEKLWELLSRESARLNGIDEQVDGLKRQLGRLQSLLKDADAKKNETERVRNFLEDVKDIVYDADDIIESFLLNELRGKEKGIKKQVRTLACFLVDRRKFASDIEGITKRISEVIVGMQSLGIQHIADGGGRSLSLQERQREIRQTFSRNSESDLVGLDQSVEELVDHLVENDSVQVVSVSGMGGIGKTTLARQVFHHDIVRRHFDGFSWVCVSQQFTRKDVWQRILQDLRPYDEGIIQMDEYTLQGELFELLESGRYLLVLDDVWKEEDWDRIKAVFPHKRGWKMLLTSRNEGLGLHADPTCFAFRPRILTPEQSWKLFERIVSSRRDKTEFKVDEAMGKEMVTYCGGLPLAVKVLGGLLAKKHTVLEWKRVHSNIVTHIVGKSGLSDDNSNSVYRVLSLSYEDLPMQLKHCFFYLAHFPEDYKIDVKILFNYWVAEGIITPFHDGSTIQDTGESYLEELVRRNMVVVEESYLTSRIEYCQMHDMMREVCLSKAKEENFIRVVKVPTTTSTTINAQSPCRSRRLVLHSGNALHMLGHKDNKKARSVLIFGVEEKFWKPRGFQCLPLLRVLDLSYVQFEGGKLPSSIGDLIHLRFLSLYEAGVSHLPSSLGNLKLLLCLNLGVADRLLVHVPNVLKEMQELRYLRLPRSMPAKTKLELGDLVNLESLTNFSTKHGSVTDLLRMTKLSVLNVIFSGECTFETLLLSLRELRNLETLSFHDFQKVSVANHGGELLVLDFIHLKDLTLSMHLPRFPDQYRFPPHLAHIWLIGCRMEEDPMPILEKLLHLKSVYLSSGAFLGRRMVCSKGGFPQLLALKMSYKKELVEWRVEEGSMPCLRTLTIDNCKKLKQLPDGLKYVTCLKELKIERMKREWTERLVIGGEDYYKGLKHICLEKSRGAFLRRSIDDIIFELVPAKSIARFRCVSESIHRRPDVTEQSLTKSMSRPRLLFALEVNKDLLFFSSPQPQNPYDNSSLVATPYKRFPKYLPTRICTTLGGLVFLQKWLRKKTRVICNPVSGDYITLPKVKATGVGESYFGFDPITKQFKVLCMTWSRYGTPNTHQVLTLETGKRLWRTIQDPILPHYRSFDRICINGVLYYGADFEESQSSKIVCFDFRFEKFSFINIADEGMFRGSYKWTLFNYKGKLGAHQYSRNGELVLWVLEDAENHKWSKSICILPPIVHNSRIVGVTGTGEIANYESNYAFSLPYFKTLTNYAFSLPYFKTLTNYAFSLPLGFHACASMPKSVALIALEDANGSVRLRTVQM

SEQ ID NO: 34538 - protein, 199 aa, Coccidioides immitis RS
MSFATSTWEGICARYPPGWIEGVGSAAVQFFGFILPGLGFLAFDILKPASFASRKIQQPCKQPSKQQMLSCLGLVFGNQLFLIASHFFLLRISNYELTPFRMDSQLPSILEVVINCAVGAILRDVVFYYVHRLMHTKILYRRIHRIHHEFRAPIALAAIYSHTIDHVLVNAMPIYISMAVQRRVFLVPSAKRRKPRYSS

SEQ ID NO: 34539 - protein, 131 aa, Elaeis guineensis
MADPIRRTDEYGNPIPEHQGHGGAVTGGTYGTTTTPHEGVLHGEGGRQQQVHPGKEEHPGGRHHRSGSSSSSSSSEDDGQGGRRKKGLKEKIKEKLPGGGHKSEEHGQTDEGQHEKKGMMEKIKEKLPGHH

SEQ ID NO: 34540 - protein, 724 aa, Kluyveromyces lactis NRRL Y-1140
MSNSLRRSSASSSSSQGKPGRNGSGNGSYSQINSSLHARVKAFQEQRQLKRSGSIHSNQSQNSVQIEQIVNKPLPPLPPKTMVEEAENSQQLEQQQQQQHNIQIQQTQQQQQRQPILKQQDQHLQHLQHTELLAQSVTENDQHDQQQQQQGGLLLSPKTELPDIEEKKGQFEKQTQEALANLSIQSDGMSSASESSGSASNKQQQDHELNPIRKAPKRPQGVPSCTGSGNAGAPSPIGGVGGSQAAAGTFRPPAAAGGVVMPNQPRLSQGQPHLQKAKQSLSARRGLKLPTGGMSLKMKPTHQQQQLAPQHTHQEFAGAPSNSALPLQGKRSNPGSLINGIQSTSTSLANSSHDTLGTDPKSNPTSNSNSGIGGLFANFSKYVNIKSGSLNFAGKLSLSSKGVDFSNGSSFRIKLDELEFLEELGHGNYGNVSKVLHKPTHIIMAMKEVRLELDESKFRQILMELEVLHNCQSPYIVDFYGAFFIEGAVYMCMEYMDGGSLDKTYDDEQIGGIDEPQLARITSSVIQGLKELKDVHNIIHRDVKPTNILCSASQGTIKLCDFGVSGNLVASLAKTNIGCQSYMAPERIKSLNPDKSTYSVQSDIWSLGLSILEMALGAYPYPPETFDNIFSQLSAIVDGPPPKLPEGKFSADAQNFVSMCLQKIPERRPTYAALLEHPWLKKYENVDVRMSEYITNRLNKKRELLEQTGEGPPKHVPALHMGGL

SEQ ID NO: 34541 - protein, 513 aa, Solanum tuberosum
MIMTAATVVIAAIVVILVAYFVGKVLYTVWWWPKMIEIKLKKEGIHGEPYKLLFGNFKEMMKMSKEAKKQPLLNHDIIPWVNPFLLRLSNTYKKIFVVWYGPTPRVTVTDPKLIREVLNRYNEFHKPEANAFIHLFVSGLGSYNGEKWDTHRKILNPAFHVERLKRMFPAISVCCDEMINRWDKLVSKEGSCELDVTDEFLNLSGDVISRAAFGSNIEEGRSIFLLQKEQCELIFASPFTLFFPSLRFLPTASNRKAKYIHKKVISLIRGIIEKREDAVRRGVSENDDILGLLLKARNEENAAGRGSVSLSTDDVIEECKQFYFAGQDTATALLSWTLVVLSMHPEWQDKARNEVFQVIGKNKPQFDDLNQLKLMNMIFQEVLRLYPAIFLIRGTSKDTQLGDMTIPPGVQVCVPTHLVHRDPQVWGDDALMFNPERFSEGVTKAAKEQLYFPFGWGARMCIGLNFGMLEAKLIFAQILQHFWFELSPSYTHSPQLILVMKPQYGAQIILHKL

SEQ ID NO: 34542 - protein, 210 aa, Capsicum annuum
MAKTTALLLSLVLFIIAAVANAQQCGRQRGGAVCSGSLCCSQYGWCGSTPEYCSPSQGCQSQCGGSVPTPTPGGGGASAQNVRATYHLYNPQNVGWDLNAVSAYCSTWDANKPLAWRSKYGLTAFCCPVGPRGRDSCGKCLRVTSANTRTGAQTIVRIVDQCGNGGLDLDVNVFRQIDTDGVGNQRGHLIVNYQFVDCGDNLNVSLVIYG

SEQ ID NO: 34543 - protein, 519 aa, Rhodospirillum rubrum ATCC 11170
MAGPKPPFYLTTPIYYVNDKPHIGHAYTTLACDVLARFKRLDGFDVKFLTGTDEHGQKVQKSATAAGIDPQTFTDRVSANFRDLAAAMNFSNDAFIRTTEPRHKEACKALWTLLVERGEIYLDAYRGWYAVRDEAFYGEDELTTAADGSRLAPTGAPVEWVEEPSYFFRLSKWQQPLLDLYAARPDFIAPDSRRNEVISFVKGGLTDLSISRTTFSWGVPVPGDEDHVMYVWLDALTNYITAVGFPDQTGDYARYWPANLHMVGKDILRFHTVYWPAFLMAAGLEVPGRVFAHGWWTNEGQKISKSVGNVIDPRALIETYGLDPVRYFLLREVPFGNDGDFSHRAMINRMNGELANDLGNLAQRVLSMIAKNCAGAVPEPGPFSEDDDALLAAAVALLDKVRQAMDRQAFHEALEAIWVVIRAANGYVDRQAPWALRKNDPPRMATVLYVLAEVIRRVALLMQPFVPASAARMLDQLGQGPEARDTTALGDRPLLAPGTVLPKPEGIFPRHVVDDEGAA

SEQ ID NO: 34544 - protein, 78 aa, Oryza sativa
  misc_feature (51)..(51): Xaa can be any naturally occurring amino acid
MAPTVMASSATSVAPFQGLKSTAGLPVRRRSTNSGFGNVSNGGRIKCMQVXPMGGIKKFETLSYLPQLTGRDFWKQIE

SEQ ID NO: 34545 - protein, 488 aa, Pseudoalteromonas tunicata D2
MFSPLSQPLVFTDSVIANQPFVTKTFITVDNPATEKLLTSVSCVDDAGIEHAVQSAELGFGTLKSMHSQARSDLLMRWYQLVIDYIDALAEIMTLEQGKPLAEAKGEVIYGAEFIRWFAEECKRSYGQQIPSNNNHQQLSTIRQPIGVVLAITPWNFPIAMITRKVAPAIAAGCSVILKPSELTPLSALALAHLAIRAGFPKGAFNVLLTDDAPSLVSKLLADHRVKKVTFTGSTQVGRILLAQAANTVKRTSMELGGNAPFIVFDSANLDQAVDGLIKSKFRNAGQACVATNRVLLDASIAGDFTAKLLTKVATLKTGNGLSNDTDLGPLINQAAKLRLVATIEQAICEGASWVFGETAFAEAKCSKDNFLPVVVLGNINQDMAIFQQELFGPVVLLSQFESEQQAIELANSTEYGLAAYFYSQNINQVHRVAESLTFGMVGINEGLISNAIAPFGGIKQSGLGREGGQAGLDEYLQQKYLCLNIKD

SEQ ID NO: 34546 - protein, 772 aa, Oryza sativa (japonica cultivar-group)
MLGRRVVMLPSAAAALGLRRGRARMRLGCVLEHVAPRLAVASAALLGAGEVIAAAAAAGKSGGAGHAAVASTLAQLTVTAVAIASGACLSTKVDFLWPRIEQLPDTLIFEGVEVTGYPIFEDPKVQKAIVFASTAHIGQFRKTGDPYVTHCIHTGKILAALVPSTGERAINTVVAGILHDVIDDTAENLKSIEEQFGDDVASLVSGVSKLSYINQLLRRHRQKNTGGSTLTSEEYFSYALPIRKAEAVAQETLAVWCSLASRLGVWALKAELEDLCFAVLQDLLQAVLPFDLLLDRKRRSYFLNNLHGSSETSVPKPKIVDDAAVALASLAACEEELEQELLISTSYIPGMEVTLSSRLKSLYSMYCKMKRKHVGIKQIYDARALRVIIGDKNGALHGPAVKNCYSVLDIVNRLWTPIDGEFDDYIINPKGSGYQSLHTAVQASDNSPLEVQIRTQRMHEYAEYGLAAHWLYKESKVDYRSGTSNKIGQSTSYPSSSSEDENYIQDVMPSKYSSMKMGHPVLRIEGSQLLAAVIVSIDKGGKELLVAVSFGLEASEAVAERRSCFQLKRWETYARVYKKVSEKWWCAPGHGDWSTNLEKYTLCQDGIFHKQDQFGRLLPTFIQLIDLTEEEEEEYWMVVSAIFEGKEASSLTPDSSNTERSTSEPPSSTPLSDPINNKVHLLRTMLQWEEQVRRGASLVEKSLSVGTCTEPILREVAIICWPYGKIMRMSLGSTAADAARRMGVEGKLLWVNGQLVLPQTELKDGDIVEVRM

SEQ ID NO: 34547 - protein, 399 aa, Zea mays
MLAAVMDYFSSCWGPRSGDGHRGKGPDAAGRQDGLLWYKDAGQLVTGEFSMAVVQANQLLEDQSQVESGSLSLADPGPQGTFVGVYDGHGGPETSRFINDHLFNHLRRFATEHKFMSADVIRKAFQATEEGFLSLVSKEWSLKPQIASVGSCCLVGVICAGTLYVANLGDSRAVLGRLVKATGEVVAMQLSSEHNACYEEVRQELQSSHPDDPHIVVLKHNVWRVKGLIQISRSIGDVYLKKPEYNREPLHSKFRLRETFQRPILSSEPQITEHRIQPNDQFVIFASDGLWEHLSNKEAVDLVQSSPHNGIARRLVKAAMQEAAKKREMRYSDLKKIDRGVRRHFHDDITVVVVFLDLNAMSKASWSKSPSVSLRGGGVTVPAKSLAPFSAPARLNSTY

SEQ ID NO: 34548 - protein, 462 aa, Volvox carteri
MALSMKMRANARVVSGRRVAAVAPRVVPFSSVARPVLRSTFAPEVSIDIRRAGRSRIVVEAVKKSVGDLGKADLEGKRVFVRADLNVPLDKKTLAITDDTRIRAAVPTLKYLLDNGAKVLLTSHLGRPKGGPEDKYRLTPVVARLSELLGKEVKKVDDCIGPSVEQAVASLKSGELLLLENVRFYKEEEKNDPEFAKKLASNADLYVNDAFGTAHRAHASTEGVTKFLKPSVAGFLLQKELDYLDGAVSAPKRPFVAIVGGSKVSSKITVIEKLMEKCDKIIIGGGMIFTFYKARGLKVGSSLVEEDKLELAKNLEAIAKAKGVQLLLPSDVVVADKFDANANTQTVSVEAIPDGWMGLDIGPDSIKTFQDALADAKTVVWNGPMGVFEFPKFAVGTVAIANTLSELTPKGAITIIGGGDSVAAVEQAGVAEKMSHISTGGGASLELLEGKVLPGVAALDEK

SEQ ID NO: 34549 - protein, 253 aa, Streptomyces coelicolor A3(2)
MADAPYKLILLRHGESEWNEKNLFTGWVDVNLTPKGEKEATRGGELLKDAGLLPDVVHTSVQKRAIRTAQLALEAADRHWIPVHRHWRLNERHYGALQGKDKAQTLAEFGEEQFMLWRRSYDTPPPALDRDAEYSQFSDPRYAMLPPELRPQTECLKDVVGRMLPYWFDAIVPDLLTGRTVLVAAHGNSLRALVKHLDGISDADIAGLNIPTGIPLSYELNAEFKPLNPGGTYLDPDAAAAAIEAVKNQGKKK

SEQ ID NO: 34550 - protein, 332 aa, Petunia x hybrida
GTSHLQLHIQQQPQQQSKSYRDIYNNMDGQISTPVAYFNCSNLPEQSQHPPYIPPFQVVGLAPGLVDDGGLDLQWNYGLEPKRKRPKEQDFLENNNSQISSIDFLQPRSVSTGLGLSLDNGRLASSGDSAFLGLVGDDIERELQRQDAEIDRYIKVQGDRLRQAILEKVQANQLQTVTYVEEKVIQKLREKETEVEDINKKNMELELRTEQLALEANAWQQRAKYNENLINTLKVNLEHVYAQSRDSKEGCGDSEVDDTASCCNGRATDLHLLCRDSNEMKELMTCKVCRVNEVSMLLLPCKHLCLCKECESKLSLCPLCQSTKYIGMEIYM

SEQ ID NO: 34551 - protein, 2228 aa, Kluyveromyces lactis NRRL Y-1140
MSIITPTAPITPPMESTGDRMITLELKDGTTLQGYSFGAETTAAGELVFQTGMVGYPESITDPSYEGQILVITFPLVGNYGVPDRKLMDEYVEGLPRYFESNRIHVAGLVIAHYTEEYSHWLAQSSLGTWLKESNVPAVYGIDSRSLTKHLREAGSMLGRFALQKPGTSFEDANSAEWMSYFETPEWVDPNVDNLVAKVSLKAPKLFVPNHPDIDLVQGPDGKTLRIVAVDVGMKYNQIRCFVKRGVELLVVPWDYDFTTEEYDGLFISNGPGNPAILQEVSDRLTKVLDAKKTPVFGICLGHQLLARASGASTLKMKFGNRGHNIPCTSTVSGRCYITSQNHGFAVDETSLTNGWKSLFTNANDGSNEGIYHSELPYFSVQFHPESTPGPRDTEFLFDVFIQSVLDFKQTGVLKQVEFPGGNIEENLAAHPREDVKKVLVLGSGGLSIGQAGEFDYSGSQAIKALKEEGIYTILINPNIATIQTSKGLADKVYFLPVTAEFVRKVILHERPDAIYVTFGGQTALSVGIEMKDEFETLGVKVLGTPIDTVITTEDRELFANAMDEINEKCAKSAAAATVAEALEAVKDIGFPVIVRAAYALGGLGSGFASNEKELVDLCNVAFASSPQVLVERSMKGWKEIEYEVVRDAFDNCITVCNMENFDPLGIHTGDSIVIAPSQTLSDEDYNMLRTTAVNVIRHLGVVGECNIQYALNPTSKEYCIIEVNARLSRSSALASKATGYPLAYTAAKLGLNIPLYEVKNSVTRSTCACFEPSLDYCVVKMPRWDLKKFTRVSTLLSSSMKSVGEVMSIGRTFEEAIQKAIRSTEYSNIGFSETDDELDIDYELSNPSDMRIFAIANAFAKFGYSIDQVWEKTNIDKWFLNKLYSLIKFSDKISSYGSKENLPALVLKQAKQLGFEDRQIAKFLNSNEVAIRRLRKEYGIIPFVKQIDTVAAEFPAHTNYLYLTYNAAAHDLDFNDHGVMVLGSGVYRIGSSVEFDWCAVTAVRTLRKNNFKTIMVNYNPETVSTDYDEADRLYFETINLERIMDIYELESSAGVVVSMGGQTSNNIAMSLHRENVKILGTSPEMIDSAENRYKFSRMLDQIDVDQPAWKELTSMDEAEDFAEKVSYPVLVRPSYVLSGAAMNTVYSKDDLESYLNQAVEVSREYPVVITKYIENAKEIEMDAVALDGELIMHVVSEHVENAGVHSGDATLIVPPQDLDPETVRRIVEATAKIGRALQITGPYNIQFIAKNNEIKVIECNVRASRSFPFISKVVGVNLIEMATKAIMGIPVTPYPVEKLPDDYVAIKVPQFSFPRLAGADPVLGVEMASTGEVAAFGHSKYEAYLKSLLATGFKLPKKNILLSIGSYKEKQELLPGVKKLYNMGYKLFATAGTADFISEHGIPVQYLEVLNEEDDEKSEYSLTQHLANNKIDLYINLPSANRFRRPASYVSKGYRTRRMAVDFSVPLVTNVKCAKLLIEALSRNMSLDVSERDAQTSHRTVTIPGLINISAYVPNISNVLLGPAELKEVTRLSVESGFTYSQIMPKSSSGPVITDAASLKVANSVVKDSAYTNFGFTVAATPNNIDTVSAVANEATSLFLPYRELSNNVPAVSEHLKHWPLDKPVIAEAKTSDLASVILLASLQNRSIHITAVSNKEDLSLVMAVKEKQSNVTCDVNIHSLFVSQDDYPEAKFLPTKEDQEFFWSNLESIDAFSIGSLPTALAAVTGNEIVTGLGIKEALPLLLSAVNDGRLTIDDIVERLHINPAKIFSIPEQNSAVEVDLDFTFRHTKRWSPYQKGGLTGGIQRVLINEETIVLSGDLVATEAKGQPILPSKFTPTTPAVAKETPLAAVGTPILGAISTSRKRFSFSNERRLSINSMDGDDEEAILDQPLEQRLMSSRPPKELSAPSVLINLIRTKNPFLRRNILSVNQFKRSDFHALFAVAQELRAGVEREGVLDVMKSRVLTTMFYEPSTRTSSSFIAAMERLGGRTVNINTSASSVKKGETLQDTIRTLACYSDAIVLRHPDEMSAHIAAKYSPVPIINGGNGSREHPTQAFLDLFTIREELGTVNGITVTFMGDLKFGRPVHSLCRLLQHYQVRINLIAPKELRLPNALRKELQDSGLLGIESETLTPEIISKSDVLYCTRVQQERFETEEDYLKLKDTYIVDNKILSHAKQQMVVMHPLPRVNEIREEVDYDHRAAYFRQMRYGLFVRMALLAMVMGVEL

SEQ ID NO: 34552 - protein, 155 aa, Arachis hypogaea
MHLEAETWTALVVILCFLGLILKESIMGGKSSRESGGDRRHVPSYGSGGASSSSWDNYGYSQPPPYAYQPSIQHRPPAAPYYDYQQPKRRLDRRYSKIADNYRSLDEVTAALSQAGLESSNLIVGIDFTKSNEWTGKRSFNRKSLHHLRNGHNPL

SEQ ID NO: 34553 - protein, 198 aa, Triticum aestivum
  misc_feature (156)..(156): Xaa can be any naturally occurring amino acid
GPENRRTPMMASNPGEIPEYELNPGELQFRKGDEVLKGTYQVAKWNGTKVSVKIVDRETYSDQEAINSFRHELTVFEKVRHPNVVQFIGAVTQNIPMMIVSEYHANADLGSLIQRKGRLNGHKVLRYALDIARGMTYLHQCKPDPIIHCDLKPKCXNIFLDNGGLTKVGGFGLMRLSKMAPDKVKLMNHEAIVDTFSY

SEQ ID NO: 34554 - protein, 427 aa, Kluyveromyces lactis NRRL Y-1140
MFSFVRHFDEWNLAAITSGASLPNWLIYLCGICTIVATSISIISQCGQLWNYRIPSQQRLILRIQMMVPIFSISCFASILRPEIGAIYIDPIREIYEALVIYQFFTYLTLRLGGERNIIINIAPMYPPSRHAIPFFGRYLQRIDLSDPHDFETLKRGVLQYVWFKPVYCIGMATFEAFQWNTVWLVICYNISVTWSLYCLAMFWKCLYTELSVFKPWPKFMCVKLIIFASYWQSLIINVLTIIDVIDIHGDDKYVAFEIGNSVLCVEMIGFAIAHWYAFSSDEYGPDKYPNSGRLKILYALKDWLGFKDLWWDFKSVINGDYRDYRSFDSVESMLADRDTHSRTNRLTRGLRYTNQGMSSYWVGSSGYGSTETDNGNDLESAWTDITEGLNLPRYIPEDSNYPVVWDATSHRYDARIDDLRKQMRSK

SEQ ID NO: 34555 - protein, 390 aa, Vigna angularis
ISLPTVLPPLALNFELCRATTHHLRRILNSISLSSNLKVVVLDFMNHSAARVTHTLQIPTYFYYTSGASTLAILLQQIILHENYTKSIKDLNMDVLIPGLPKIHTDDFPDTVQDRTSEAYKVFTEIAMCMRDSDGVIVNTSEAIERRAIKAFNEGLMEGTTPPVFCIGPVISSAPCRGDDDGCLSWLDSQPSQSVVFLSFGSMGRFSRTQLREIAIGLEKSGQRFLWVVRSEFEDGDSGEPTSLEELMPEGFLQRTKGTGMVVRDWAPQAAILSHDSVGGFVTHCGWNSVLESVCEGVPMVAWPLYAEQKLNKVILVEEMKVGVAVKGDKDGLVSSTELSNRVKELMDSDRGKEIRQNIFKMKISATEAVGEGGSSIIALNRLVELWKEH

SEQ ID NO: 34556 - protein, 474 aa, Vigna angularis
MTMKKDSIVLYSALGRGHLVSMVELGKFMLSHHPSLSINILFLTPPPNQDTPTSPTAFTCAATAKYITAVTAATPSITFHRIPQISLPTVLHPQALNFELCRATTHHFRRILNYISHSSNLIAVVLDFMNHTATRVTDALQIPTYFYYTSGASTLAILLKQIIIHESTTKSIKDLNMHFTIPGVPRIHTDDLPDTGKDRQSESCQIFIDIGKCMRDSYGVIVNSCDAIEGRVIEAFNEGLMEGTTPPVFCIGPVISSEPAKGDDNGCVSWLDSQPSQSVVFLSFGSMGRFSRTQLREIAIGLEKSEQRFLWVVRSEFEESDSGEPPSLDELLPEGFLERTKEKGMVVRDWAPQAEILNHESVGGFVTHCGWNSVLEGVWEGVPMVAWPLYAEQKLNRVILVEEMKVGLGVERNKEGLVSSTELGERVKELMDSDRGKEIRQRMFKMKISAKEAMSEGGSSVVALNELVQKWKAH

SEQ ID NO: 34557 - protein, 293 aa, Volvox carteri
MRAAQTVKAAGVSRAARPVRANVVCKAQKVEFGQAAAAVVAASALVAGSANALTYDELQGLTYLQVKGTGIANTCPVLEKGSTDLSELSAGTYKLENFCIEPTSFTVKEESVFKGGETEFVKTKLMTRLTYTLDAMSGTLKVGSDGSAELKEEDGIDYAATTVQLPGGERVAFLFTIKQFDGKGTLDNIKGDFVVPSYRGSSFLDPKGRGGSTGYDNAVALPARADAEELLKENVKSTKALKGSAVFSVAKVNTATGEIAGVFESIQPSDTDLGAKPPKDIKITGLWYGQLSQ

SEQ ID NO: 34558 - protein, 308 aa, Oryza sativa (japonica cultivar-group)
MSSCGQYMLHRVGKLDTLAGIAIKYGVEVADIKRLNGLSTDLQMFAHKTLRIPLPGRHPPSTYQQNGSYEGDDRECTPPRRLHDDILDSVLRTPKHKASPAMSLLQGYYGLTPPPKKDTTHEGTEMAVYRKGKSVFLDDDPWFGEPPDSDPFPFQHRKTRSLAIGSSLLNGETEENGDSEKLIRRRQKADGELLPREENGSSAVLARAGKGLALRPKSGSRQDLNKSQQNLIALAEPSFGDGLHAVRKSSSTPEFQEPESNSSSTSSSIWSTSKWTLKPDAFTLPLPLPLFDNIPKPIAAWRNKAARD

SEQ ID NO: 34559 - protein, 479 aa, Pseudomonas fluorescens Pf-5
MTAPDRSPPRYKSDLIYGLNDRPHFSAAIFAALQHVLASFVGIISPTLIFGGVLGLESELPYLISMALFVSGLGTFVQARRLGPIGSGLLCVQGTSFSFISVLLSAGFMVKGRGGDTNEILSTIFGICFVAAFIEMFLSQFIGKLRKLITPVVTGTIITLMGLSLIKVAVTDMAGGYGASDLGAASNLGLAALVLLTIVVLNRFNHPMLRLGSIVIGLTLGFVVAWMLGRVDMAAMPEVPLVSVPVPFKYGFSFDLIAFIPLAVIFLISPLEAAGDLTANSMISQQPVKGPLYIKRIKSGLLADGFNSAVAAVFNSLPMVTFAQNNGVIQLTGVASRYVAYFIAGLLVLLGLFPVIGAVLQLMPKPVLGGATLIMFGTVAVAGIKILAEAGLHRRNVLIVAISLGMGLGVAAVPEVLRELPKALHNIFESPITVGAFCAIFLNIFLPEEFLELEEDEFDPEAATLKVMQDPDMSGKANS

SEQ ID NO: 34560 - protein, 306 aa, Pseudomonas fluorescens Pf-5
MSQNMQDLLNQILDEVRPLIGQGQVANYIPALADVPANQLGIAVYGNDGQVFSAGDADTPFSVQSISKVFSLVQAIGHSGEAIWERLGHEPSGQPFNSLVQLEFERGRPRNPFINAGALVICDINQSRFAAPALSMRDFVRRLSGNLQVMVDGRVAESEYQHRARNAAMAYLMQSFGNFHNDVEAVLRSYFSHCALRMSCVDLARAFCFLANDGFCKHSGEQILTRRQTQQVNSIMATSGLYDEAGNFAYRVGLPGKSGVGGGIVAVVPGQFTVCVWSPELNSAGNSLVGMAALELLSQRIGWSVF

SEQ ID NO: 34561 - protein, 409 aa, Glycine max
MGSIPDPGELSELTQPSFDEFQRQTSLMTSCTLLWKELSDHFSSLEQDLNHKSEALKRKIHTLDNSTSDSLRLLDHHYCTSSSFSLFFFFFFFFAKPPLYFSYLTNTTMGDEKKGKPAASGVWSTIKPFVNGGASGMLATCVIQPIDMIKVRIQLGQGSAAQVTSTMLKNEGFAAFYKGLSAGLLRQATYTTARLGSFKILTAKAIEANDGKPLPLYQKALCGLTAGAIGATVGSPADLALIRMQADATLPAAQRRNYTNAFHALYRITADEGVLALWKGAGPTVVRAMALNMGMLASYDQSVEFFRDSVGLGEAATVLGASSVSGFFAAACSLPFDYVKTQIQKMQPDADGKYPYTGSVDCAVKTFKAGGPFKFYTGFPVYCVRIAPHVMMTWIFLNQVQKLQKSYGL

SEQ ID NO: 34562 - protein, 556 aa, Oryza sativa (japonica cultivar-group)
MDAVMPGAAGAHNATAAAAAGRRGGGIVAGMMALPEVQTVELLVAVSIFVAIHSLRQRRSQGLPSWPLVGMLPSLLLGLRGDMYEWLTGVLASRGGTFTFHGPWLTNLHCVVTSDPRNLEHMLKTKFGSFPKGPYFRDTVRDLLGDGIFGADDEVWRRQRKAASLEFHSAEFRALTASSLVELVHRRLLRVLGDAEEAGDAVDLQDVLLRLTFDNVCMIAFGVDPGCLRPGLPEIPFAKAFEDATEATIVRFVTPTAVWRAMRALGVGHERVLQRSLAGVDRFAYDVIRQRKEEVAAGGGGGGGGRSDLLTIFTKMRDADTGAAAYSDKFLRDICVNFILAGRDTSSVALAWFFWLLNKNPAVEAKILEEIDDIVAARRSSPPAPAVAANGADEDDLVFHPEEVKKMEYLHAALSEALRLYPSVPVDHKEVVEDEVFPDGTVLKKGTKVIYAMYTMGRMESIWGEDCREYKPERWLRDGRFMGESAYKFTAFNGGPRLCLGKDFAYYQMKFAAASILRRYHVRVVDGHPVAPKMALTMYMKHGLKVKLTKRDKSKL

SEQ ID NO: 34563 - protein, 451 aa, Pichia angusta
MGTKSMTDVTAEELSKDSVAMMLAKDRELKNKYLKQKHISEQPWTWENWHRHINWLNFILVLAVPFAGLISTKWVPLKLHTFVTAVILYCFGGISITAGYHRHWAHRAYDCKLPVKIFFALFGASAVEGSIKMWGHQHRVHHRYTDTPRDPYDAKRGFWYSHMGWMLLVPNPRYKARADISDLLDDWVVRVQHRHYLLLMVVMAFLFPAVLTHYLFNDFWGGFIYAGLLRAVVIQQATFCVNSLAHWIGEQPFDDRRTPRDHVLTALVTFGEGYHNFHHEFPSDYRNALKWYQYDPTKVVIYLLSKVGLAYNLKKFSQNAIDQGILQQQQKKLDRMRAKLNWGPQLSELPVWDKSTFFEKAKEQKGLVIISGIVHDCANFLTEHPGGQALLKTSFGKDATMAFNGGVYAHSNAAHNLLATMRVAVIRDGGANGDTFDAQLRYLASKENKKE

SEQ ID NO: 34564 - protein, 255 aa, Magnetospirillum magnetotacticum MS-1
MSDAAGHQSGYALFLDFDGTLVEIAPRPDAVQVDPTLVPALERLRDRLGGALAIVTGRPVTVIDAFLKPARFDVAGLHGVERRVDGNLTGGRAEDHPDLRAGVERLHAETARYEAVLIEDKGASVAVHWRLAAPGDAQAAEAIVKAVAHDLGSAYRLQLGKAVGEIVPASATKGHAIRAFSEAAPYAGRRAIFLGDDRTDEIAFASVNEDGGISVRVGEGETVARRRLASPAEVRALIAAWAEGAPIDPETLPPA

SEQ ID NO: 34565 - protein, 175 aa, Kluyveromyces thermotolerans
HRLWSHRAYSARWPLRLFFAIFGAASVEGSIKWWGHSHRIHHRYTDTVRDPYDARRGLWYSHMGWMLLQPNPKYRARADIADLTDDWIVRFQHRHYIPIMAFSAFILPALLCKYLFNDFIGGLVYGGVLRVFAIQQTTFCIDSLAHYLGDQPFDDRRTPRDNWITALVTFGEGYH

SEQ ID NO: 34566 - protein, 451 aa, Oryza sativa
MAEPEFEQAYKELASTLESSTLFEKNPEYRKALEVVSVPERVIQFRVVWEDDSGKCQVNKGYRVQFNSALGPYKGGLRLHPTVNLSILKFLGFEQIFKNALTGLNMGGGKGGADFDPKGKSDNEIRKFCVAFMTELSKHIGADTDVPAGDINVGGREIGYMFGQYRRLRNQWEGVLTGKGLNWGGSLIRPEATGYGLVYYVDHMINYASGGKESFKGKKVAISGSGNVAQYAALKVIELGGTVVSLSDSKGSLIATEGKGFTPEDISQIAALKLKRQALTALEGHSYNYIEGARPWKHVGNVDVALPSATQNEVSQDEAEALIAAGCKFIAEGSNMGCTQEAIDAFENHRKSNKGSSIWYAPGKAANAGGVAVSGLEMAQNSQRLSWTNEEVDAKLAKIMKDCFENCLATAKEYITPAEGEFPSLVAGANVAGFKKVAAAMHDQGDWWGTA

SEQ ID NO: 34567 - protein, 520 aa, Glycine max
  misc_feature (487)..(487): Xaa can be any naturally occurring amino acid
MASACVTLKSNTHLANSEKGFLGERIKGGFNNSALVMNQLAIRSRSHKRVKHGVGVVSAVLTSNNAKESLTLQVPSFLRRRADPKNVISIILGGGPGTQLFPLTKRAATPAVPVGGCYRLIDIPMSNCLNSGINKIFVLTQFNSASLNRHIARTYFGNGINFGDGIVEVLAATQTPGEAGKNWFQGTADAVRQFTWVFENTNVENVLILAGDHLYRMDYMDLVQSHVDRNADITVSCAAVGDSRASDYGLVKVDDRGRIIQFSEKPNGDDLKAMQADTSLLGLSPQDALKSPYIASMGVYVFKTDVLLNLLKWRYPTSNDFGSEIIPAAVRDHDVQSYFFEDYWEDIGTIKSFYDANLALTEESHKFEFYDPKIPIYTSPGFLPPTKIDKCQIVDAIISHGCFLRECTVQHSIVGERSRLDYGVELLDTVMMGADYYQTESEIASLLAEGKVPIGIGRNTKIRNCIIDKNAKIGKDVIIANKDLALXGVQEADRPEDGFYIRSGITIIMEKATIEDGTVI

SEQ ID NO: 34568 - protein, 580 aa, Frankia sp. EAN1pec
MLCPREHSRCRRLIPTQGDDPVARGVGAEGGGILWIGKDAIRRVEAVGEGWAVRPVCVADAVNGARCHPGGLTWRPEGRQWAAHRDGRDEAMTATDTVKATETRHQGAAVVGGDQSVADAGGVTSPAPTESHTTTPSMFRARGEQLVLVATILFPFAALVAAVPLLWDHWITWRDVILAAVMYAITGHGVTVGFHRYFTHRGFKTSKPVRAALAIAGNMAIEGPVIRWVADHRRHHAFSDADGDPHSPWRYGTGPAALARGLWHAHVGWLFDVEQTDQRRYAPDLLDDPMIVRVSRSFALCAFVSLALPAVIGGLWGGSFEAALQAFFWASLVRVALLHHVTWSVNSICHVMGSRALPLPRPLGQRVAAGPAFHGRVLAQPAPRRADLGPARRPPLADRHQLLRDQDSGDPRAGPGRPLARPRPPGRQARLTGVVHSQRRWSRLSTSASVSPPRHPPRAPGRVPERPCGGLFDLGGQGKPLVLGLVLLAGEGAELGVEGEDALVVGGGLGQRLVQLGLATSQFLEGPFQPGQLLAGRTQFARAQGRTRVRSRRLPGARGRARPSRTPRAAARATGAGRAA

SEQ ID NO: 34569 - protein, 464 aa, Vibrio fischeri ES114
MPLHSKNAVRDDLLDDIYSSADLSLSMPKYKMPEQEHDPRHAYQVIHDELMMDGNSRQNLATFCQTWVEDEVHKLMDECIDKNMIDKDEYPQTAELESRCVHMLADLWNSPDAENTLGCSTTGSSEAAMLGGMALKWAWREKMKKLGKPTDKPNMICGPVQVCWHKFARYWDIELREIPMEGDRLIMTPEEVIKRCDENTIGVVPTLGVTFTCQYEPVKAVHEALDKLQEETGLDIPMHIDAASGGFLAPFCDPDLEWDFRLPRVKSINASGHKFGLSPLGVGWVIWRDASALHEDLIFNVNYLGGNMPTFALNFSRPGGQIVAQYYNFLRLGKEGYRKIHQACYDTAVYLSSEIEKLGMFEIIYDGKGGIPAMSWSLKEGVDPGFNLFDLSDRIRSRGWQIAAYAMPPKREDLVIMRILVRHGFSRDQADLLVADLKHCVEFFAKHPISHGSDELESSGFNHG

SEQ ID NO: 34570 - protein, 121 aa, Campylobacter jejuni subsp. jejuni NCTC 11168
MQEKTIFELIVEGKLPCNKVLESDDFLAFHDIAPKAPIHILIIPKKYFKDFQEFDPELMAKMTSFIQELAVLLGVDKSGYRLVTNCGKNSGQEVFHLHFHMLGGFELPKEKTKKENPQALF

SEQ ID NO: 34571 - protein, 189 aa, Campylobacter jejuni subsp. jejuni NCTC 11168
MSKKVLIPLAQGFEEAEFIGIADVLKRAKELNPDLEVVIASLNSELLVKGANSISIKADCSIEDVDIENLDAIALAGGFEGMMNLKNSNVILNIIKQLHSKNKIVAAICASPIVLNEAGVLEGEFACYPSCEVGLNGNRVNKAVVVNKNVITSAGPATAILFGLELAKKLCGDEIYQKLYEGMLLPLTK

SEQ ID NO: 34572 - protein, 470 aa, Vigna angularis
MKDTIVLYPNIGRGHLVSMVELGKLILSHHPSLSITILILTPSPNATFTLASNSNAQYIAAVSATIPAITFHSVPMAQLPLDTHSLPPHLISVDLSRHSTHNVALALQSLVKGSNIKALVMDFLNFSNPKTLTENLTTNIPTFFYYTSAASSLVVLFHMSTTLPKQIKDEQFLLHFPGLPAISTDDFPNESLDPLNYTNQIFSQIAEAMKGSSGIIINTCEAIEEKAIAVLNDDGTVPPLFCVGPVISASYGEKDKGCLSWLESQPSQSVVLLCFGSMGLFSREQLKEMAIGLEKSQQRFLWVVRTELECGDSVEEKPSLNELLPEGFLERTKEKGLVVRDWAPQREILSHDSVGGFVTHCGWNSVLESVCEGVPMVAWPLYAEQKLNRVFMVQEMKVALALKEEKDGSVSGSELGERLKELMESDKGKEIRQKVFKMKLSAAEALGERGTSRVALNKLATLWETSYFTI

SEQ ID NO: 34573 - protein, 586 aa, Securigera parviflora
MCGILAVLGCSDDSQAKRVRVLELSRRLKHRGPDWSGLHQHGDCFLAHQRLAIVDPASGDQPLFNEDQSIIVTVNGEIYNHEELRKQMPNHKFRTGSDCDVIAHLYEEHGENFVDMLDGIFSFVLLDTRDNSFIVARDAIGVTSLYIGWGLDGSVWIASELKGLNDDCEHFETFPPGHLYSSKEREFRRWYNPPWFSESIPSAPYDPLALRQAFEKAVVKRLMTDVPFGVLLSGGLDSSLVASITARHLADTKAAKQWGAKLHSFCVGLEGSPDLKAGKEVADYLGTVHHEFQYTVQDGIDALEDVIYHIETYDVTTIRASTPMFLMSRKIKSLGVKWVISGEGSDEIFGGYLYFHKAPNKEELHKETCRKIKALHKYDCLRANKSTFAWGLEARVPFLDKEFINVAMNIDPENKMIKLDEGRIEKWILRKAFDDEENPYLPKHILYRQKEQFSDGVGYGWIDGLKDHAAKHVTDRMMLNASNIYPFNTPTTKEAYYYRMIFERFYPQNSARLSVPGGASVACSTEKALEWDAEWSKNLDPSGRAALGVHVSAYENQLSSSVSKGVEPEKIIPKMEISPLGVAIQS

SEQ ID NO: 34574 - protein, 363 aa, Hypocrea jecorina
MATQTINKDAISNLSFVLNKPGDVTFEERPKPTITDPNDVLVAVNYTGICGSDVHYWVHGAIGHFVVKDPMVLGHESAGTVVEVGPAVKSLKPGDRVALEPGYPCRRCSFCRAGKYNLCPDMVFAATPPYHGTLTGLWAAPADFCYKLPDGVSLQEGALIEPLAVAVHIVKQARVQPGQSVVVMGAGPVGLLCAAVAKAYGASTIVSVDIVQSKLDFARGFCSTHTYVSQRISAEDNAKAIKELAGLPGGADVVIDASGAEPSIQTSIHVVRMGGTYVQGGMGKSDITFPIMAMCLKEVTVRGSFRYGAGDYELAVELVRTGRVDVKKLITGTVSFKQAEEAFQKVKSGEAIKILIAGPNEKV

SEQ ID NO: 34575 - protein, 759 aa, Zea mays
MVRSGSIRRSAVPAPMPAPAFTVSPADYRLLEEVGYGANAVVYRAEFIPTGRTVAVKCLDLDRVNSNLDDVRKETQTMSLIDHPNVIRSYCSFVVGHNLWVVMPFMSEGSCLHLMKVAYPDGFEEPIIASILKETLKALDYLHRQGHIHRDVKAGNILIDNPGVVKLGDFGVSACMFDRGDRQRARNTFVGTPCWMAPEVLQPGTGYNFKADIWSFGITALELAHGHAPFSKYPPMKVLLMTLQNAPPGLDYDRDKRFSKSFKEMVAMCLVKDQTKRPTAEKLLKHSFFKNAKPPELTVKNILTDLPPLWDRVKALQLKDAAQLALKRMPSSEQEALSMSEYQRGVSAWNFDIEDLKAQASLICDDDPPEIKEDDDTGRITDIDKDTSSDDYFGKTAPSNGNNCSDRSSVPANPGQNGPEINEILSSNNGNAYSERKPDGRKNPESENDSLPSTSKHDADGKDYRCDFRQKQRTYSGPVLQSGPNNSSMTERGHIIERDAGVQSVSDKQKNGTRRANNLSGPLSLPTRASANSLSRANNLSGPLSLPTRASANSLSAPIRSSAGYVGSLGDKPKRTMVEIKGRFSVTSENVDLAKVQEIPGSSASRKLQEGPSLRKSASVGDWSANDKTTSTNHQRKELCNSSVSTSILIPHLQNLVKQTAFQQDLITNLLSSLQQNERVDAAQSRVQSTTSDTVVEAATAEREHSLLVKIFELQSRMISLTDELIAAKLKHVQLQEELNVLYCQEEILDMREDESEEA

SEQ ID NO: 34576 - protein, 459 aa, Oryza sativa (japonica cultivar-group)
MDRFKMIKEVGDGTFGSVWRAINKQNGEVVAVKKMKRKYYSFEECMSLREVKSLRRMNHPNIVKLKEVIRENDILYFIMEYMECNLYQLMKDRVKPFSEAEVRNWCFQIFQALAYMHQRGYFHRDLKPENLLVSKDVIKLADFGLAREVTSVPPYTEYVSTRWYRAPEVLLQSSIYDSAVDMWAMGAIMAELLTLHPLFPGTSEADEILKICNVIGSPDEQSWPQGLSLAETMKFQFPQVSGNQLAEVMTSVSSEAVDLISSLCSWDPCKRPKAAEVLQHTFFQGCTFVPPTVRSKAGVLPKTPPCVGVKGVSEHGMPRRYSTGTLSTTKPHSNASLKSSGLSKTGVQRKLQMDRQAPQKIKKPTESNNKLTTNRVPARNSPGHPVLRHSRSLPETGRATMHKVSTLTERLTHMSVTSRTRTTPKPAAPLLKAGLGKSDLLGKTDEIPPAKRLTRKLVS

SEQ ID NO: 34577 - protein, 411 aa, Oryza sativa (japonica cultivar-group)
MLACIACSTKDGGEGGHRSATATPNSGKSLTSQLKDMVLKFSGSGRHQYKSGGSPSLRTSRFHRSSRLAAYPGIIDESGFTSDGAGEAYTYMRTTTASAGARAAPSTWDLPPKVNHRSFQPRVIRSPSASGVPSIGEEDYDDDDDDDDEETVLLEEDRVPREWTAQVEPGVQITFVSIPGGAGNDLKRIRFSREMFNKWEAQRWWGENYDRVVELYNVQTFSRQQGFSTPTSSVDEAMQRDSFYSRVGSTRESPAMMMPPPPPLPSSGAGREHPISRTASSKAQLSSSSSVAAARPPFYPSTAVPDPSDHVWAHHFNLLNSAAAGPAAPYDPSRGTTSSRDEASVSISNASDLEATEWVEQDEPGVSITIREFGDGTRELRRVRFSRERFGEERAKVWWEQNRDRIHAQYL

SEQ ID NO: 34578 - protein, 924 aa, Arabidopsis thaliana
MLEPRGADIPILFLVLVVLPVVAYILLGKWSNISEKRVRANLLAQMAAEEALRAETVVNADRGVRFESVATENRAQRTRTKTVSAGGGAVRAEFDAGARETVAEQRSDSVTATCGVTVVAPVNNNELHVCARCFGPAKTRCSRCKSVRYCSGKCQIIHWRVAHKDECVPVESCSSSSERVSFEKDSVLYDHGMDSTMYSNNTTQAAKGKTSKSSVDFASLGISQNDITPQINTQGRKSVGKQHSSKANRESCRRDSATVFDSSDEAASAGGDNKTSHIKHKSRGNSYAAETNPRRHSVDSSAVQMNGQSFVSGMQESHKHENNLGVRSSFGCPNTQYPSNGTRTATLPRTGINKSGEQSCTETSKKGQVAAVSKTVRSKDTGISEESNGISSTMGIMKMMGLRNSTKHDDRYKNLKMLFPYEEFLKFFQCEVFDLSPRGLVNCGNSCYANAVLQSLTCTKPLVAYLLRRSHSRSCSGKDWCLMCELEQHVMMLRESGGPLSASRILSHMRSINCQIGDGSQEDAHEFLRLLVASMQSICLERLGGETKVDPRLQETTLVQHMFGGRLRSKVKCLRCDHESERYENIMDLTLEIYGWVESLQDALTQFTRPEDLDGENMYRCSRCAGYVRARKELSIHEAPNILTIVLKRFQEGRYGKINKCISFPEMLDMIPRPPRTGDVPPLYMLYAVIVHLDTLNASFSGHYISYVKDLRGNWYRIDDSEIHPVPMTQVMSEGAYMLFYMRSYPRPQRGEHNGKAPVHHSQPRNEMKEQRKPVNRFKPRADHKNTESSSSEWSLFTSSDEASFTTESTRDSFSTIDYTDVCHVVDSSSPFAIFNNVYHNVEPSPHNTVACRMFSGTKPETRYFVEQETNHNNTVVLDATPSLYPIPAPYPPHDYYDQSMYVNYETNPEFNNGQDQDRTYSYW

SEQ ID NO: 34579 - protein, 525 aa, Pseudomonas syringae pv. phaseolicola 1448A
MALDIHAHRILILDFGSQYTQLIARRVREIGVYCELHPFDMDDEAIREFAPKGVILAGGPESVHEANSPRCPQAVFDLGVPVFGICYGMQTMAEQLGGKVAGSELREFGYARVDVVGKSRLLDGIEDHIDADGLFGLDVWMSHGDKVTKLPEDFHILASTPSCPIAGMADDARGYYGVQFHPEVTHTKQGGRILSRFILDICGCEALWTPSKIAEDAIAQVRAQVGTDNVLLGLSGGVDSSVVAALLHKAIGDQLTCVFVDNGLLRLHEGEQVMAMFAENMGVKVIRANAEEQFLNNLEGESDPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 34580 - protein, 445 aa, Corynebacterium efficiens YS-314
MITAQMDETVLWLGLATVVSLLLSGLLGAIESAVSTVSRARVEQMHKDEVSGSAALLHVIDNRATNINILVMLRTLLDTSAAVLAGVIAVHLVTSDAWAIFLAIVVVSLITFGVVGVFGRTVGRKNPYTVSLRSAVVLTGVEKVLGPLAKLIIWVGNVIAPGPGLRNGPYATEVELREMVDIAQEHGIVEVEERRMIQSVFDLASTTVRQVMVPRPEMIWIESGKSAGQATALCVRSGHSRIPVIGENVDDIIGVVYLKDLVKQTYYATDGGRSVTVDEVMRPAKFIPDSRPLDALLQEMQEEQNHIAILIDEYGGVAGLISIEDILEEIVGEIADEYDNDEVAPIEQIAERTYRVMSRLSLEDLRDHLQEELEVDIDFTDDIDDQVDTVGGLIAFELGRVPLPGATVETSGLRLTAEGKRNRRGRLRMHSAVVEVLPAVEQAEN

SEQ ID NO: 34581 - protein, 312 aa, Arabidopsis lyrata
YLSGMDILLTVDPVNIHYILSSNFANYPKGMEFKKIFEVVGDSIFNVDSGLWEDMRNSSHAIFSHQDFQRFWVSTSVNKLRQGLVPIIENAADKNILVDLQDLFQRFLFDTSLILMTGYDPKCLSIEMPKVEFGDAVDGVSDGVFYRHVKPVFLWRLQYWIGVGVEKRLKRGLAVFDQLLEKIITAKREEIKSLGTQHHSRGEAIDVLTYYMTMDTTEYKYLKPSDDKFIKDTILGFLIAARDTTSSALTWFFWLLSKNPEAMNKIRQEVNKKMPRFDPADLDKLVYLHGAVCETLRLYPPVPFNHKSPAKP

SEQ ID NO: 34582 - protein, 378 aa, Corynebacterium efficiens YS-314
MARDYYGILGVDRNATDSEIKKAYRKLARKYHPDVNPSEEAAEKFREASVAHEVLTDPDKRRIVDMGGDPMEQGGGAGHPGGFGSGGLGDIFDAFFGGGAGSRGPRSRVQPGSDTLWRTSITLEEAFTGVKKDLTLDTAVLCSKCHGSGSASNAKPKTCGTCHGSGEIQEVQRSFLGNVMTSRPCHTCNGTGEVIPDPCDECAGDGRVRARRDIVADIPAGIQSGMRIRMAGQGEVGAGGGPAGDLYVEVMVRPHAVFTRDGDDLHASIRVPMIDAALGSELEVESLTGEEITVVIPAGTQPNQVITLEGEGMPRLRAEGRGDLMAHVDLFVPTEIDDRTRELLEQIRDYRRDNSSVHREGEEHGGLFDKLKSKFRNR

SEQ ID NO: 34583 - protein, 553 aa, Bradyrhizobium sp. BTAi1
MTHPGEQFYPEGVRWDAPIARGTLPELLAKAVSDFGDRGALEFRDRPISFNALAGLVDQAAAAFLRAGFGKGASIALFLGNSPDHPINFFGALKAGARVVHLSPLDGEIALSHKLSDSGARILVTSNLSALLPMALKFLEKGLLDRLIVCEDDHWGQVGTPQTALPDSPAVITHRAFVDGAVAPAVWPAISPDDIALLQYTGGTTGLPKGAMLTHGNLTSAVSIIEIWSRATRTRSEGGDRVICVLPLFHIYALTVVLLTALRIGSLVSLHQRFDLEAVMRDIEHKRATYFPGVPTMWIAIANLPDLDKRDLSSLTSVGSGGAPLPVEVARILERRVGMKLKSGWGMTETCSPGTSHPKEGPDKPGSIGIALPGIEMDVVSLEDPTRVLGVNEVGEIRVKGPNVTKGYWNRPEETAQSFVGDRFLTGDIGYVDADGFYFLVDRKKDMIISGGFNVYPQMIEQAIYIHPAVQEVIVIGIPDAYRGEAAKAFIKLRDGFAPFPVEDLREFLTGKLGKHELPAAVEFVDELPRTPVGKLSRHELRQQQSSTSQSKH

SEQ ID NO: 34584 - protein, 1067 aa, Legionella pneumophila subsp. pneumophila str. Philadelphia 1
MPKRTDIKSILILGAGPIVIGQACEFDYSGTQAVRALKEEGYRVILVNSNPATIMTDPELADATYIEPVQWKEVARIIEIERPDALLPTMGGQTALNCALDLVREGVLAKYSVEMIGATREAIDRAEDREKFRQLMIKIGLDMPRSAIAHSLEEAIQVQARLGFPAIIRPSFTMGGSGGGIAYNREEFEEICIRGLELSPTHELLIDESVLGWKEYEMEVVRDKNDNCIIVCTIENFDPMGVHTGDSITVAPAQTLTDKEYQRMRDAAIKVLRAVGVDTGGSNVQFAINPEDGRMLVVEMNPRVSRSSALASKATGFPIAKVAAKLAVGYTLDELKNEITGGKTPASFEPSIDYVVTKVPRFNFDKFPQTPDTLTTQMKSVGEVMAIGSNFQESLQKAIRGLEIGRCGLHSLFQKEDMARLRGHLREPTPDRLWYIADAFRQNLSLEEIHLESRVDPWFLAQIQELVLLERSIIGKTIRDLDKTALHLMKHRGFADAYLAKLLGCTEAEVRARRVELEILPVYKRIDSCAGEFPSDTAYMYSCYEGSCEARPESNKKKIMILGGGPNRIGQGIEFDYCCVHAALSLRSAGYQTIMVNCNPETVSTDFDTSDRLYFEPVTLEDVLSIVAMEQPEGVIVHYGGQTPLKLARDLEANGVKIIGTSSDAIDMAEDRERFQQMVKELKLHQPDNGTVRSEAEAIELANKIGYPLVVRPSYVLGGRAMEIVYQEEDLRYYLSHAVEVSNDSPVLLDKFLNDAIEVDIDAVCDGKDVLIGAIMEHIEQAGIHSGDSACTLPPFSLGVVVQQDLIEQIRKMALKLGVVGLINAQFAIQADDIYVLEVNPRASRTVPFVSKATGLPLAKIAALCKVGISLKDQGLNQNHHTPSFYSIKLPVFPFIKFSGVDSILGPEMKSTGEVMGIAKRFGQAYAKAQLGAGCHIAKRRRAFVSVRDADKTRVGEIAKRLIELGFEIIATRGTALALQAAGVDCRRVFKVAEGRPHVLDFIKNNEIDFIVNTTEGKQAIADSFAIRRNALQHKVSYTTTLSGAEAACLAMKYEDRETVTRLQDLH

SEQ ID NO: 34585 - protein, 1310 aa, Burkholderia sp. 383
MASTTLGVKVDDLLRSRLKDAAARLERTPHWLIKQAIFAYLERIEHGQLPPELSGHSGVTELADGQVADGDDDNSPHPFLEFAQNVQPQSVLRAAITAAYRRPEPECVPFLLGQARLPANLQADVQALATKLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDAQRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDTEIKRAQVDGLEGYPVYTRKIYTDVSYLACAKKLLAAPDAVYPQFATHNAHTLAAIYQLAGQNYYPGQYEFQCLHGMGEPLYEEVTGRDKLNRPCRVYAPVGTHETLLAYLVRRLLENGANTSFVNRIADKTVAVKELVADPVDEASKVVPLGAPHAKIPLPRNLYGDERPNSMGLDLSNEHRLASLSSALLASAHFPWRAAPMLADDALADAPARDVRNPADQRDLVGTVSEATAEHVSAALAHAVAAAPIWQATPVDARADCLVRAADLLEAQMHTLMGLIVREAGKSLPNAIAEIREAVDFLRYYAAQIRDEFSNDTHRPLGPVVCISPWNFPLAIFMGQVAAALAAGNTVLAKPAEQTPLIAAQAVRLLREAGVPAGAVQLLPGTGETVGAALVADARTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDGEAKQTIDTHVAAMKDKGHGVTQLPAPEACAHGTFVPPTLIEIGSIDELKREVFGPVLHVVRYRRSQLDKLLEQIRATGYGLTLGIHTRIDETIAHVISNAHVGNIYVNRNVIGAVVGVQPFGGEGLSGTGPKAGGALYLQRLLATRPSGLPRSLAQTLIADGAVEGDARGNPAAALTTLRDWLIEQREPVLAARCDGYLAQVPAGATAVLSGPTGERNTYTLGPRGTVLCVAATPGGARAQFAAVLATGNRALFAGAAGEALVAALPASLKAHAVVRKQADAPFDAVLFEGDSDELQTLVKDVAQRPGPIVSVQGVSVGAFENGDAEDYALERLLTERSVSVNTAAAGGNANLMTIG

SEQ ID NO: 34586 - protein, 502 aa, Burkholderia sp. 383
MNLVAALDRAARATPDKPFLVSESATITYAAARERSHRAAAVLSALGIAAGDRVAAMCFNTPAFVDLMFGAWRLGATFVPINHKLQAPEVDYVLEHSRSKALLFDVALAPVVERLVHPARRLVTEGELDGVPCFDTLCATMDGLAGIDPADGDIAQILYTSGTTGHPKGCVHSHRTVTLAAMQAALATGIGRHERTLMAMPIWHSSPLNNWFGGTLYAGGTVVLLREYHPLRFLQTVERERVTLYFGAPVSYLLPLDTIDGFAAFDLSSVRAWLYGGGPIGPAQAERLARAYRSDAFFQVYGMTEAGPAGTTLYPDEQIAKAGSIGRTGGPGVDLRVVRMDGIDAQPGETGEIWLKTDSMMLGYLDDAAATRAAFAPDGWYRTGDIARIDQDGYLFIVDRLKDMIVTGGENVYSKEVEDVLGAHPDIAEAAVVGVPHPDWGETVVAHVVLRAGTVPDADALRAFCGERLAAYKIPREFTFAQALPRTPTGKLQKFLLRVRRE

SEQ ID NO: 34587 - protein, 473 aa, Mycobacterium leprae TN
MRHYYSVAAIRDAEASLLASLPDGVLMKRAAYGLASVIIRELAVRTGGVTGRRVCAVVGSGDNGGDALWAATFLRRRGAAADAVLLNPDRVHRKALVAFRKAGGRIVENVSAATDLVIDGVVGISGSGPLRPAAAAVFATVSASGVPVVAVDLPSGIDVVTGVINGPAVHAALTVTFGGLKPVHALADCGDVTLVDIGLDLPDSDILGLQAADVAAYWPVPGVHDDKYTQGVTGVLAGSSTYPGAAVLCTGAAVAATSGMVRYAGSAYTQVLAHWPEVIASATPTAAGRVQSWVVGPGLGIDATATAALWFALETDLPVLVDADGLTMLAAHPDLVINRNAPTVLTPHASEFARLAGTPPGDDRVGACRKLADSFGATVLLKGNVTVIADPGGPVYLNPAGQSWAATAGSGDVLSGMIGALLAAGLPAAEAAAAAAFVHARAAALSAADPGPGDVPTSASRMVSHIRTALAAL

SEQ ID NO: 34588 - protein, 384 aa, Burkholderia sp. 383
MRSATAPRSKLPDVGTTIFTVIGQLAAQHDALNLSQGAPNFAPDPSLVEGVARAMRDGHNQYAPMAGVMALRERLAEKTEALYGTHYDPATEITVIASASEGLYAAISALVHPGDEVIYFEPSFDSYAPIVRLQGATPVAIKLSPEHFRVNWDEVAAAINPRTRMIIVNTPHNPTATVFSADDLERLAQLTRDTGIVILSDEVYEHVVFDGAQHQSMARHRELAERSVIVSSFGKSFHVTGWRVGHCVAPAELMDEIRKVHQFMVFAADTPMQVAFAEILARPDSYLGLSAFYQAKRDLLARELADSRFELLPSEGSFFMLARFRHFSDESDSDFVLRLIRDARVATIPLSAFYTDGTDAGVIRLSFSKDDATLVEGARRLRSL

SEQ ID NO: 34589 - protein, 608 aa, Coprinopsis cinerea okayama7#130
MVDLPPGLLYLIQHLPSLAIPPATVLASTKLIYHFDLLDGVVESAIPVWAVVLASALSLPVAFVGKALLKGLKDRRDAARNGAVLPPQIYDPLPGGVGLLRATLDNFENGYPGELFEDWVKEYGNIVNFKILGEDRFFTVEPDHIKAILATQFESFEKGPNFQRFMGSILGTGVFNSDGDMWRFHRAMTRPFFTRDRISHFDIFDRHATDALNQLKARLREGYAVDIQDLASRFTMDSATEFLFAKDVQSLAAGLPYPHDSPLHASTSLAASTHPANKFALAFDEAQRLTAIRSRMGVNWPLAEFWRDRVKKEMVTINKFIDPILAAAVQRKRESGGVVGEKVGVGGEREVKENESLLDHLVNYTDDEKVLRDETLNILLAGRDTTTNSITWSVYMLSQHPDVLARLRQEILEVVGETRRPTFDDMKDMKYLRAVINETLRLYPAVPFNVRTSNRPVVLRSKNGGVDHYVPANTKFAYSVFLMHRRKDLWGPDADKFDPDRFLDSRVKTYLTPNPFIFLPFNAGPRICLGQQFAYHETSFFLIRLLQQFKRIEHVPEAQPVWSRPPARWRGSAGPKGVDGVRIKSYLTMSVMGGCWVRMEEAGGEENV

SEQ ID NO: 34590 - protein, 359 aa, Debaryomyces hansenii CBS767
MTIPSSYKKIVLNNAPSKEVNLKYGEESSTFRIERTTFDKNSVKDGEMVIKMLYFSNDPAQKGWMQKGIDSKRMYLRILENDPVISLGLGEVVFSKSSKHSVGDKVTGRFTWEEYIVVNEERITKTIDESLGLPLTSYLSSVGMTGLTAYFGVTKVGELKKGQTIVISAASGATGSMCVQIAKHIVGASKVVGISSSPKKCKWVESLGADVCVNYHDTDYQKQLSDIIGDDFVDVYYDNVGGEILSFMLSKVKQFGNIVACGAISGYNDAEKGEVTGWPEITRNRLTIRGFIIIDFIKDFAEGINAIVGAIKEGKINITEDVSVVDLSKEIDVLAKVPETWGLLFSNKKPNGKLVTKIA

SEQ ID NO: 34591 - protein, 360 aa, Debaryomyces hansenii CBS767
MSIPSNYKQIILNSAPSKEVNLKYGEESSTFRIEQASFDENSVKDGEVVVKVLYLSNDPTQRGWMQKGIDAKRMYAPPILENDPVTALGLGEIVLSKSSKHSVGDKVTGRFSWQEYVVVNEQSIFTTIDESAGLPLTSYLSSVGMTGLTAYFGVTKVGELKKGQTIVISAASGATGSMCVQIAKHIVGATKVIGISGSAEKCKWVESLGADVCVNYHDADYQKQLSDIIGDDFVDVYYDNVGGEILSFMLSKVKPFGHVVACGAIAGYNDKEKSNVTSWAEIITNRLTVRGFIILDFVKDYAQGVGAIVGAIKEGKIKITEGTSVVDLTSEKDVLAKVPETWSLLFGSNKPNGKLITKIA

SEQ ID NO: 34592 - protein, 366 aa, Bacillus cereus ATCC 10987
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSEEDAISYSLSGANLRCTGVNWDLRKDEPYSIYDRFDFDIPVGSVGDAWDRYVCRMKEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 34593 - protein, 481 aa, Bacillus cereus ATCC 10987
MSDPNKDLEDLKREAARRAKEEARKRLVAKHNAEISKLEEENQEKEKALSKNDGMTVEEAKRRAAAAAKVKAAVLAKQKGEGTEEEKAKAKAKAAAAAKAKAAALAKQKREGMEEGTEEEKAKAAAAAKAKAAALAKQKREGMEEGTEEEKAKAKAKAAAAAKAKAAALAKQKREGTEEVTEEERAKAKAKAAAAAKAKAAALAKQKREGTEEVTEEERAKAKAKAAAAAKAKAAALAKQKREGMEEGTEEEKAKAKAKAVAAAKAKAAALAKQKASQGDGDSGDEKAKAIAAAKAKAAAAARAKMEGAEGKKEEEAKQEEPSVNQPYLNQYVEVIKGKVGEDALVDCYINKLSKDVPTLVVEPSKYYEVMELLRSHEELAFDYMSELHATDFVTHMEVYVHLFSYGKKQSVAVKVKLDREAPQVESVTPLWKGADWPEREAYDLLGIVFKGHPNLSRILMPDDWIGHPLRKDYEPYDVEV

SEQ ID NO: 34594 - protein, 231 aa, Shewanella sp. ANA-3
MNMSQKMAAEFLGTLWLVLGGCGSAVLAAAFPEVGIGLLGVALAFGLTVLTMAFAIGHISGCHLNPAVSFGLWAGGRFPASELLPYIIAQVAGGIVGAGVLYAIASGQEGFSLAAGFASNGFGEHSPGGYSMMSVLICEIVMTLFFLLVILGATDERAPKGFAPIAIGLCLTLIHLISIPVSNTSVNPARSTGPALFVGDWAVSQLWIFWVAPIVGAILAGMIYRYFKAAE

SEQ ID NO: 34595 - protein, 136 aa, Camellia sinensis
MARTKQTARKSTGGKAPRKQLATKAARKSAPATGGVKKPHRFRPGTVALREIRKYQKSTELLIRKLPFQRLVREIAQDFKTDLRFQSSAVAALQEAAESYLVGLFEDTNLCAIHAKRVTIMPKDMQLARRIRGERA

SEQ ID NO: 34596 - protein, 430 aa, Shewanella sp. ANA-3
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRSLFEQYPTEISCIIIEPVAGNMNCIPPIPGFLEGLRAMCDEFGALLIIDEVMTGFRVSRSGAQGHYGVTPDLTTLGKVIGGGMPVGAFGGRKEVMQFIAPTGPVYQAGTLSGNPIAMSAGLAQMEALCEEGLYEALSAKTKRIAEGFKAAADKHGIPMAINYVGGMFGFFFTEQEQITRFDQVTKCNIEHFRTFYHGMLDEGVYLAPSAYEAGFLSMAHGEEELRLTLEAADRVLGRMKAAM

SEQ ID NO: 34597 - protein, 271 aa, uncultured archaeon GZfos9C4
MNVEDVMTPKVITEDEDVSVTIISRDMDLSGIGSVVITKEDKPVGIVTDRDISIKICATRRTGKVKVKEIMSSPLITIAPEALLEEACELLAANDIRRLPVMENDELVGIVSVRNILTRAPEHVHRFYPAEGEVVPERLEVGDVMTLEVITEDEVTPVTKITKDMEVSGIGSVVITSEDKPVGIVTDRDIASKVIMKDKKASEIKAKEIMSSPLITIKPEAPVEKACELMAENNIRRMPVMENNELVGIISVRNILTRAPEHVKKFYPAEG

SEQ ID NO: 34598 - protein, 174 aa, Glycine max
RITSPSVTTVNRAGGGMVAPFTGLKSMAGFPTRKTNDDITSIASNGGRVRCMLLFSPVGKKKFETLSYLPDLDDAQLAKEGEYVLRKGWIPWLEFELGHGFVYREHNRAPGYYDGRYWTMWKLAMFGCTDASQVLKELQEAKTAYPNGFIRIIGFDNVRQVQCISFIAYKPPGF

SEQ ID NO: 34599 - protein, 437 aa, Zea mays
MAYFIGVSSPHHSATGAEAEQPWAGSEQRVVAVIMVGGPTKGTRFRPLSLNVPKPLFPIAGQPMVHHPISACSRIPHLAQIYLIGFYEEREFALYVSSISHELRIPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPDILSAIEDVLKQKKDRANLRRVSSIEALHSATKALPPDFVRLDQDILSPRAGKKELYTYQTLDFWEQIKTPGMSLRCSGLYLSQFRHTSPHLLASGDGKRTATIVGDVYIYPSAKVHPTSKIGPNVSISANARVGAGARLINCIILDDVEIMENAVVIHSIVGWKSSIGKWSRVQGEGDHNAKLGITILGEAVDVEDEVVVVNSIVLPNKTLNVSVQEEIIL

SEQ ID NO: 34600 - protein, 172 aa, Glycine max
PRVRRLREDDRRGNLCILFIQDSASAFWKQRPKYFEMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 34601 - protein, 610 aa, Francisella tularensis subsp. holarctica
MWAIVGSSGFESFDDFEIIEELPRETPFGLCSNGLFKIKVEDKEVLFLNRTGLGQNILPHQINYKANIYALKKYGATSIIALSSVRSLREELKPGDMVIPYQFIDRTKSLREFTFCEQGLLNYVSLSKPITESIAEEIRAKKKEFDFEIHFKQSYVCIEGPQFPTIIDAKCFQSMGGGVIGMTAFPEFALAREAGLNYISCNFIVDYVPWSYDVRNLYNVLEIRETNNLKAEKLVKWLVNNLPFYAENDCHELGIARYLSTPIESLPPNKKAWLKVIAKDNSEHEEALEAEILKKVPDLYGGIKTIPAKLQDLLTFIGKYDREGNRKDLEATRKAAASLDLYSYPKVDLENVEDIQITHDDGHNIPVRVYNPKVDEKLKVIIFSHGGGFVSGTLDSFDAFCRKLALTTNRVVFSVDYRLAPEHKFPAGLNDVEFVAEHIFKHSKKFGVSKKKFTLMGDSAGANLTVLATYNLLQKDTVKIANNIILYPSVDLSHMPTKSLEDFASGYILTKAKTMWYSELYVPENIDKRSPEVSPFYIKELDNMPRTLVMTAGYDPLRDEGLLFAERLLRHDVEVQHYHFDSLVHGFINFSKLIPKEMDVLHSRVVKFLG

SEQ ID NO: 34602 - protein, 490 aa, Oryza sativa (japonica cultivar-group)
MAPAMASSAATVVLIPFCVSGHLTPMLEVGKRMLRSRCCGDDDDGRPAMSLTVLLAQLPESHRAPEIDEIIRREAAGASEHSGFDVRFHCLPAEELPDFRGGEDFISRFMQQHASHAREAIAGLESRVAAVVLDWFCTTLLDVTRDLGLPGYVFFTSAASMLSLLLRLPALDKEVAVDFEEMGGAVDLPGLPPVPAALLPTPVMKKGCNYEWLVYHGSRFMEAAGIIVNTVAELEPAVLEAIADGRCVPGRRVPAIYTVGPVLSFKTPPEKPHECVRWLDAQPRASVVFLCFGSMGSFAPPQVLEIAAGLERSGHRFLWVLRGRPPAGSPYPTDADADELLPEGFLERTKGRGMVWPTWAPQKDILAHAAVGGFVTHGGWNSTLESLWHGVPMAPWPLYAEQHLNAFELVRDMGVAVEMEVDRKRGNLVEAAELERAVRCLMDEGSEEGRMAREKAAAAKAACRNAVDGGGSSIAALRKLTQEMAHMSSI

SEQ ID NO: 34603 - protein, 210 aa, Solanum sogarandinum
MADQYEQNKPSVEETVGANVEATDRGLFDFIGKKEEEKPSHAHEEEAISSEFCEKVKVSEEEEHKEKEKKEEKKLHRSSSSSSSSSDEEEEIGEDGQIIKKKKKKGLKEKIKEKISGDHKEEVKTEDTSVPVEKYEETEEKKGFLEKIKEKLPGGGHKKTEEVAAPPPPPPAAVDHEAEGKEKKGFLDKIKEKLPGYHSKTEEEKEKEKD

SEQ ID NO: 34604 - protein, 525 aa, Zea mays
MERVLKDDAVEEKGDRARMASFVGAMAISDLAKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARNALLQNTMDNKENTDKFRADLMNIAMTTLSSKILSQDKEYFAELAVDAVLRLKGSTNLESIQILKKPGGSLKDSFLDEGFILDKKIGIGQPKRIENAKILVANTAMDTDKVKIYGAQVRVDSMSKVADIEAAEKQKMREKVQKIIAHGINCFINRQLIYNFPEELFADAGILAIEHADFEGIERLALVTGGEIASTFDNPDSVKLGHCKVIEEIMIGEDRLIHFSGVAMGQACTIVLRGASEHVLDEAERSLHDALCVLSQTVNDTRVLFGGGWPEMLMAKEVDELARKTPGKRSHAIDAFSHALQAIPTIIADNAGLDSAELISQLRAEHHKENCTAGIDVITGTVGDMQRLGIQESFKVKQAILLSATEAAEMILRVDEIISCAPRRREDRM

SEQ ID NO: 34605 - protein, 235 aa, Mycobacterium avium subsp. paratuberculosis K-10
MSSPDQDPREAIAQGDDEVIDVRRGMFGAAGTGDTSGYGRLVRTVTLPGSSPRPYGSYFDDVVDTLTESLQSNGIEFHQAIEKVVVYRDELTLHVDRAALPHVAQHLRDDPRLRFEMCLGVSGVHYPHETGRELHAVYPLQSITHNRRVRLEVAVPDEDPHIPSLYRIYPTTDWHERETYDFFGIVFDGHPSLTRIEMPDDWHGHPQRKDYPLGGIPVEYKGAQIPPPDERRAYN

SEQ ID NO: 34606 - protein, 345 aa, Pseudomonas fluorescens Pf-5
MPHSLDITALPVLDLSQLQGHPEQRRIFLDGLRQAARDVGFFYLTGHGVDSGLLRRVQDQARAFFALPEADKAAVGMIHSPHFRGYNQAASEITRGQPDLREQFDLGAERQALPLDPHSPPWTRLQGPNQWPAQLPAFKPVLLEWQQAMTAMSLRLLRGFAQALSLPEQAFDGLYGERPNEHIKLIRYPGRAPGQSNQGVGAHKDSGFLSFLLQDQQAGLQVEVEEGRWIDAPPRDNTLVVNIGELLELATHGYLRATVHRVQSPPADRQRLSIAFFLGAQLDARVPLYPLPEALLREARGPASDPDNPLFREVGWNYLKGRLRSHPDVARRFYPDALVPKALSA

SEQ ID NO: 34607 - protein, 516 aa, Francisella tularensis subsp. holarctica
MTDIHNHKILILDFGSQYTQLIARRVREVGVFCEIFPHDVAADFIKNYQAKGIILSGGPESVYDSDVKAPEIVFELGVPVLGICYGMQTMVMQHGGEVKGADQSEFGKAIINILNLTNNIFSNMEHEQLVWMSHSDKVTQTGEHFEIIASSTNAPVAAVAHKNKPFFGVQFHPETTHTENGKQIIENFVVNICGCDTLWNIENIIENDIKEIKQKVGTDKVILGLSGGVDSSVVAAILHQAIGDQLTCIFVDTGLLRLNEGDQVMQVFAEHMDINVIRINAKNRFLDALRGICDPEQKRKIIGKLFVDIFDEEAAKIENAKWLAQGTIYSDVIESASNNQSKAHVIKSHHNVGGLPKEMKLKLLEPLRELFKDEVRKLGLGLGLPYNMLYRHPFPGPGLGVRILGEIKKEYVETLQKADAIFTEELYKHNLYHDVSQAFGVFLPIKSVGVVGDQRRYEYVIALRAVVSIDFMTATWANLPYDFLSLVSNRIVNEVKQVSRVVYDVTGKPPGTIEWE

SEQ ID NO: 34608 - protein, 441 aa, Mycobacterium avium subsp. paratuberculosis K-10
MSTTTESTHDGAGETLVVAGGQDWDKVVEAARSADPGERIVVNMGPQHPSTHGVLRLILEIEGETVTEARCGIGYLHTGIEKNLEYRYWTQGVTFVTRMDYLSPFFNETAYCLGVEKLLGITDQIPERVNVIRVMMMELNRISSHLVALATGGMELGAMTPMFVGFRGREIVLTLFESITGLRMNSAYIRPGGVAQDLPPNAKTEIAQALDQLRQPLREMGDLLNENAIWKARTQDIGYLDLTGCMALGITGPILRATGLPHDLRKSEPYCGYENYEFDVITADTCDAYGRYMIRVKEMWESIKIVEQCLDKLQPGPIMVENGKIAWPADLKVGPDGLGNSPEHIAKIMGGSMEALIHHFKLVTEGIRVPPGQVYTAVESPRGELGVHMVSDGGTRPYRVHYRDPSFTNLQSVAAMCEGGMVADLITAVASIDPVMGGVDR

SEQ ID NO: 34609 - protein, 554 aa, Debaryomyces hansenii CBS767
MSQEEYSSGVQTPVSNHSGLEKEEQHKLDGLDEDEIVDQLPSLPEKSAKDYLLISFFCVLVAFGGFVFGFDTGTISGFVNMSDYLERFGELNADGEYFLSNVRTGLIVAIFNVGCAVGGIFLSKIADVYGRRIGLMFSMIIYVIGIIVQISASDKWYQIVVGRAIAGLAVGTVSVLSPLFIGESAPKTLRGTLVCCFQLCITLGIFLGYCTTYGTKTYTDSRQWRIPLGLCFVWAIMLVIGMVCMPESPRYLVVKNKIEEAKKSIGRSNKVSPEDPAVYTEVQLIQAGIERESLAGSASWTELVTGKPRIFRRVIMGIMLQSLQQLTGDNYFFYYGTTIFQAVGMTDSFQTSIVLGVVNFASTFLGIYTIERFGRRLCLLTGSVCMFVCFIIYSILGVTNLYIDGYDGPTSVPTGDAMIFITTLYIFFFASTWAGGVYCIVSETYPLRIRSKAMSVATAANWIWGFLISFFTPFITSAIHFYYGFVFTGCLLFSFFYVYFFVVETKGLTLEEVDELYAQGVAPWKSSKWVPPTKEEMAHSSGYAAEAKPHDQQV

SEQ ID NO: 34610 - protein, 604 aa, Oryza sativa (japonica cultivar-group)
MCGILAVLGAADWSQAKRAHVLSCSRRLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASANHTNHANANANGNSNGKANGNCAMAANGTNGVGLVVANGTANGKMEA

SEQ ID NO: 34611 - protein, 1057 aa, Staphylococcus aureus subsp. aureus MW2
MPKRNDIKTILVIGSGPIIIGQAAEFDYAGTQACLALKEEGYRVILVNSNPATIMTDKEIADKVYIEPLTHDFIARIIRKEQPDALLPTLGGQTGLNMAIQLHESGVLQDNNVQLLGTELTSIQQAEDREMFRTLMNDLNVPVPESDIVNTVEQAFKFKEQVGYPLIVRPAFTMGGTGGGICHNDEELHEIVSNGLHYSPATQCLLEKSIAGFKEIEYEVMRDKNDNAIVVCNMENIDPVGIHTGDSIVVAPSQTLSDVEYQMLRDVSLKVIRALGIEGGCNVQLALDPHSFDYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESFDLDYIKERISHQDDERLFFIGEAIRRGTTLEEIHNMTQIDYFFLHKFQNIIDIEHQLKEHQGDLEYLKYAKDYGFSDKTIAHRFNMTEEEVYQLRMENDIKPVYKMVDTCAAEFESSTPYYYGTYETENESIVTDKEKILVLGSGPIRIGQGVEFDYATVHAVWAIQKAGYEAIIVNNNPETVSTDFSISDKLYFEPLTEEDVMNIINLEKPKGVVVQFGGQTAINLADKLAKHGVKILGTSLENLNRAEDRKEFEALLRKINVPQPQGKTATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGINIIGLINIQFVIAHDGVYVLEVNPRSSRTVPFLSKITDIPMAQLAMRAIIGEKLTDMGYQEGVQPYAEGVFVKAPVFSFNKLKNVDITLGPEMKSTGEVMGKDTTLEKALFKGLTGSGVEVKDHGTVLMTVSDKDKEEVVKLAQRLNEVGYKILATSGTANKLAEYDIPAEVVGKIGGENDLLTRIQNGDVQIVINTMTKGKEVERDGFQIRRTTVENGIPCLTSLDTANALTNVIESMTFTMRQM

SEQ ID NO: 34612 - protein, 576 aa, Oryza sativa (indica cultivar-group)
MAVEGRRRVPLPLPPPTRRGKQQQQQGGERARRVQAGDALPLPIRHTNLIFSALFAASLAYLMRRWREKIRTSTPLHVVGLAEILAICGLVASLIYLLSFFGIAFVQSVVSNSDDEEEEEDFLIDSRAAGPVAAQATPPPAPAPCSLLGSACAAPKKMPEEDEEIVAEVVAGKIPSYVLETRLGDCRRAAGIRREAVRRTTGREIRGLPLDGFDYASILGQCCELPVGYVQLPVGVAGPLVLDGERFYVPMATTEGCLVASTNRGCKAIAESGGATSVVLQDGMTRAPVARFPSARRAAELKGFLENPANFDTLAMVFNRSSRFARLQRVKCAVAGRNLYMRFSCSTGDAMGMNMVSKGVQNVLDYLQDDFPDMDVISISGNFCSDKKSAAVNWIEGRGKSVVCEAVIKEEVVKKVLKTNVQSLVELNVIKNLAGSAVAGALGGFNAHASNIVTAIFIATGQDPAQNVESSQCITMLEAVNDGKDLHISVTMPSIEVGTVGGGTQLASQSACLDLLGVKGANRESPGSNARLLAAVVAGAVLAGELSLISAQAAGHLVQSHMKYNRSSKDMSKVAS

SEQ ID NO: 34613 - protein, 181 aa, Mycobacterium avium subsp. paratuberculosis K-10
MAKFLDAVAGFGVTFASMFKKHVTEEYPEKPGPVAPRYHGRHQLNRYPDGLEKCIGCELCAWACPADAIYVEGADNTEELRYSPGERYGRVYQINYLRCIGCGLCVEACPTRALTMTNDYEMADDNRADLIYEKDRLLAPLLPEMTAPPHPRAPGATDKDYYLGNVTAHGLREAQRAGEPR

SEQ ID NO: 34614 - protein, 559 aa, Debaryomyces hansenii CBS767
MSESFQTVLTKPFQDQKPGTSGLRKKVQVFQQPNYTENFIQAILDAIPEGKNGSTLVIGGDGRYYNDTVIQLIIKISAANGIKKLIIGRNGILSTPATSHVIRIRGATGGIILTASHNPGGPNNDLGIKYNLANGGPAPESVTNKIFDVSKALDDYKIVALPEFDLSKIGSLQTGPIEVEIIDSTKDYVEMLKDTFDFNAIKKFLTDATEKQGFKLLFDAMNGVTAPYGQVIFVEELGLPSSSVQNCKSLPDFGGLHPDPNLTYAKGLVDRVDKENIAFGAASDGDGDRNMIYGAGTFVSPGDSVAIIAEYADAIPYFARNGVHGLARSMPTSGALDLVAKDKGLNIYEVPTGWKFFCNLFDAKKLSICGEESFGTGSDHIREKDGLWAIIAWLNVLADFDTKNPDKKTSVEIVQNSFWEKYGRTFFTRYDFENVSGKGANKIIELLTSIVENSPKGTKLADGYVVSEGDNFSYTDLDGSVSTNQGLFVKFENGLRFIVRLSGTGSSGATVRLYLEKHSSDASTYQTKVDDYLSQDIKFVLDLLKFNEFLGREEPDVRT

SEQ ID NO: 34615 - protein, 542 aa, Betula platyphylla
MAIQAKEQEFIFRSKLPDIYIPKHLPIHSYCFENISKVGSRPCLINGLTGKVYTYYDVELTARKVASGLSKLGIQKGDVVMLLLPNSPEFAFVFLGASYLGAMTTAANPFCTAGEVSKQAKSANAKIVVTQACYYDRVKDYTNENGVKIICIDSPPEDCLHFSELTKADENDVAEVDISPDDVVALPYSSGTTGLPKGVMLTHKGLVTSVAQQVDGENPNLYYHSEDVILCVLPLFHIYSLNSVFLCGLRAGASILILPKFEIVSLLQLIQKHKVTVMPIVPPIVLAITKFPDLDKYDLSSVKMLKSGGAPLGKEIEETVKAKFPNALFGQGYGMTEAGPVLAMCLAFAKEPMEVKSGACGTVVRNAEMKIVDPETGASLPRNQPGEICIRGDQIMKGYINDPEATASTIDKEGWLHTGDIGLIDDNDELFIVDRLKELIKYKGFQVAPAELEALLLTHPNISDAAVVPMKDDLAGEVPVAFVARSNGSQVTEDEIKQFVSKQVVFYKRISRVFFIDVVPKSPSGKILRKELRAKLAAGFSN

SEQ ID NO: 34616 - protein, 335 aa, Oryza sativa
MSTTAKLAGLLRDEQGPVAFNDAVDEDAVPVEPLTEHDDAISTMSAAHCNNMQFRCYRGFWISEMWAPGVVAVHRSFAPRADDVLVASLQKSGTTWLKALTFATMARGAWPPSSHDHPLRRLNPHLCVPSLEVLYTLGRDALLDMLPSPRLLSTHMPLSLLPPSTCKIVYIYRDQKDTAVSLWHFMKRRHPDLTFSEVHEAFCNGICMGGPAWDNILEFWYASNAEPTRVLFLTYEKVLQDPCDAVKKLAQFLGQPFSGAEEEAGVVTEIADLCSIDNLRNQKANKYGSIGGKISHESFFRKGMAGDWTNHMTLEMAERLDSILREKLDGSGLIV

SEQ ID NO: 34617 - protein, 584 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQNSARLTVPGGATVACSTAKAVEWDASWSNNMDPSGRAAIGVHLSAYDGKNVALTIPPLKAIDNMPMMMGQGVVIQS

SEQ ID NO: 34618 - protein, 439 aa, Pyrococcus horikoshii
  misc_feature (1)..(1): Xaa can be any naturally occurring amino acid
  misc_feature (90)..(90): Xaa can be any naturally occurring amino acid
  misc_feature (109)..(109): Xaa can be any naturally occurring amino acid
  misc_feature (286)..(286): Xaa can be any naturally occurring amino acid
  misc_feature (351)..(351): Xaa can be any naturally occurring amino acid
  misc_feature (393)..(393): Xaa can be any naturally occurring amino acid
XIREKALEFHKNNFPGNGKIEVIPKVSLESREELTLAYTPGVAEPCKEIARDPGKVYEYTSKGNLVAVVSDGSRILGLGNIGPLAGLPVXEGKALLFKRFGGVDAFPIXIKEQEPNKFIDIVKAIAPTFGGINLEDIASPKCFYILERLREELDIPVFHDDQQGTAAVVLAGLLNALKVVGKKISEITLALFGAGAAGFATLRILTEAGVKPENVRVVELVNGKPRILTSDLDLEKLFPYRGWLLKKTNGENIEGGPQEALKDADVLISFTRPGPGVIKPQWIEKXNEDAIVFPLANPVPEILPEEAKKAGARIVATGRSDYPNQINNLLGFPGIFRGALDVRARTITDSXIIAAAKAIASIVEEPSEENIIPSPLNPIVYAREARAVAEEAXKEGVARTKVKGEWVEEHTIRLIEFYENVIAPINKKRREYSKAITRA

SEQ ID NO: 34619 - protein, 314 aa, Mesorhizobium huakuii
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 34620 - protein, 182 aa, Campylobacter jejuni subsp. jejuni NCTC 11168
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLINLKDLNGANKLEKLTSVYSVLEI

SEQ ID NO: 34621 - protein, 314 aa, Mesorhizobium loti
VMFDGSSIAGWKAINESDMVLMPDPDTVHMDPFFAQSTMVILCDILDPVSGESYNRDPRGTAKKAEAYMKAEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 34622 - protein, 314 aa, Mesorhizobium mediterraneum
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 34623 - protein, 314 aa, Mesorhizobium ciceri
  misc_feature (100)..(100): Xaa can be any naturally occurring amino acid
VMFDGSSIAGWKAITKSDMVLMPDPETVHMDPFFAQSTMVILCDILDPVSGESYNRDPRGTAKKAEAYMKAEGIGDTIFVGPEAEFFVFDDVKYKADPYXTGFKLDSTELPSNDDTDYETGNLGHRPRIKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFFIGGVIKHAKAINAFTNPLTNSYKRLVPGYEAPVLLAYSARNRSASCRIPFGSSPKAKRVEVRFP

SEQ ID NO: 34624 - protein, 314 aa, Rhizobium leguminosarum bv. viciae
VMFDGSSIGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 34625 - protein, 205 aa, Escherichia coli
MQEYNQPLRIGVGGPVGSGKTALLEVLCKAMRDTYQIAVVTNDIYTQEDAKILTRAEALDADRIIGVETGGCPHTAIREDASMNLAAVEELAIRHKNLDIVFVESGGDNLSATFSPELADLTIYVIDVAEGEKIPRKGGPGITHSDLLVINKIDLAPYVGASLEVMEADTARMRPVKPYVFTNLKKKVGLETIIEFIIDKGMLGR

SEQ ID NO: 34626 - protein, 365 aa, Ipomoea batatas
ANEHGSEEVLNYDQVFVRDFVPSALAFLMNGEPDIVKNFLLKTLLLQGWEKKVDRLKLGEGVMPASFKVLHDPVRKTDAIIADFGENAIGRVAPVDSGFWWIILLRAYTKSTGDTSLAERPECQKGMRLILSLCLSEGFDTFPTLLCADGCSMIDRRMGVIGYPIEIQALFFVALRCALAMLKPDTEGKEFIERIVKRLHALSYHMRSYFWLDFQQLNDIYRFKTEEYSHTAVNKFNVIPDSIPDWVFDFMPTRGGYFVGNVSPARVDFRWFALGNCVAILASLATPEQASAIMDLIEARWEELVGEMPLKISYPALENHEWRIVTGCDPKNTRWSYHNGGSWPVLLWLVTAACIKTGRPQIAKR

SEQ ID NO: 34627 - protein, 529 aa, Mycobacterium leprae TN
MADSAGLDQPEPSPRPVLVVDFGAQYAQLIARRVREARVFSEVIPHTTSIEEITARDPLAIVLSGGPASVYTEGAPQLDPALFDLGLPVFGICYGFQAMAQVLGGTVARTKTSEYGRTELKVLGGDLHSGLPGVQPVWMSHGDAVTAAPDGFDVAASSSGAPVAAFENRDRRLAGVQYHPEVMHTPHGQQVLSRFLHDFAGLDADWTAANIAGVLVEQVRAQIGNGHAICGLSGGVDSAVAAALVQRAIGDRLTCIFVDHGLLRDGERGQVQRDFVAATGAKLVTVDAAETFLQALSGVTNPEGKRKIIGRQFIRAFEGAVRDLLGDSTFDSGIEFLVQGTLYPDVVESGGGSGTANIKSHHNVGGLPDNLRFKLVEPLRLLFKDEVRAVGRQLDLPEEIVARQPFPGPGLGIRIVGEVTAERLDTLRRADSIAREELTTAGLDYQIWQCPVVLLADVRSVGVQGDNRSYGHPIVLRPVSSEDAMTADWTWVPYEVLECISTRITNEVAEVNRVVLDITNKPPGTIEWE

SEQ ID NO: 34628 - protein, 755 aa, Bradyrhizobium japonicum
MRSASGGPRVLLRRLRETMAEQVSAQERLDKIVVLIAANMVAEVCSVYVLRIDNTLELYATEGLNREAVHHTVLSAHEGLVGLVASEATPLNLNDAQSHPAFSFRPETGEEIYHSFLGVPILRAGNTLGVLVVQNRAKRTYVEEELEALQTTAMVLAELIASGELSALAQPGLEPAARHSMQKVGAILSEGIALGHVVLHEPRVVIKDYIAEDLPKEIKRLDTALAKLRADLDRMLERGDVAEGGEHREVLEAYRMFANDQGWSHKLHEAVATGLTAEAAVERVQSDTRARMLRSTDPYLRDRLHDLEDLGYRLMRQLVGQDHAPSREQLPDNAIVIARAMGPAALLDYNRKRLRGIVLEEGTANSHVSIVARALGIPAVGEVPNAPGIADPGDAIIVDGTSGSIYVRPSQEIEAAFAERVRFRARRQAQYLALRDRPCVTKDGQKVELMINAGLAIDLPHIEDTGSAGIGLFRTELQFMVGQSLPRTSDQLALYRTVLDAAGTKPVTFRTLDIGGDKALPYMEAVIEENPALGWRAIRLGLDRPGLLRGQIRALLRAGGGRALRIMFPMISEVAEFDAAKALVERELTYLRQHGHTLPERIDIGTMVEVPALLYQLDELLKKVDFISVGSNDLFQFLFAVDRGNAKVSERFDTMSAPILRALRDIARKSHAAQKSLSLCGEMASKPIGALALIAMGYRSLSLSATALGPVKAMVIDLDAKKAEAMLGPLLDAPSGSVSIRQKLTEFAEAEGLAL

SEQ ID NO: 34629 - protein, 438 aa, Cryptococcus neoformans var. neoformans JEC21
MSTRQDKSTTERHAKILRELVKQPGNKNCADCKRNDTRWASWNLGVFLCIRCSGIHRSMGTHISKVKSIDLDIWTPEQMESIQKWGNKRANMYWERHLKAGHIPSDHKIESFIRSKYETRRWAMDGPPPPDPSVLENESTGGVVSPPPHQTKSPAPIPSSTSSSAAPPVPAHLPKTHPLLSRSIASSKATPSKPTSAVQAPIIDLFADDPAPAPAAVPAASSRAPAPIATAPAPAQPAPSSASNIFDLDFRTPSAPPLSNSPPASGPISNKSQSAKADIMSLFSSPSPSAIQSQQPNLTGGFFNATPSGVQATSPYASWQGGITSAVPSDGTQLGIPVGNKWSGLQMDQNAWGAPQHAQATQKTQPTQAYAQPQQQQSVNNIVSDPWTQAKTSMASPSDPWASTSSGDAGMGGGFFGMNQAQPKKEKDERDPFANIWA

SEQ ID NO: 34630 - protein, 627 aa, Ipomoea batatas
MEREWFLPFKVLGLGIWMLIATSCSATLSPSGVNYEVVALIAIKTGLHDPYNVLENWDVNSVDPCSWRMVTCSPDGYVSALGLPSQSLSGTLSPGIGNLTNLQSVLLQNNAISGHIPAEIGKLERLQTLDLSNNKFNGDIPSTLGDLRNLNYLRLNNNSLSGQIPESLSKVDGLTLVDVSFNNLSGRPPKLPARTFKVIGNPLICGQSSENNCSVIYPEPLSFPPDAGKGQSDAGAKKHHVAIAFGASFGALFLIIVLVSLIWWRYRRNQQIFFDLNDNYDPEVCLGHLRRYTYKELRTATDHFNSKNILGRGGFGIVYKGSLNDGTIVAVKRLKDYNAAGGEIQFQTEVEMISLAVHRNLLRLWGFCSTENERLLVYPYMPNGSVASRLKDHVHGRPVLDWSRRKRIALGTARGLVYLHEQCDPKIIHRDVKAANILLDEDFEAVVGDFGLAKLLDHRESHVSTAVRGTVGHIAPEYLSTGQSSEKTDVFGFGILLLELITGQKAVDFGRGANQKGVILDWVKTLHQEGKLNLMVDKDLKNNFDRVELEEMVQVALLCTQFNPSHRPKMSEVLRMLEGDGLAEKWEASQRNDTPRYRTHENTPQRYSDFIEESSLIVEAMELSGPR

SEQ ID NO: 34631 - protein, 867 aa, Aspergillus oryzae
MATPFLVSFDPSANGLSLKQIAYFGRVLIKASSVAQAEDFLRQNFRLLDVYVDATAVSTTGDLVDILNAGAAKIFITLDQLTALSQEQSVPSSRVVVYTSSDSQVDSFQKWVAEDSERKDAGLSTDSSAVKALIDKLGLNPEAQSLYRTYSGAVTEETLKDTLTQGAVSIVPAQALTLDRNQADGKIVAASLIAARAVADQSNGLYATTVTDERGTCLGLVYSSDESISEALRTGTGVYQSRKRGLWYKGQSSGDVQELIRVGFDCDSDCLVFVVNQIGRGFCHLGTASCFGPYNGLSRLQKTLQARKADAPAGSYTARLFNEPKLTQAKIMEEADELCRANTKEEIAFEAADLLYFALTRCVAAGVSLEDVERNLDLKSLKVKRRKGDAKGPWAEKAGLAAPASAPAPTPAPVEKSQPSTKEDSRIEMTRVITASTPVEDVKAYLKRPSQKSNDAIIGLVRPIIQDVREHGDAGVLKYTHKFEKATSLTSPVINAPFAPELMQVSPETKEAIDVSIANIAKFHSAQKGSNDGLQVETMPGVVCSRFSRAIERVGLYIPGGTAVLPSTAMMLGVPAMVAGCKKIVLASPPRADGSVTPEIVYVAHKVGAESIVLAGGAQAVAAMAYGTESVSKVDKILGPGNQFVTAAKMLVANDTSAGVSIDMPAGPSEVLVIADKQANPAFVASDLLSQAEHGVDSQVILIAIDLNEQELQAIEDEVDKQARALPRMDIVKGSLEHSVTFVVRDLAEAMALSNEYAPEHLILQIENAEAAVEQVQNAGSVFIGQWTPESVGDYSAGVNHSLPTYGYAKQYSGVNLGSFLKHITSSNLTAEGLLGLSRTVEQLAAVEGLDAHKRAVSIRVAHMKGQ

SEQ ID NO: 34632 - protein, 429 aa, Mycobacterium leprae TN
MPVTIDPRRHSAALFDLDAVVTDTPLDSTVTLVRQLQGIGVGTAVFSTNRNSQGVLTATGLDHLFPVHVDGLASGKVTILVAAANRLMAQPGRCVVVAVDAAGITAARYGGFALVLGLVIGEDQTGHRDTLRNSGADTVVADLGEVIVRTGDRRMSELPDALQTLGLTDDLTARQPAVFFDFDGTLSDIVDDPDSARPVPGATEALQKLATHCPVAILSGRDLADVIKRIGVPGIWYSGSHGFESTAPDGTHHQNDAAEATIPILEQAATQLRDQLGPIPGVMVEHKRFGVAVHYRNVARDRVNEVAVAVRTAGQRNALRVTTGREVIELRPDIDWDKGKTLHWVIDRLHHAGTQVGSASLMPICLGDDITDEDAFDAVRHTDVGGIPIVVRHTEDGNRATAALFTLDSPMHVSEFTERLARQLSDTQR

SEQ ID NO: 34633 - protein, 557 aa, Zea mays
MAEVAARRAVGVPAGGGGDQANLAAVAAAMRGRGEVDTSSPFQSVRQAVDLFGGGAAAVSQWRHPQAPPRVHLRPEEEELMKVEEQTVKLEMELFVKEKETFKVLKELQETKQVIDGLKIQIEKVTWEDTNAAKGHADTGMVHPLPAVEQNTEPPVQSAKGTQSPLTTLIKLNQAKAFLNTDTVNMLKSQIQKEKGSLEKTRERLQFNLGKASSLEADLTKTVARLQAAKAPQPVLEPSEIWLQMKHLNADKARHKKASEDLRNEICELTAAIEHTRSKTKTLQFRILMAEKLKEASQRGESVALAEMEKLSNGRDPNGSTSDAVTLSVEEHSTLVLKAQEADGAARKKVDAAMQGLDQANRCKLELLERVEEAMAAVETSRKALEEAQRREESETKAKLVAEETLRKLRSDQIIQNWRPTNSSSVKFKNTALLAPRRAAAGAGIYDVNGLSLVAAGPNSVKTVSIGQILSMKLDRELEMTRTTTTSARKKKVSLGQILSQKYEMFSPLRIDHDCASHRQFQQPRRKRMGFVVYALLLARQRHRRRKAASCTRGGLS

SEQ ID NO: 34634 - protein, 317 aa, Bacillus licheniformis ATCC 14580
MDVISIGETMALFTPNEDGPLRYARNYQVRIAGAETNTLIGLSKLGKKAGWITRLGKDEFGAMILSSVRGEGVDVSQVKLDDAAPTGLFFKERKSAAKVNVFYYRTLSAASFLKKCDIDEQYIEKAGLLYITGITPALSESASDAVFYAVELAKKHNKCVVFDPNFRKKLWDGERARQTMFELIKRSDIVLPGLSEGRFLFGTADEKKIAEAIRGLGAETAIIKLGSKGAYYAGGNESGYAEGYQIQAAADPVGAGDGFAAGVLSGLIDQIPLSEAVKRGCAVGAMVAAVNGDIEGLPDRESLFAFMEQSDEEDVSR

SEQ ID NO: 34635 - protein, 580 aa, Bordetella bronchiseptica RB50
MYVYDPVDQQLVEERVEQFSDQTRRFLDGQLTEDEFRTLRLQNGLYIQRHAPMLRIAIPYGMLAARQLRKLAHIARTWDRGYGHFSTRQNMQFNWPRLEDVPAILAELASVQMHSIQTSGNCIRNTTSDHFAGVAPDELVNPLVWCEIIRQWSTLHPEFAFLPRKFKIAVSGAVEDRAAVGVHDIGLQAVERDGQLGFRFWVGGGLGRTPMVGHLINPFVPWQHLLTYLQAALRVYNLHGRRDNKFKARIKILVKDLTPEVYAHEVEQEWQSLKDGPDTITEDQLNTIAGRFVWPDYDSAAASEPDPTDARAQADPRFARWLRTNVRAHKVAGYAAVTVSLKATGVPPGDITADQMDAVADLSERYGFGELRVSHEQNLVLADVRRARLHDLWQELQQLNLATPNIGLLTNIIACPGGDFCALANAVSIPVAESIQRRFDDLDYLFEIGELDLNISGCINSCGHHHVGHIGILGVDKAGEEWYQVTLGGRQNGAAKPLPDLESPRGGGAAIGRIIGPSFARTQIPDVIDRLIRTYLELRDSDAERFIDVVDRVGIDPFKRDVYADPAVAKPASQQEPAHA

SEQ ID NO: 34636 - protein, 526 aa, Yarrowia lipolytica CLIB122
MFQLFSILVLAFTTALVAQLAYNQYDYQRKVKKFGCGQLRVAENGLFGWKGLREVLRINKYKLGPAALKDRFEKYGKTHVFHVGPSPLITTMDPENIKAMLATQFKDFCLIARYKALGPMLGDGIFTLDGHGWTHSRALLRPQFAREQVSRLDSIEHHFQILKKCISKEMSDKRDTQRGFDIQNLFFLMTLDTATEFLFGSSVDSLVDFLDDPSIQTGDHGGIDEAARKGFSNAFNRAQELSSLRTRLHKLYWVIGTLAVREPYHRYNREVKTFVDHYAAKAIKARNEKNTDLLDNDKYIFMYELVKETSNPITLRDQMLNILLAGRDTTASMLSWIYFRLARDPKRYAKLRAAVLADFGPGPENITFESLKKCDYLRYVLNESLRVYPVVPINARTASRDTTLPRGGGPDGSQPIFVPKGQTVSYSVWWTHRDPEFWGQDAEEFIPERWDTKNGSIGRGWEYLPFNGGPRICLGQQFALTEVGYVLSRMVQTYETLESGDTKPLPPLYNHALTLCHQEGVWIKTE

SEQ ID NO: 34637 - protein, 314 aa, Rhizobium etli
VMFDGSSIGGWKAINESDMVLMPDTETVHMDPFFAQSTMVILCDILDPVSGEAYNRDPRGTAKKAEAYLKASGIGDTIFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 34638 - protein, 314 aa, Rhizobium tropici
VMFDGSSIAGWKAINESDMVLMPDPDTVHMDPFFAQSTMVILCDILDPISGESYNRDPRGTAKKAEAYLKASGIGDTAFFGPEAEFFVFDDVKYKADPYNTGFKLDSSELPSNDDTDYETGNLGHRPRVKGGYFPVPPIDSCQDMRSEMLTVLTEMGVTVEKHHHEVAAAQHELGIKFDTLVRSADGMQIYKYVVHQVANAYGKTATFMPKPIFGDNGSGMHVHQSVWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 34639 - protein, 81 aa, Oryza sativa
  misc_feature (70)..(70): Xaa can be any naturally occurring amino acid
MSGFRGNRGGGGGGGGFRGGGGGRGGGGGFRGGRGGGGGRGGFGRRDEDFGPPERVIQTGAMLHTCDDQXVIKSTQLDQVP

SEQ ID NO: 34640 - protein, 314 aa, Rhizobium tropici
VMFDGSSIAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKSGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 34641 - protein, 214 aa, Thermus thermophilus HB8
MDLSAVRFDEKGLVPVVVQDARTGEVLTLAYANREALEETLRTRRSTFFSRSRQALWRKGETSGHTQEVVEVLLDCDGDAVVYRVLPQGPACHTGERTCFHRALLEGEKDLGFVVGQVYATIKERLRTLPEGSYVARMHQAGLDRILKKIGEEAGEVILAAKNQNPEELRHEAADLLFHLLLTLAELGLTPEDLAKTLWERHRPRSPYDGSHGN

SEQ ID NO: 34642 - protein, 425 aa, Shewanella sp. ANA-3
MSTTNDSLMARRQAAVAGGVGQIHPVFTARAENATVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSNIAAIILEPVQGEGGFYAASPEFMQRLRALCDREGIMLIADEVQTGAGRTGTFFAMEQMGVSADITTFAKSIAGGFPLSGITGKAEVMDAIGPGGLGGTYGGNPLACAAALAVLEVFEEEKLLERANAIGERIKSALNTMQVEHPQIADVRGLGAMIAIELMEEGKPAPQYCAQILAEARNRGLILLSCGTYGNVLRILVPLTVPDEQLAAGLGILKSCFDAVLKG

SEQ ID NO: 34643 - protein, 290 aa, Zea mays
LVLTRPVHEVCSDRVCGGFVITEAGFGADIGTEKFMDIKCRYSGLVPQCAIIVATIRALKMHGGGPEVVAGKPLDHAYVSENVALVEAGCINLAKHISNTRSYGVNVVVAINKFASDTEAEMKAVHSAAMAAGAFDAVVCTHHAHGGKGAVELGLAVQRACESQAEPLKFLYPLESSIKEKIESIAKFYGASGVEYSEQAEKQIEMYTKQGFSSLPICMAKTQYSFSHVPSMKGAPTGFVLPIRDVRASIGAGFIYPLVGTMSTMPGLPTRPCFYQIDVDTATGKVMGLS

SEQ ID NO: 34644 - protein, 314 aa, Sinorhizobium terangae
VMFDGSSISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 34645 - protein, 314 aa, Sinorhizobium fredii
VMFDGSSIAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 34646 - protein, 314 aa, Sinorhizobium medicae
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFP

SEQ ID NO: 34647 - protein, 314 aa, Sinorhizobium meliloti
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFP

SEQ ID NO: 34648 - protein, 314 aa, Sinorhizobium saheli
VMFDGSSIAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFP

SEQ ID NO: 34649 - protein, 314 aa, Rhizobium galegae
VMFDGSSIGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFP

SEQ ID NO: 34650 - protein, 314 aa, Bradyrhizobium japonicum
TMFDGSSIAGWKAINESDMCLMPDPVTETIDPFFAETTMVIACDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCVHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFP

SEQ ID NO: 34651 - protein, 325 aa, Schizosaccharomyces pombe 972h-
MAENENHVLSIRMSHPYYSEKEISRILSTRDPKENNLRMQAFAWISTLSKTLKFPVRTSGLAMLLYSRFQLFFPVNEIPLLECATACLVVASKIEDTAKKFRDILLAHYLQKHPGSEVDAHSQKRILGLERMTLELICFDFRVRHPHNYMVKFAKSLKFSSSTASIAWNVCTDAYKTYTMLKYPAHIVAVASISIACKLQQLPQPIIPRSFFAPPALTEAVIADILDLYMHYQPHTCIGNMYTTEKLLGLCVDFQRAQKNSGRPQKPPQIDPHSSSLADEYRESNKRLQESKESCARFILDCDRKYFNTEFEKRMLEERRNKGTV

SEQ ID NO: 34652 - protein, 544 aa, Schizosaccharomyces pombe 972h-
MGSDGSSLSPKVSQPGHTEIVDHVSEKVITNGKNVNKKVNAEVDGKSMVEKVKTHEENAEDYHYGGYHPVYIGEEFHHRRYVVERKLGWGHFSTVWLAYDRAAKRRVALKVVRSAEHYRETSIDEIRILQKIREGDEKHLGKKHIISLLDYFVHRGPNGAHVCMVFEVLGENLLSLIQSYGHRGVPVGIVKQIAYQLLIALDYLHRECGIIHTDLKPENVLICIDQDALQHIEAPATTSSPTSNTSSSKTRNNTGYTAKAPIIKRGQSVDNSAQERKTFAKNPTKNSKPAGQVIPSSPFTSTLSRFPSLEGAVSEISLRDSQKHNSHPNSPFSSGDNSLILDGVNGSQEPVPKITVKIADLGNACWTRKHFTNDVQTRQYRSPEVILGCRWGASADCWSFACIIFELLTGDYLFDPRNGNSYSKEDDHIAQIIELLVNYPKQMALSGKHSRDLFNRRGELRNIHKLKFWPLKDVLEQKYHFSAELAQQISDFLSPMLCFDPAKRTNAGYMSNSPWLREVADPTFKIETTGATGEDVPGWATEIR

SEQ ID NO: 34653 - protein, 322 aa, Legionella pneumophila subsp. pneumophila str. Philadelphia 1
MTIDRIRALVSEDFNAVNNLIIDKIQSQVGLIQDLSQHIVESGGKRLRPLVVLLASNACGYKGKDHISLAAMVEFFHTATLLHDDVIDESTLRRGRQTANSIWGSKASVLVGDYLFTQSVNLMVEVGIKEILNLLANTSHQITCGEVKQLANRHNPALTLDDYFDVIRAKTALLFAAAACIGPILTNAPIELRNSLYNYGLHLGNAFQLIDDALDYCSDAATLGKNIGDDLADGKATLPLIHALQNGNATQQQQIRESLMKGSLSHLPDILIAIEQTEAIPFTKRIAAQEVDSALSALEILPDSVYKEALVDLAKFALERNY

SEQ ID NO: 34654 - protein, 298 aa, Shigella flexneri 2a str. 2457T
MIRVACVGITVMDRIYYVEGLPTESGKYVARNYTEVGGGPAATAAVAAARLGAQVDFIGRVGDDDAGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 34655 - protein, 459 aa, Pythium irregulare
MVDLKPGVKRLVSWKEIREHATPATAWIVIHHKVYDISKWDSHPGGSVMLTQAGEDATDAFAVFHPSSALKLLEQFYVGDVDETSKAEIEGEPASDEERARRERINEFIASYRRLRVKVKGMGLYDASALYYAWKLVSTFGIAVLSMAICFFFNSFAMYMVAGVIMGLFYQQSGWLAHDFLHNQVCENRTLGNLIGCLVGNAWQGFSVQWWKNKHNLHHAVPNLHSAKDEGFIGDPDIDTMPLLAWSKEMARKAFESAHGPFFIRNQAFLYFPLLLLARLSWLAQSFFYVFTEFSFGIFDKVEFDGPEKAGLIVHYIWQLAIPYFCNMSLFEGVAYFLMGQASCGLLLALVFSIGHNGMSVYERETKPDFWQLQVTTTRNIRASVFMDWFTGGLNYQIDHHLFPLVPRHNLPKVNVLIKSLCKEFDIPFHETGFWEGIYEVVDHLADISKEFITEFPAM

SEQ ID NO: 34656 - protein, 364 aa, Staphylococcus aureus subsp. aureus MW2
MITAEKKKKNKFLPNFDKQSIYSLRFDEMQNWLVEQGQQKFRAKQIFEWLYQKRVDSIDEMTNLSKDLRQLLKDNFTVTTLTTVVKQESKDGTIKFLYELQDGYTIETVLMRHDYGNSVCVTTQVGCRIGCTFCASTLGGLKRNLEAGEIVSQVLTVQKALDATEERVSQIVIMGIGEPFENYDEMMDFLRIVNDDNSLNIGARHITVSTSGIIPRIYDFADEDIQINFAVSLHAAKDEVRSRLMPINRAYNVEKLIEAIQYYQEKTNRRVTFEYGLFGGVNDQLEHARELAHLIKGLNCHVNLIPVNHVPERNYVKTAKNDIFKFEKELKRLGINATIRREQGSDIDAACGQLRAKERQVETR

SEQ ID NO: 34657 - protein, 62 aa, Zea mays
YTRAYVDQTALLYRLCWSLCGALKGVIQWGNHALYNSVHDAVLAIVDFIKRVGPIGWDYLWS

SEQ ID NO: 34658 - protein, 555 aa, Moritella marina
MCSIFGILDIKSDIKPLREQALELSKLLRHRGPDWSGIYTSDNAILVHERLAIVDVNNGAQPLYNEEKTHVLAVNGEIYNHKDLKKTLNVDFEFQTESDCEVILALYKEKGTQFLDDLNGIFAFALYDETEDAYLIGRDHIGIIPLYTGYDEHGNFYVASEMKALVPICTQIEEFPAGHYLWSKDGVVTPYYQRDWKDFDNVAQNGGDKSVVKQGLEDAVKRQLMCDVPYGVLLSGGLDSSVISAITQQYAKRRIEDGGKTEAWWPQLHSFSVGLNGSPDLAAAQKVADHLGTIHHSIEFTVQEGIDALRDVIYHIETYDVTTIRASTPMYLMARKIKAMGIKMVLSGEGADELFGGYLYFHKAPNAKEFHEETVRKVNKLHMFDCLRANKSMAAWGIEARVPFLDKEFVDASMRLNPELKMITGDRIEKNIIREAFEDLLPEEIVWRQKEQFSDGVGYSWIDQLKVHVEEAVTDQMLASAAFKFPINTPDTKEGYYYRAIFEDHFPGDSAAKCVPFGKSVACSTVEALAWDESFQNNADPSGRAAGVHNEAYED

SEQ ID NO: 34659 - protein, 419 aa, Sulfolobus tokodaii str. 7
MLSRKIIEESDIYLATSTRDPELFPLVIDHGEGVWIYDVDGNKYLDFTSGIGVNNLGWPSHPEVIKIGIEQMQKLAHAAANDFYNIPQLELAKKLVTYSPGNFQKKVFFSNSGTEAIEASIKVVKNTGRKYIIAFLGGFHGRTFGSISLTASKAVQRSIVGPFMPGVIHVPYPNPYRNPWHINGYENPSELVNRVIEFIEDYIFVNLVPPEEVAGIFFEPIQGEGGYVIPPKNFFAELQKLAKKYGILLVDDEVQMGLGRTGKLFAIENFNTVPDVITLAKALGGGIMPIGATIFRKDLDFKPGMHSNTFGGNALACAIGSKVIDIVKDLLPHVNEIGKIFAEELQGLADDVRGIGLAWGLEYNEKKVRDRIIGESFKRGLLLLPAGRSAIRVIPPLVISEEEAKQGLDILKKVIKVVK

SEQ ID NO: 34660 - protein, 482 aa, Shewanella sp. ANA-3
MLLKDPSLLRQQCYINGQWCDAQSKETVAIANPATGAVIASVPVMGQAETQAAIAAAEAALPAWRALTAKERGVKLRRWFELLNENSDDLALMMTSEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPVVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGIGEGVTTGPLINCAAVEKVQSHLEDALSKGATVVAGGKPHSLGGNFFEPTVLTNVDSSMRVAREETFGPLAPLFKFTDVDDVIKQANDTEFGLAAYFYGRDISLVWKVTEALEYGMVGVNTGLISTEVAPFGGMKSSGLGREGSKFGIEEYLEIKYICMSV

SEQ ID NO: 34661 - protein, 363 aa, Bacillus licheniformis ATCC 14580
MTKQTISVQLSTAKKQKPEADKLEFGRTFTDHMFIMDYTAENGWHDPRIVPYQPIEMDPAAMVYHYGQSVFEGLKAYLSSEGRVLLFRPEKNFERLNKSNDRLCIPRVDPEIVLEGLKQLVQIDKEWIPQAEGTSLYIRPFIISTEPYLGVAPSNMYKMLIILSPVGSYYKEGIRPVKIAVESEFVRAVAGGTGNAKTAGNYAASLKAQEVAESKGFSQVLWLDGVEKKYIEEVGSMNIFFKISGEIVTPALNGSILEGITRNSVIHLLKQWGLSVTERKISVDELVQAHKDGLLEEAFGTGTAAVISPVGELIWKDESLVINNGQTGEIAKRLYQTITGIQKGALPDTFGWTVEVDKVSQSC

SEQ ID NO: 34662 - protein, 554 aa, Magnaporthe grisea 70-15
MEFKTVEFKSFTDQKPGTSGLRKKVTVFQQPHYSESFVTSILLSIPEGADGAFLVIGGDGRFYNPEVIQLIAKIGLAYGVKKLLIGQNGILSTPAASHVIRKRKATGGILLTASHNPGGPKNDFGIKYNLANGGPAPESVTNKIYETTKTLTSYKIASIPDIDITNIGTKTYEGLEVEVVDSCEDYTAMLKDIFDFDLIKKFFASNSDFKVLFDGLSGVTGPYGKAIFQEELGLGAESTQNCEPSPDFNGGHPDPNLVYAKSLVDVVEEKKIPFGAASDGDGDRNMIYGAGAFVSPGDSLAIIAHHAKLIPYFKKNGVFGLARSMPTSGAVDLVAKKQGLNCYEVPTGWKFFCALFDADKLSICGEESFGTGSNHIREKDGLWAIVAWLNIIAGLGVEHPDVTPSIKQIQLDFWKEYGRTFFTRYDYEDVDSEGANKLVKTLQEKMADSSFVGSKIGDLTVTEAGDFSYTDLDGSVSKNQGLYVRFSSGSRIVVRLSGTGSSGATIRLYIEQYSDDASTYEKDAQDFLGPEIKFATELLKFKEFVGRDEPDVKT

SEQ ID NO: 34663 - protein, 314 aa, Mesorhizobium tianshanense
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRTKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 34664 - protein, 176 aa, Idiomarina baltica OS145
MDLIKSIRDSIRAIPDYPKPGITFRDISPLLQSKDAFKSTIEAFAQRYQELGIDQIAAVEARGFIFGAALAQRLGCGLTLLRKPGKLPGPVVKETYALEYGEDALEIQECAFKEPQRVLLMDDLLATGGTVAAAAKLLSRTQAELLEAAFVITLDDLPGEQKLQDLGISCYTLCRF

SEQ ID NO: 34665 - protein, 512 aa, Thlaspi caerulescens
MSRLENDRPLLIDRIDEEEEETAYDETEKVHIVRDEDDNERDLEYGVGCGGAPPFSWRKLWLFTGPGFLMSIAFLDPGNLEGDLQSGAVAGYSLLWLLMWATAMGLLVQLLSARLGVATGRHLAELCREEYPSWAGMVLWVMAELALIGSDIQEVIGSAIAIKILTNGILPLWAGVIITALDCFFFLFFENYGIRKLEAVFAVLIATMGVSFAWMFGQAKPSGSELLVGILVPKLSSRTIQKAVGVVGCIIMPHNVFLHSALVQSREVDKRQKYRVQEAINYYTIESTLALFVSFLINLFVTTVFAKGFYNTDLADSIGLVNAGQYLQDKYGGGLFPILYIWGIGLLAAGQSSTITGTYAGQFIMGGFLNFRMKKWMRALITRSCAIIPTIIVALVFDSSEATLDVLNEWLNVLQSIQIPFALIPLLCLVSKERIMGSFKIGPLCQTIAWLVAALVIMINGYLLVEFFSSEVSGIVYTGFVIVFTASYGAFIVYLIARGINFTPWRPKAESS

SEQ ID NO: 34666 - protein, 303 aa, Pichia jadinii
MSTTLSSSTYGKDNVKFLKVKKDPQNPKKQEVMEATVTCLLEGGFDTSYTEADNSSIVPTDTVKNTILVLAKTTEIWPIERFAAKLATHFVEKYSHVSGVSVKIVQDRWVKYAVDGKPHDHSFIHEGGEKRITDLYYKRSGDYKLSSAIKDLTVLKSTGSMFYGYNKCDFTTLQPTTDRILSTDVDATWVWDNKKIGSVYDIAKAADKGIFDNVYNQAREITLTTFALENSPSVQATMFNMATQILEKACSVYSVSYALPNKHYFLIDLKWKGLENDNELFYPSPHPNGLIKCTVVRKEKTKL

SEQ ID NO: 34667 - protein, 220 aa, Frankia sp. EAN1pec
MRTVITDGLPSQLPDIDPSETSEWLESLDAVIEESGRGRARFLMLKLLERAREKAVGVPGLTSTDFINTIPPEQEPWFPGDEHVERRIRAYIRWNAAIMVSRANRPEYNVGGHIATYASSASLYEVGFNHFFRGKDHLTSSPGSDSGDQIFIQGHASPGIYARAFLEGRLTEAQLDAFRREGEPGGLSSYPHPRLMPDFWEFPTVSMGLGPIDAIYQARF

SEQ ID NO: 34668 - protein, 658 aa, Arabidopsis thaliana
MERSNLFHIPCFLLLFLLFNINGVHTTFVCGDEDFSPNTSYVENLESLLPSLASNVIRERGFYNVSLDGVYALALCRKHYEVQACRRCVDRASRTLLTQCRGKTEAYHWDSENDANVSCLVRYSNIHRFGKLKLEPIGNVPHSSLDPSSNLTRISQEFAARANRTVEVASTADESSVLKYYGVSSAEFTDTPEVNMLMQCTPDLSSSDCNHCLRENVRYNQEHNWDRVGGTVARPSCYFRWDDYRFAGAFDNLERVPAPPRSPQTRQDYRVKKGRMFQPWSVVVVVFPTGINLAVFVAFVLAYRRMRRRIYTEINKNSDSDGQATLRFDLGMILIATNEFSLENKLGQGGFGSVYKGILPSGQEIAVKRLAGGSGQGELEFKNEVLLLTRLQHRNLVKLLGFCNEGNEEILVYEHVPNSSLDHFIFDEDKRWLLTWDVRYRIIEGVARGLLYLHEDSQLRIIHRDLKASNILLDAEMNPKVADFGMARLFNMDETRGETSRVVGTYGYMAPEYVRHGQFSAKSDVYSFGVMLLEMISGEKNKNFETEGLPAFAWKRWIEGELESIIDPYLNENPRNEIIKLIQIGLLCVQENAAKRPTMNSVITWLARDGTFTIPKPTEAAFVTLPLSVKPENRSMSERKDKDPFSVDEVSITVLYPR

SEQ ID NO: 34669 - protein, 107 aa, Synechococcus sp. CC9311
MDSKTKERIQTLIQSSPIFVFMKGTKLMPQCGFSNNVVQILNALGMSFETFDVLSDMEIRQGIKDYSDWPTIPQVYVKGEFMGGSDILIEMYNNGELKEKLEIELAS

SEQ ID NO: 34670 - protein, 290 aa, Frankia sp. EAN1pec
MSASSDINPLNFLSILTGSFATPAGENPTAAMIESAYRHHRIDACYINCEVAPEALGDAVRGARAMGWVGFNCSIPHKVAVIEHLDGLGESATIIGAVNCAVRRDDGWIGENTDGQGFLTSLRAQVDPAGQHVVLFGAGGAARAIAVETALAGAASITVVNRGTGRGRELSRLIAAKTPTAAEFVRWDGPYQVPEWASIVVNATSIGLFPDADARLNLDLDSLRPHMLVADVIPNPPRTRLQRDAAERGCVTLDGLGMLVNQGVISIRHWLGVDVDPAVMRERLAEILGS

SEQ ID NO: 34671 - protein, 305 aa, Corynebacterium efficiens YS-314
METTPKHGIWLGKDRADGWAQKKGENTALVYGCTYFSHSKRGRRFVSTIGTMTELITSGPFTLSPVGAHLTSVDFDSGDVLFLSSESKFGEGNAIRGGIPLIAPWFGTLLGREPQHGWARTTEWEVMEGDKLSAGLVRDGLELQLSLWRTELGFEMNLGLTNKSDKTETVQLAFHPYFRVADVEKTTVTGAEGAQILDRVTDETSTQDGAITFDGLYDRVVLGSPEMLIDDGSRTIEVIGRGHDATVVWNPGAEKGASFDDLGDGEWRDFVCVEPALLGEDLKGVKVEPGDSISIGMEVKVTAKN

SEQ ID NO: 34672 - protein, 456 aa, Pythium irregulare
MGTDQGKTFTWQEVAKHNTAKSAWVIIRGEVYDVTEWADKHPGGSELIVLHSGRECTDTFYSYHPFSNRADKILAKYKIGKLVGGYEFPVFKPDSGFYKECSERVAEYFKTNNLDPKAAFAGLWRMVFVFAVAALAYMGMNELIPGNVYAQYAWGVVFGVFQALPLLHVMHDSSHAACSSSPAMWQIIGRGVMDWFAGASMVSWLNQHVVGHHIYTNVAGADPDLPVDFESDVRRIVHRQVLLPIYKFQHIYLPPLYGVLGLKFRIQDVFETFVSLTNGPVRVNPHPVSDWVQMIFAKAFWTFYRIYIPLVWLKITPSTFWGVFFLAEFTTGWYLAFNFQVSHVSTECEYPCGDAPSAEVGDEWAISQVKSSVDYAHGSPLAAFLCGALNYQVTHHLYPGISQYHYPAIAPIIIDVCKKYNIKYTVLPTFTEALLAHFKHLKNMGELGKPVEIHMG

SEQ ID NO: 34673 - protein, 307 aa, Mycobacterium leprae TN
MDSAAQSNQAQSVFGQTGTARVKRGMAEMLKGGVIMDVVIPEQARIAEGSGAVAVMALERVPSDIRAQGGVSRMSDPDMIESIIAAVTIPVMAKARIGHFVEAQILQSLGVDYIDESEVLTPADYTHHIDKWKFTVPFVCGATNLGEALRRINEGAAMIRSKGEAGTGDVSNATTHMRAIAGDIRRLTSLSEDELYVAAKELHAPYELVIEVARTNKLPVTLFTAGGIATPADAAMMMQLGAEGIFVGSGIFKSSDPAQRAAAIVKATTFYDDPDVLAKVSRGLGEAMAGIDVEQIAQPDRLAQRGW

SEQ ID NO: 34674 - protein, 357 aa, Picrophilus torridus DSM 9790
MAKDYYAILGVDRNASQDDIKKAFRELAKKYHPDANPGNKEAEEKFKEIAEAYEVLSDPQKRKQYDETGTTDFNAGSGFNWQDFTHFDDINDIFNQFFGGNFGDTFFGGYTNQPDLDIYLRVNISLEDAYYGASKNVKYRRNAMCEHCSGTGAENKVLITCPTCHGSGQERITRGQGFFRMVTVTECRTCHGRGKIPQKPCTVCHGTGTVSKNEDISVNIPKGADTNLKLRLKNMGNSYGGVTGDLYIVLIVNNPPGIRRSGQDIYVEHTIDFPEAALGGEEEIKLFRESYNLKIPAGTQPGEILKIKGAGMPRINGHGSGDLNVIIKIEVPKHLTSRQKELLEEFRNEKKKSWFHF

SEQ ID NO: 34675 - protein, 438 aa, Aspergillus oryzae
MGSTSTSTLPPDFLWGFATASYQIEGAVNEDGRGPSIWDTFCKIPGKIAGGANGDVACDSYHRTHEDIALLKACGAKAYRFSLSWSRIIPLGGRNDPINEKGLQYYIKFVDDLHAAGITPLVTLFHWDLPDELDKRYGGLLNKEEFVADFAHYARIVFKAFGSKVKHWITFNEPWCSSVLGYNVGQFAPGRTSDRSKSPVGDSSRECWIVGHSLLVAHGAAVKIYRDEFKASDGGEIGITLNGDWAEPWDPENPADVEACDRKIEFAISWFADPIYHGKYPDSMVKQLGDRLPKWTPEDIALVHGSNDFYGMNHYCANFIKAKTGEADPNDTAGNLEILLQNKKGEWVGPETQSPWLRPSAIGFRKLLKWLSERYNYPKIYVTENGTSLKGENDLPLEQLLQDDFRTQYFRDYIGAMADAYTLDGVNVRAYMAWSLME

SEQ ID NO: 34676 - protein, 495 aa, Pseudomonas fluorescens Pf-5
MSVAIDPRVAAFIDSQHGLLIDGHSQPALSGARMAVYNPASGEQLAEVAAAAQADIDLAVNAARRAFEGSWKAQRPADRERLLLKLADLLEANGEELAQLETLNNGQSIHLARALEVGAAAEFTRYMAGWATKIEGKSLDVSIAAVPGAQYRAYTVPEPVGVVGAIVPWNFPLLMAIWKIVPALACGCTVVLKPADETPLTALRLGQLCLEAGIAPGVVNVVTGSGAQAGAALAAHSGIDKLAFTGSTQVGKLIGHAAVDNMTRFSLELGGKSPVIVLDDCDPQTAAAGAAGAIFFNQGQVCTAGSRLYIQRRIYNEVLERLVAIAGSLSIGPGLDEQAQINPLISAKQQKRVLQMVQRGVEEGARLLCGGVAHGERGFYVRPTVVADVHADQQLVREEIFGPVVVATPFDTLDEVVGLANDNQYGLGASIWSNDLGRVMQLIPQIKAGTVWVNTHNMLDPSMPFGGYKQSGIGREMGHAAIEAYTENKSVCIAY

SEQ ID NO: 34677 - protein, 339 aa, Francisella tularensis subsp. holarctica
MYLKLYTLYKEYTNYKTIMQKSVLEQLKQVTMVVADTGDFELIKKYKPVDATTNPNLILKVVKEQKYSNLVAKTISKVKANNPDLNSDDLVKEIAIEILVSFGIKILDVIEGKVSSEVDARVSFNSAATIDYAKRIIARYESNGISKDRVLIKIAATWEGIKAAKLLQKEGINCNLTLIFDKAQAKACAEAGVYLVSPFVGRITDWQIQQNNLKTFPAIADDDGVNSVKAIYKLYKSHGFKTIVMGASFRNVEQVIALAGCDALTISPVLLEELKNRDEHLEVKLTKNDDVVTQSPQISEADFRWLMNENAMATHKLAEGIRLFTKDTIELENIIKQNL

SEQ ID NO: 34678 - protein, 444 aa, Pseudomonas fluorescens Pf-5
MSEPSRFWHPMLHPNEMKQREPIRIVRGDGCYVYDDKGHQLVDGVAGLWNVNVGHNRKEVKAAITAQLDELEYFQLFDGVSHPRAEELSRVVMNLLEPEDMRRVAFSSGGSDAIESALKLARQYWKLEGQADRTKFISLRQGYHGTHFGGASVNGNTVFRRNYEPLLPGCYHIDTPWLYRNPYSQDPEELGKICADLLEREIQFQSPDTVAAFIAEPIQGAGGVIVPPANYWPLIREVCDKYGVLLIADEVVTGFGRSGSMFGSRLWGVKPDIMCLAKGITSGYIPLGATVVNRRIEEAFEKNANFTGAIMHGYTYSGHPVACAAALACLDIVVKEDLPANAAKMGDYMLDKLLPFVERFDTVGEVRGKGLMLALDLVADKTTREPIDPMSGYANQVAQIARDNGVMVRPVGTKIILSPPLVIQQAQADAIVDALAEGLSKARR

SEQ ID NO: 34679 - protein, 517 aa, Mesorhizobium sp. BNC1
MTRETFYITTAISYPNGRPHIGHAYELIATDALARFQRCDGKDVMFLTGTDEHGIKMLQTARKEGITAGELADRNAPEFQRMAKLLNASNDDFIRTTEERHRTASQAIWKAMADRGDIYLGGYSGWYSVRDEAYYGEDETRVGEDGVRYGPQGTPVEWVEEESYFFRLSAYQERLLKLYEENPDFIGPAERRNEIVSFVRSGLRDLSISRTTFDWGVPVPGDEKHVMYVWVDALTNYITALGYPDQDAERWRYWPADVHIIGKDIIRFHAIYWPAFLMSAGIALPKRVFGHGFLFNRGEKMSKSVGNVIDPFTMIEHYGLDQVRYFFLREVPFGQDGSYSHEAIVNRTNADLANDLGNLAQRSLSMIAKNCDGKVPARGELSAADRAILDQAEAALATARGAMGRQAIHAALAAIFDVVAEANRYFAAQEPWALRKTDPARMETVLYTTAETLRRIAILCQPFIPSSAEKLLDLLSVPQDRRGFADVGETAMLAPGTPLPAPQPVFPRYVEQEGQEG

SEQ ID NO: 34680 - protein, 432 aa, Nicotiana glutinosa
MAGQTIIVSGLNPAAILQSTIGGGASPTAAAAENGTRKVIPLSRDALQDFMLSIITQKLQDEKQPFYVLDLGEVVSLMDQWKSSLPNIRPFYAVKCNPEPSFLSILSAMGSNFDCASRAEIEYVLALGISPDRIVFANPCKPESDIIFAAKVGVNLTTYDSEDEVYKIRKHHPKSELLPRIKPMFDGNARCPMGPKYGALPEEVEPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTVIGKRVRGELREYWINDGLYGSMNCVLYDHATVNATPLAVLSNRTNVTCGGSKTFPTTVFGPTCDALDTVLRDYQLPELQVNDWLVFPNMGAYTKAAGSNFNGFNTSTIVTHLAYTYPS

SEQ ID NO: 34681 - protein, 479 aa, Escherichia coli
  misc_feature (1)..(1): Xaa can be any naturally occurring amino acid
  misc_feature (16)..(16): Xaa can be any naturally occurring amino acid
  misc_feature (20)..(20): Xaa can be any naturally occurring amino acid
  misc_feature (105)..(105): Xaa can be any naturally occurring amino acid
  misc_feature (122)..(122): Xaa can be any naturally occurring amino acid
  misc_feature (139)..(139): Xaa can be any naturally occurring amino acid
  misc_feature (187)..(187): Xaa can be any naturally occurring amino acid
  misc_feature (411)..(411): Xaa can be any naturally occurring amino acid
XAQHTVYFPDAFLTQXREAXPSTLSFDDFLAACQRPLRRSIRVNTLKISVADFLQLTAPYGWTLTPIPWCEEGFWIERDNEDALPLGSTAEHLSGLFYIQEASSXLPVAALFADGNAPQRVXDVAAAPGSKTTQISARXNNEGAILANEFSASRVKVLHANISRCGISNVALTHFDGRVFGAAVPEXFDAILLDAPCSGEGVVRKDPDALKNWSPESNQEIAATQRELIDSAFHALRPGGTLVYSTCTLNQEENEAVCLWLKETYPDAVEFLPLGDLFPGANKALTEEGFLHVFPQIYDCEGFFVARLRKTQAIPALPAPKYKVGNFPFSPVKDREAGQIRQAATGVGLNWDENLRLWQRDKELWLFPVGIEALIGKVRFSRLGIKLAETHNKGYRWQHEAVIALASPDNXNAFELTPQEAEEWYRGRDVYPQAAPVADDVLVTFQHQPIGLAKRIGSRLKNSYPRELVRDGKLFTGNA

SEQ ID NO: 34682 - protein, 498 aa, Shewanella sp. ANA-3
MSTPKKRSDWESLAASLAINGKAYINGEYRDAAAGSTFDCVSPIDGRVLAKVASCDQMDANIAVANAREVFESGVWSKTAPVKRKQVMIRFAELLEENANELALLETLDMGKPIRFSKAVDIAGAARAIRWSGEAVDKLYDELAPTAHNEIGMITREPVGVVAAIVPWNFPLLMACWKLGPALATGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIAFNQGEVCTAGSRLLVESGVKDQLIELIAEELASWQPGHPLDPATVSGAVVDKQQLDTILSYIKAGQDEGASLVHGGQQVLAETGGVYVQPTIFSQVNNKMKIASEEIFGPVLSVIEFNGMEEAIAIANDTIYGLAAGVWTADISKAHKTAKALRSGMVWINHYDGGDMTAPFGGYKQSGNGRDKSMHSFDKYTEIKATWIAL

SEQ ID NO: 34683 - protein, 446 aa, Shewanella sp. ANA-3
MADSPYNTTHEHPSLEHYWMPFTANRQFKASPRLLAQAEGMYYTDINGNKVLDSTAGLWCCNAGHGRREISEAVSKQIREMDYAPSFQMGHPLAFELAERLTELSPEGLNKVFFTNSGSESVDTALKMALCYHRANGQASRTRFIGRELGYHGVGFGGISVGGLSNNRKAFSGQLLQGVDHLPHTLDIQNSAFSRGLPSLGAEKAEVLEQLVTLHGAENIAAVIVEPMSGSAGVILPPQGYLKRLREITQKYGILLIFDEVITAFGRVGAAFASQRWGVIPDIITTAKAINNGAIPMGAVFVQDFIHDTCMQGPTELIEFFHGYTYSGHPVAAAAALATLSIYENEQLFERSFELERYFEDAVHSLKGLPNVIDIRNTGLVAGFQLAPNSQGAGKRGYSVFEHCFHQGTLVRATGDIIAISPPLIVEKHQIDQIVNSLSDAIHAVG

SEQ ID NO: 34684 - protein, 371 aa, Bacillus licheniformis ATCC 14580
MGKQGVFKPGLEGVIAGETNISFLDTEAEQIVIKGYDLIELAEQKTYLDLVYLLLQDKLPDPMELKGIESALKSAYELPGGIYTILKSLPNNTHPMDALRTGISALAGYDPELNDRSQAANRSKALRLIAQVPNITANSYRILHQKNVITPDKQLSFSQNFLYMLTEKEPTPQETAVFDQTLMLYSEHEMPNSTFAARVIASTNTDIYGAFTGAAASLKGHLHGGANEAVMYMLLEGETKSGFCKLIEHKLSRKEKIMGFGHRVYMRKMDPRAALLKKALYSLSHKTGRQDLYEMCDAGEKLMREEKGLYPNLDYYAAPVYYLLGIPIDLYTPIFFAARSVGLSAHVIEQHEDNRLFRPRVHYTGPRHLHP

SEQ ID NO: 34685 - protein, 1057 aa, Staphylococcus aureus subsp. aureus MSSA476
MPKRNDIKTILVIGSGPIIIGQAAEFDYAGTQACLALKEEGYRVILVNSNPATIMTDKEIADKVYIEPLTHDFIARIIRKEQPDALLPTLGGQTGLNMAIQLHESGVLQDNNVQLLGTELTSIQQAEDREMFRTLMNDLNVPVPESDIVNTVEQAFKFKEQVGYPLIVRPAFTMGGTGGGICHNDEELHEIVSNGLHYSPATQCLLEKSIAGFKEIEYEVMRDKNDNAIVVCNMENIDPVGIHTGDSIVVAPSQTLSDVEYQMLRDVSLKVIRALGIEGGCNVQLALDPHSFDYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESFDLDYIKERISHQDDERLFFIGEAIRRGTTLEEIHNMTQIDYFFLHKFQNIIDIEHQLKEHQGDLEYLKYAKDYGFSDKTIAHRFNMTEEEVYQLRMENDIKPVYKMVDTCAAEFESSTPYYYGTYETENESIVTDKEKILVLGSGPIRIGQGVEFDYATVHAVWAIQKAGYEAIIVNNNPETVSTDFSISDKLYFEPLTEEDVMNIINLEKPKGVVVQFGGQTAINLADKLAKHGVKILGTSLENLNRAEDRKEFEALLRKINVPQPQGKTATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGLNIIGLINIQFVIAHDGVYVLEVNPRSSRTVPFLSKITDIPMAQLAMRAIIGEKLTDMGYQEGVQPYAEGVFVKAPVFSFNKLKNVDITLGPEMKSTGEVMGKDTTLEKALFKGLTGSGVEVKDHGTVLMTVSDKDKEEVVKLAQRLNEVGYKILATSGTANKLAEYDIPAEVVGKIGGENDLLTRIQNGDVQIVINTMTKGKEVERDGFQIRRTTVENGIPCLTSLDTANALTNVIESMTFTMRQM

SEQ ID NO: 34686 - protein, 560 aa, Thermus thermophilus HB8
MDQVREKPWLAHYDPGVPPEIQVPDIPLWRFLEESARRFPQNVALEFLGKTLSYQELWGLARRFAQGLKDLGVRPGDRVAIMLPNSPQFVIAFYGTLLAGGVGVNVNPLYTPRELRHQLADAGAETLVILDHLLPRYLEVEKEVPVKRVVVTGIKDFLPFPKNLLYPLKAKRDGLPLGFPKREGFHAFAELLKRPPAEPHVPDPEDLALLQYTGGTTGLSKGAMLTHRNLVANVLQIDAWDPTSKDLVGKGVMLGALPFFHVYGMTVAMNYGLFSGYKIVLLPRPEIKAIVEAIEKHQVTHFPGVPTLYVAFNNFPGIERRDLKSVRACISGSAPLPLEVAERFERLTGAKLVEGYGLTEASPVTHCNPLYGERRLGSVGLPFPGVDAKVVDEEGKELPPGEVGELAVKGPNVMKGYWNRPEETQKTLKDGWLFTGDLAKMDEDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILRRELREEFAKKQG

SEQ ID NO: 34687 - protein, 202 aa, Idiomarina baltica OS145
MLITESTVDQLAWEKMNQLVPCIVQHVLTGEVLMQGYMNRDALLQTLQTKAVTFYSRSKQRLWQKGEQSGHVLQFTGAYRDCDNDSILVQAIPQGPTCHLGTRSCFAEAPAPFLVQLNNIIKARRSASPDESYTAKLLSQPIKRIAQKVGEEGVEVALAATVQDKDELLNESADLLYHLLVTLEASDLSLEQVLEVLHQRHR

SEQ ID NO: 34688 - protein, 184 aa, Schizosaccharomyces pombe 972h-
MKIFESCHLFQYPFEQVSAAHWQKYPNEHATHVIAVDTLDRKVLDNGVLYTERLITCHQALPRWILKLIDGAQDCYIRETSYVDLKARTLTLLTSNLTFSDRLRVDETVTYSPHPELEATVFQQEARIEALACMKRLSNLIEQWSVDGFGKKASRGKEGFESVLEKINMSVFQTRPFGSSEATA

SEQ ID NO: 34689 - protein, 854 aa, Schizosaccharomyces pombe 972h-
MKTEFGFSNLVGTIFSKGNLVFTPDGFSILSPVGNRVSVYNLKDNTSYTFPFENHKNISHIALSPTSTLLLSVDEEGRCILCNFLRRSVLHYFNFKSPVGAIEFSPNGKFFAVSLGKLIQVWRTPNSLEEREFAPFVLHREYTGHFDDIVSISWSADSRFFISTSKDLTARLHSVDPIEGFHPCALTGHKNTVVSGFFSKDQQTIYTVSKDGALFVWKYSPLFQAGEVIDEEAEENKTRTHIWLIKERHYFNQNSKLRCAAFHPTSNLLVVGFSSGLFGIYELPSFTMLYQLSITQSNIDTLTVNSTGDWIAIGSSKLGQLLVWEWQSESYVLKQQSHYDALSTLQYSSDGQRIITGADDGKIKVWDMNSGFCIVTFTQHTSAVSGLCFSKRGNVLFSSSLDGSVRAWDLIRYRNFRTFTAPSRVQFSCIAVDPSGEIVCAGSQDSFEIFMWSVQTGQLLETLAGHEGPVSSLSFNSSGSLLASGSWDKTVRIWDIFSRSGIVEPLPIPSDVLSLAFHPDGKEVCVASLDGQLTFWNVQEGKQTSLIDGRKDLSGGRRFDDARTAENSSLNKTFTSICYSADGSCVLSAGTSKYVCLYDIITGVLIKKFQLSKNESLQGVQEMLNSRKMTEAGSIELIDTQGEESDLEDRIDRTLPGARRGDLSARKTRPEIICHGVQFSPSGGAFAAATTEGLMIYSLYNDFLFDPINLDMDITPSTTLTMCAEGEFLISLVMALRLNEYKVVQKVYESIPITDVEHVVQELPVSYLANFMGYLSSFAAETPHIEFHLRWMKSVLTYHGEYLRRKNFEFASQLTSLQKSIVVLSKRLSQLSSNNEFQLSFLLDKMHLRLENTA

SEQ ID NO: 34690 - protein, 239 aa, Arabidopsis thaliana
MTESSLDLQESGWEELRREARKIEGDLDVKLSSYAKLGARFTQGGYVDTGSPTVGSGRSWKSMEMEIQSLLEKLLDINDSMSRCAASAAPTTSVTQKLARHRDILHEYTQEFRRIKGNINSLREHAELLSSVRDDISEYKASGSMSPGVQVLRERASIHGSISHIDDVIGQAQATRAVLGSQRSLFSDVQGKVKNLGDKFPVIRGLLGSIKRKRSRDTLILSAVIAACTLFLIIYWLSK

SEQ ID NO: 34691 - protein, 399 aa, Candida tropicalis
MMNIDQHHQQLQQQSQAQAQAQAQAQAQAQAQAQAQAQAQAAAAAVAASSQRQVSFNVSDHYQILEIVGEGAYGIVCSAIHKPSNQKVAIKKIEPFERSMLCLRTLRELKLLKHFNHENIISILAIQRPLNFESFNEIYLIQELMETDLHRVIRTQNLTDDHIQYFIYQTLRALKAMHSANVLHRDLKPSNLLLNSNCDLKVCDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFQELFSNKPGINPLALDLLEKLLIFNPAKRITVEDALKHPYLQLYHDPNDEPISDKIPEDFFDFDKKKDSLTIEDLKKMLYEEIMKPL

SEQ ID NO: 34692 - protein, 198 aa, Shigella flexneri 2a str. 2457T
MSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKALLNMVREAVLAFNGDVQVETFSSLKKQGVDKLRQKLDTWFSEMQPVEETQDGE

SEQ ID NO: 34693 - protein, 439 aa, Bacillus halodurans C-125
MFFHGTSRVNGKGHLEIGGVDTVELANLYGTPLFVYDVALIRERAKDFKQAFADEGVQAQVAYASKAFSCIAMFQLAEELGLSLDVVSGGELYTAQQAGVSMERIHFHGNNKSRAEIEMAVEAGIGCFVVDNFYELDLLADICEQKRATANILLRITPGVEAHTHDYISTGQEDSKFGFDLVSGQATLAVKKALAVDSIHLLGVHSHIGSQIFETTGFVMAVEKIFEHLVTWREDHGFEPSVLNLGGGFGIRYIEGDTPRPVGDYVKEMIRAVKQQIAEHEMSMPEIWIEPGRSLVGDAGTTLYTIGSRKEIPNVRHYLSVDGGMSDNLRPALYQAEYEGALANRVNEQPVGMFSVAGKCCESGDMLIWDLPLPEANHEDILAVFCTGAYGYSMANNYNRIPRPPVVFVEDGDAQLVIQRERYEDLVRLDMPLVKKVKV

SEQ ID NO: 34694 - protein, 94 aa, Triticum aestivum
MEIQHHGGVGNSKVVKVQSQEAWDLFTDQASKEGRPVVAHFGASWCVTSLSMNYKFEELAQTHPEVLFLYVDVDDVQSVSSKYGVKAMPTFFLI

SEQ ID NO: 34695 - protein, 149 aa, Crocosphaera watsonii WH 8501
MLKEQLSLKLAHWLAGDFSNQKQAASSPKDYPHIRVFFRPLSWDFFEGIGFYSEQAYDYDLWSPYRQGVHRFVQKEGQVIVENYGLKEPILYAGAGRERDILKTITPDCIERGLDINTHEQVWGTTTDRLRFEKRQSFAQELPDVSTSA

SEQ ID NO: 34696 - protein, 577 aa, Magnaporthe grisea 70-15
MDKTELGAAGVHPVTSNAAGSQEKVTIQEDNKRGEDWYTRNGLNLRSFQRRDEDSGTGTAELDRTMKGRHLHMIAIGGSIGAGFFVGSGGALGSGGPGSLLINFLIIGVMMFNVVYALGELSIMYPVSGGFYTYSARFIDPSWGFAMGWNYVFQWAIVLPLELTVCGITISYWNDSISVGVWITVFWLAILIINIFGTLGYAEEEFASSAFKLLATCIFLVIAFVLVLGGGPKDGRYNEYWGARLWVDPGPFQNGFRGFCSVFVTAAFAFSGTELVGLAAAEARNPVKEMPGAIKQVFWRITLFYILGLFFVGLLIDARDPNLLGSSSHDVHASPFVLVGKYAGLKGFDHFMNITILVSVLSIGVSAVYGGSRTLTALSQQGYAPKIFSYIDRSGRPLYSVGIILVFGLLAYVNLNAQGEVVFNWLLSLSSLAALFTWGSICLAHIRFRKAWAHNGHTTDEIPFKAIGGVWGSYLGLTLNILVLAAQIFAAIAPPPKAGEEPTFSDAEGFFSAMLALPIVILFWIIGYLWKREGWLKTEQIDVDSGRRELPWDEINAYRAELAAMPAWKRIVHTVFV

SEQ ID NO: 34697 - protein, 295 aa, Nicotiana tabacum
KGGIRYHPEVDLDEVNALAQLMTWKTAVADIPYGGAKGGIGCKPKDLSRSELEPLTRVFTPKIHELIGINTDVPAPDMGTNAQTMAWILDEYSKFHGHSPAIVTGKPIDLGGSLGREAATGRGVVYATEALLAEYGKNIKDLTFAIQGFGNVGAWAAKLIHERGGKVIAVSDITGAVKNPNGLDIPALLNHKEATGKLIDFCGGDVMNSDEVLTHECDVLIPCALGGVLNRENADNVKAKFIIEAANHPTDPEADEILSKKGIVILPDIYANAGGVTVSYFEWVQNIQGFMWDEE

SEQ ID NO: 34698 - protein, 548 aa, Pseudomonas fluorescens Pf-5
MTLSPFAGKPAPAELLVDIPRLVTAYYTGQPDASVSTQRVAFGTSGHRGSSFDLSFNEWHVLAISQAICLYRESQGIDGPLFVGIDTHALSTPAGASALEVLAANGVTVMIAAGDEYTPTPAVSHAILCYNRGRTSGLADGIVITPSHNPPQSGGYKYNPTNGGPADTHITKWIEAKANELLAAKLAGVKRISYEQALKADTTHRHDYLNTYVADLINVIDLDAIRNAKLRLGVDPLGGAGVRYWSAIAEHYRLDLEVVNKQVDATFRFMSVDWDGQIRMDPSSSYAMQGLIGLKERFDVAFACDPDHDRHGIVTPSGGLLAPNNYLAVSIDYLFQNRPQWRADAAVGKTVVSSGLIDRVAARLGRRLYEVPVGFKWFADGLFDGSLGFGGEESAGASFLRRDGGVWSTDKDGLIPSLLAAEMTARTGRDPSQAYRALCDELGEPFSVRVDAKANPQQKALLSKLSPQQVTSTQLAGEPIQQILSHAPGNDQAIGGLKVMTENGWFAARPSGTEDIYKIYAESFIGDDHLKQLVQEAQTLVDTAISGN

SEQ ID NO: 34699 - protein, 116 aa, Staphylococcus aureus subsp. aureus MW2
MTNHKLIEAVTKSQLRTDLPSFRPGDTLRVHVRIIEGTRERIQVFEGVVIKRRGGGVSETFTVRKISSGVGVERTFPLHTPKIEKIEVKRRGKVRRAKLYYLRSLRGKAARIQEIR

SEQ ID NO: 34700 - protein, 603 aa, Cryptococcus neoformans var. neoformans JEC21
MSAIRPIMRPFRMTTPFRQSSSFRQLRITWAPSFGAGSSRCLTIGLSPSSGSGSSFRRRLLYPLAILPVGLLLLPVLSADSEPDAIPVPTSLSTSTTSELLRTWFIYAIISMPGVVDYSPAVLNFFINSSLRGPTEWFVRHTFFGQFVAGETVEGCMPTLKAFRERNVGAMLNYSAEVDESQLTETAPSKEERNRKEREKKFETIITALEAAGEYERSLPVDQRGVTGFALKITGLIDPNILERASYTLLRLRPLAKSNSPTAPNTHLFVPYPGTPETLDRQVVARTPELKLGDGKELLALKGKWDDMGVLEKDPGLQEGDLEELRQLWYKLQKIGHKAKENDIILYVDAEYTWYQPALDAYTLLLSQEFNRPPTSKEEIWTGPLIYGTYQTYLCRQPTHLIHAIQHAEVNGYALGVKLVRGAYFEQERKKWSDEGRVGAAPIWPNKSATDVAYNGSISTIMTTLASQLKSPHPELALSVAFGTHNPESCDLVCENLLRNGLAKEVGEAKMLRLREDVRGKVRIAQLLGMKDDLTDRMARKFVNDGKPVALKYMAYGKLSEVMPYLGRRAIENKSLMSGDHGAAAEMRRVAAELKRRFFGGSV

SEQ ID NO: 34701 - protein, 384 aa, Oryza sativa (indica cultivar-group)
MPSAAAAADLLMLGIETSCDDTAAAVVRGDGEILSQVVSSQVRYYTMPPASLFSPLTLCFCIIGHAMLCALLIVLFCAYNIWKEDLLVRWGGVAPKMAEEAHSLAIDQVVQKALDDANVSENDLSAVAVTVGPGLSLCLRVGVHKARKIAKSFRLPIVGVHHMEAHALVSSSIDVRLVNKDLDFPFLALLISGGHNLLVLAHGLGQYVQLGTTIDDAIGEAYDKSARWLGLDMRKGGGPALEQLALEGDPNAVKFSVPMRQHKDCNFSYAGLKTQVRLAIESRNISTDDIPISSATKDDRQIRANIAASFQLLKVVSGGVASNQYVRTHLNQIAEKNGLQLVCPPPKLCTDNGVMIAWTGIEHFIAGRFDDPPAVDEPDDMQVT

SEQ ID NO: 34702 - protein, 295 aa, Nicotiana tabacum
KGGIRYHPEVDPDEVNALAQLMTWKTAVANIPYGGAKGGTGCSPSDLSISELERLTRVFTQKIHDLIGIHTDVPAPDMGTNPQTMAWILDEYSKFHGYSPAVVTGKPIDLGGSLGRGAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNARDIKAKFIVEAANHPTDPEADEILAKKGVVILPDIYANSGGVTVSYFEWVQNIQGFMWDEE

SEQ ID NO: 34703 - protein, 298 aa, Ostreococcus tauri
MTSSRDANRPDQSTFSDTSSTDGSRDALVFQARLAQQCGRDDDMLSAMKVLLVASQDELTTTERNLLSVSLKNVLQRLRSSVSIARTLEIRERQLANDDGASLCRKYVKKLCVELFGFCEQTIEMVSGRARTVSAAASLDARVFWLKLMGDYWRYICEIENGIDLKDLGIERAHDARARAEDCYRAGIELASSLPITDATRLGLYLNETVFLYEIIGNRRAAIEITKACLDQTVEASPRLDDDGVDETEAIIELLANNLALWGQDAEDPPASLSTSVDAKDVRVLHAETLDLAKLHLR

SEQ ID NO: 34704 - protein, 358 aa, Idiomarina baltica OS145
MNQQRWLFIDRDGTLVLEPPVDKQLDSVSKLEFEPNVIPALLKLQQAGYRLVMVSNQDGLGTDSFPQADFDAPHDLMMAVFASQGVRFDDVLICPHFEEDNCSCRKPKLGLVQDYLQKGLIDFTDSYVIGDRETDIKLAESMGIRGIRYDRANLDWNAIVRDLTQRSRSAKVIRTTHETDIRIAVDLDNATPRSFSTGIGFFDHMLEQIATHAGISLTVNVTGDLHIDDHHTIEDTALALGQALRQALGDKRGIGRFGFALPMDECRAECLIDLSGRPHLKWQADFTRDKVGELSTEMVEHFFRSLTDAMAISLHLSTTEGNTHHQVESLFKVFGRALRQAVAKTGDQQLPSSKGMLA

SEQ ID NO: 34705 - protein, 286 aa, Triticum aestivum
  misc_feature (108)..(108): Xaa can be any naturally occurring amino acid
RSTRRSFCQWAWGRFQTCHGGFPLCPAGPFLGAPNPTSLSQKERRVSGPDFPGFLVDPWCGGWAPRPLTWIEGGGLSPDSPLLAGLNLHSPACAPTVMASSATSVDPXQGVKSTPAVPSISRCNGASIGRVSNGGRIRCMQVWPTEGIKKLGTLSDLPPLSTEALLKQIDYLIRSKWLPCLEFSKVGFIFREHNASPGYYDGRYWTMWNLHMFGCTDATQVINEVEEVKKEYPDAYVRIIGLDNMRQVQCVSFIAFKPPGCEEYGTAYTAHSRQAIYKVPLQFGQL

SEQ ID NO: 34706 - protein, 855 aa, Yarrowia lipolytica CLIB122
MFPLLPQVSSVTVPAVAVAPGKVLVSILQSDVPEIAKELKKAFGQAQFHIMADTDLSTDEYIHLLDAGASSVFVSGESAVDLAASGVPAGRLTVIGSKPDNLDVGGVFLKDTPALEDVATLASTFAKQLLPSGGAPVVYVNVEDPKAAADLAATGATVVVSSAKLTTEHQADKLDDKFPIADLLLASLSTDRQDGLYTTLVTDVLNQSLGLVYSSAESIKEAIRTGTGVYQSRRHGLWYKGKESGNTQKLIRIETDCDGDCLKFIVEQTGAGFCHFNTESCFSAAQGISCLEKTLQQRLQNAPAGSYTKRLFDDSDLLRAKIMEEAEELVEAKDAEEVSWEAADLIYFAMVKVVKEGVSWAQVMNNLDSKHMKISRRKGDAKQKWVDALGIKRQKVDEKPKEEKKEEKKEEIKEDGKIQLNHINADTASKAEIETVLARPAQKTSDIMKLVLPIVEGVKTGGDKKLLELTEKFDGVKLESPILTAPFSEDLMKISDDVKASIDMSIANVKKFHAAQLDTTELVVETQPGVVCKRFSRPIESVGLYIPGGTAVLPSTSLHLGVPAMVAGCKNIVLASPPRKDGTLSPEVVYVAHQIGAKAVVLAGGAQAVAAMAYGTESVPKVDKIMGPGNQFVTAAKMYVSNDTTAKVAIDMPAGPSEVLVICDKHANPAFVASDLLSQAEHGVDSQVILLAVDCDQKHLDAIDEELHAQALALPRVDIIRKCIAHSSALSVKTMDEAFKLSNQYAPEHLILQIEDADKYVPLVDHAGSIFVGAYSPESCGDYSSGTNHTLPTYGYARMYSGVNTGTFTKHITSQQLTREGLEIIGPAVMTLAATEGLDAHRMAVKVRLDAMKKE

SEQ ID NO: 34707 - protein, 1179 aa, Magnaporthe grisea 70-15
MATRLAGRAPALLRSAQRAAFAPKTLSQPLAARSFTNAAARPGLRATVAATQSKLAPKRLFTATAAALAQPAPDADSYLRNLPSSVLKQNATDIKKVLVVGSGGLAIGQAGEFDYSGSQALKALKEAGIASVLLNPNIATIQTNHSLADEVYYLPVTAEYCAYVFERERPDGIFLAYGGQTALNLGVELKRKGILEKYGVKVLGTSVQTLELSEDRDLFARALDEINIPIAKSIAVNSVDEALDAAEKVGYPIIVRAAYALGGLGSGFANNREELKQMAARSLTLSPQILVEKSLKGWKEVEYEVVRDAENNCITVCNMENFDPLGIHTGDSIVVAPSQTLSDEEYHMLRSAAIKIVRHLGVVGECNVQYALQPDGLDYRVIEVNARLSRSSALASKATGYPLAYTAAKIGLGNALPTLPNAVTKTTTANFEPSLDYVVVKQPRWDLSKFQHVSRDIGSSMKSVGEVMAIGRTFEEAIQKAIRMVDPRFPGWYNPNPNAEKFDDLDHELQNPSDRRWLAVGQAMLHKGYTVDKVHELTKIDRWFLHKLQNIVDCARGLESAGSLDALRKDKVLRAKQLGFSDHQIALALNVGGANVSEIDVRAYRKKLGVTPFVKRIDTLAAEFPASTNYLYTTYNASSSDVTFEDNGTVILGSGVYRIGSSVEFDWCAVSATRGIRSQGEKTVMVNYNPETYSTDFDVADRLYFEELSYERTMDIYELEGAKAAVVGFGGQLPQNIALKLQEVGKAKILGTNPQDIDKAEDRKKFSEILDSIGVDQPEWAELKSVDEARAFADKVSYPVLVRPSYVLSGAAMTVIRSPEELAEKLEAAASVSPEHPVVISKFIEGAAEIDVDGVAHQGKLLVHAVSEHVEQAGVHSGDATLVLPPQKLDEQTMERVKDIAQKVAKAWNITGPFNMQIIKADQPGEQPKLRVIECNLRASRSFPFVSKVLGVNFVDVATKALLGKDVPEPVDLMKVKRDYVATKVPQFSWTRLAGADPFLGVEMSSTGEMACFGKDLVDAYWASMQSTMNFRVPEPGEGILLGGQTDRDWLIKVVDWISPLGYKFFAAGDDVKEFVERTAKGGVKVEKIDLPVDKVQLRTAFQDHNIKGVFNLALTRAKTTEDVDYIMRRNAVDFGIPLFMEPQTAILFAECMSKKLPRQDGIPTEVRRWSEFIGGKPL

SEQ ID NO: 34708 - protein, 338 aa, Yarrowia lipolytica CLIB122
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKDYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYLLK

SEQ ID NO: 34709 - protein, 342 aa, Oryza sativa (japonica cultivar-group)
MRAGDMPGRGARRRPDLTLPMPQRDAPTSLAVPLPLPPAATTTTSAPPAGGAMHPLASAGAAPPPPLEELERVRRVGSGAGGTVWMVRHRGTGKEYALKVLYGNHDDAVRRQIAREIAILRTAEHPAVVRCHDMYERGGELQILLEYMDGGSLDGRRIADERFLADVARQVLSGIAYLHRRHIVHRDIKPSNLLIDSARRVKIADFGVGRILNQTMDPCNSSVGTIAYMSPERINTDLNDGAYDGYAGDIWSFGLSILEFYMGKFPFGENLGKQGDWAALMCAICYSDPPEPPAAVSPEFRSFVGYCLQKNPAKRPSAAQLMQHPFVAGPQPQPLAAPPPSS

SEQ ID NO: 34710 - protein, 1406 aa, Coccidioides immitis RS
MPAVFKNKTVVLSGTFPGYKQADLKNLIETNGGTFSAKVTDDCTHLVCTQKEFENNGTKNKQASSITGISIVSSAWLFESVSSKKCKKESEYLWSTLNKTQAAATSAPNGTADATAATNPRRSARNSQAQAQSQTQPQPQSQPQPQHQTKSQAKAPKKNNKRALDSTTGGTITDTAQADTEPPAKKKKETKAETQRKIDIPVDSGFSNRQNYHVYVDPDGLIYDAALNQTNRMNNNNKFYFIQILEPNDMSGQYTTWMRWGRVGEFGQSSFYKDQSLEAAISTFGKKFKDKSGLSWKNRFDSPKAGKYMFLERDYEVESEDEKEEKVKKEDEEEEEVEVKMAECTLSEPIQHVVSLIFNQSYWANAMATLDYDANKLPLGKLSKRTLQKGFELLKDLSDMVNNGQFHGTALEIINNQYFTVIPHALGRGRIPLINNERMIKKEIALLEALTDMEIANEILKGSKKSDAADPIHPLDQQFAGLGLQEMTPLDPEGTEYRQLEDYLIKTHGDTHYIKYNLKYIFRIERKDENDRFLNSPYANIKNSNRRLLWHGSRTTNYGGILSQGLRIAPPEAPVTGYMFGKGVYFADISSKSANYCCHHNSGNTGLLLLCDVELGDPMLELTHSDYHAGDRAKDENKLATLGMGRTVPYGWRDAGSVHEDLAGVLMPDTTEAPRSCDDGQNRSLYYNEYIVYDVAQIRIKYLFCVGIHVDTWIGKPIFHLVSYSLKSKKLAGAGLPPHLCYLSLFVFFVRIGMQALYSKGPKTGQNARVDAPFASYPARSDCCWEVFPTNARRCQGGELQNDICETTEGVRSYTGYVHLPPHTLDDVNVDQDYAINTFFWFFESRKDPANAPLSIWMNGGPGSSSMIGLFQENGPCFVNDDSNSTYLNPWSWNNEVNMLYIDQPNQVGFSYDTLTNVTRNTVAEESEWQVADFSQGVPEQNNTFFVGTTSSQNSRNSANSTMNAARSLWHFAQVWFQEFPEYRPNDDRVSIWTESYGGRYGPSFAAFFQEQNEKIRNGTITRDGEMHLINLDTLGIINGCVDLLIQAPSYLHYAYNNTYGIQAINETVFNTGLEDWEKPGGCRDMINNCRQLSAEGDPYMYGNNQTVNEACMRTEQYCGEHVELLYILYGDRGVYDIGHPSADPFPPNYYLGYLSQAHVQAAMGIPVNFTVSSTAVYSGFSATGDYPRNDVRGYLEDIAYLLDSGVKVALVYGDRDYICNWIGGEEVSLAIDYSESDMFRSAGYTDIQVNSSFVGGQVRQYGNFSFSRIYQAGHEVPAYQPEASYQVFQRIQFNKDIATGTIDTAQRRDYGTSGTESTFHIKNNPPPDPAPQCYILELSTCTREQVEKIRSGDALIRNYILIEDGATPTGTGTAPSATATGAGARAGFSVGLLSFVTMVLGISFT

SEQ ID NO: 34711 - protein, 446 aa, Mycobacterium leprae TN
MTSVEQSRQLVTEIPGPVSLELAKRLNAAVPRGVGVTLPVFVTRAAGGVIEDVDGNRLIDLGSGIAVTTIGNSSPRVVDAVRAQVADFTHTCFIITPYEEYVAVTEQLNRITPGSGEKRSVLFNSGAEAVENSIKVARSYTRKPAVVAFDHAYHGRTNLTMALTAKSMPYKSGFGPFAPEIYRAPLSYPYRDGLLNKDLATDGKLAGARAINVIEKQVGADDLAAVIIEPIQGEGGFIVPAEGFLATLLDWCRKNNVMFIADEVQTGFARTGAMFACEHDGIVPDLICTAKGIADGLPLAAVTGRAEIMNAPHVSGLGGTFGGNPVACAAALATITTIENDGLIQRAQQIERLITDRLLRLQDADDRIGDVRGRGAMIAVELVKSGTAEPDPELTEKVATAAHATGVIILTCGMFGNIIRLLPPLTISDELLAEGLDILSRILGDF

SEQ ID NO: 34712 - protein, 378 aa, Arabidopsis thaliana
MSSPEKFSPAPESNSNPSLPDALIISCIARVSRLYYPILSFVSKSFRSLLASPELYKERSLLNRTEGCLYVCLYLNPFESPSWFTLCLKPDQALSSETSNKKKSSGYVLATVSIPHPRLVQRSSLVAVGSNIYNIGRSISPYSSVSIFDCRSHTWREAPSLPVELVEVSAGVLDGKIYVAGSCKDGDSLNLKNTFEVFDTKTQVWDHVPIPYNETKHNIYSKSLCIDEKWYVGAKRKVVSYNPKKGIWDLVESEMCSYKSSYDYCEIENVLYSVEKTWRGTVFRWYDTELGRWRKLEGLVEQLPIILACPRLANFGGKMAVLWKENMTYSGSNKMLWCAVITLERRKKREIWGKVEWFDHVLTVPLTYVFENVLVATI

SEQ ID NO: 34713 - protein, 375 aa, Brevibacillus choshinensis
MKRDYYEVLGVGKGADADEIKKAYRKLARQYHPDVNKAADAEEKFKEVKEAYDVLSEPQKRAQYDRFGHQDPNQGFGGGGFDASGMGGFGDIFDMFFGGGGRRANPNAPRKGSDLQFGLSIEFTETVFGKETDVEIPKEAECDTCHGSGAKPGTGVETCKTCSGTGQQEVAANTPFGRIVNRRVCTTCEGKGKVFKEKCSSCRGSGRVKVRRKIHLNIPAGVDDGAQLRVTGEGEPGVNGGPPGDLYVVLRVKSHEFFEREGNDIYCEVPLTYAQAALGDEIEVPTVDGRVKLKIPSGTQTETFFRLRGKGVPHLRGNGRGDQHVKVRVITPTKLSDKQKELLRELAELSGEKPGQHGGEDEGFFEKMKRAFRGE

SEQ ID NO: 34714 - protein, 216 aa, Nostoc sp. PCC 7120
MSFIDSLSPQNVIPVEEIRYDERGLVPAIVQDYLDGTVLMMAWMNRESLQKTLDTGETWFWSRSRQEFWHKGGTSGHTQKVQSIRYDCDSDALLVGVEQIGDIACHTGERSCFHQVEGKIVAPPGDTLSQVFQVICDRRNHPTESSYTSKLFAGGDNKILKKIGEESAEVVMACKDDDQEAIAGEVADLLYHTLVALAHHQVDIKAVYRKLQERRR

SEQ ID NO: 34715 - protein, 411 aa, Nostoc sp. PCC 7120
MPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 34716 - protein, 496 aa, Anaplasma phagocytophilum HZ
MSGSNVVLCILDGWGNGSGGRYDAIHAAYTPFWDTAVSCCPMSSLSASGTDVGLPSGQVGNSEVGHISIGCGRIVLQDLLRINLEINEVHKNPKLLDFVRDIQAKGGVCHMIGLLSDGGVHSLQAHMETIIEVITGFGIKVFIHVILDGRDVPPRSAEKYIGMLNAKIEHLNAEIATVAGRYYAMDRDNRLDRTCKAYDAIAYATGPRSGSAMEALEKSYNSGVTDEFMVPTVIGDYDGMGAEDGVLFTNFRNDRVLQLLGMLLHRFPEVSNVLGMRQYSEKMRIASLFPPREIHRSLGEVISERGLKQLRIAETEKFAHVTFFFNGGREEPFTGEDRIIIPSPDVSTYDLKPEMSAVEITDSLVERINSQQYALTVVNYANADMVGHTGNMEAAKKAVTTVDSCLQRVFYAAVNAGAVMLITADHGNAEKMFDVQNDSPFTAHTSSMVPFVVCNADGDISLSDGRLCDVAPTVLDLMNIPQPSDMTGCSLITRNS

SEQ ID NO: 34717 - protein, 429 aa, Shewanella sp. ANA-3
MATKRIVIVGGGAAGLALASKLGRKMGGSDVVDVCLIDKSPIHIWKPKLHEVAVGVIDQSIEGLLYRDHGLKNGYRYIRGEIEQCEPDAKTIQLAAVYSDSGELLLEPRQIEYDYLVLALGGVSNSFNTLGAEKHCIFLDSLDNANLFHQKLLDALLQLNETQEKVSIGIVGAGATGVELAAELHHVIESVKEYGYLNISKHHLDVHLIEASPKILPQLPERVSARAQAVLDKIGIRLHIGVQVKEVTRDGFITQDGDVIEAGLKVWAAGVKGPKAFQNFSKLPITPRNQVEVDACMRVKGHQDIYALGDCALLILESGQPVPPRAQAAAQMADTLYENIVNRLQGKAEKPFVYKDYGSLVSLSRFSAVGNLMGNLRSGTFFVEGHIARIMYISLYQRHLASLYGWFSAIIYRIAQKLLKWQRPKLKLH

SEQ ID NO: 34718 - protein, 555 aa, Idiomarina baltica OS145
MEKIWLKHYPAGVPDTIDPDHYTSLLEILEESIERYGDKTAFVNMDCEMSFAELGEKAKQFAAYLQSIGLQKGDAVAIMMPNLLQYPVALFGVLAAGMTVVNVNPLYTPRELKHQLTDSQSKALVILENFANTYEKIAKDVQLEKVITTQIGDLLPAPKRWLVNFVVKYVKRMVPSHSISQRIDFNVALNKGKQKAYQRPGLTGDDIAFLQYTGGTTGVAKGAMLSHRNMVANLEQVSSVITPIMSDGEEIIITALPLYHIFALTANCLTFIKHGGRNILITNPRDMPGFVKELGKVKFSMISGVNTLFNGLLNTKGFKDLDFSNLKVSLGGGMAVQKSVAEHWERVTKSRLLEGYGLTECAPVVTVNPYDIEHYTGSIGLPVPSTDVKICDPESGEEVALGDAGELYVKGPQVMVGYLNRPDATAESIKEGWFATGDMATCDERGYFKIVDRKKDMILVSGFNVYPNEIEDVLADHPKVLEVAAVGVPHESSGEVVKVFIVKKDKSLTEREIIDFSRENLTGYKVPKLVEFRDELPKSNVGKILRKELRDEKKD

SEQ ID NO: 34719 - protein, 517 aa, Synechococcus sp. CC9311
MVWPPLDTEHWLVSAEQMLALEQEWLGSGLPVAALMEAVGQAMADWCLQRRKRLEQGVLVLVGPGHNGGDGLVLARRLMHAGVEVRLWAPLPLRQTLTQEHWRHLEWLGATVLETQPDPRDSALWVEALFGLGQHRPLPEGLVLLFEERERVQPGRLISLDVPAGMHSNHGRMQAGGGAVASDTLCVGLVKRGLVQDAALANVGCVHRLDPGVPQLLIDRRKSSAVLRVMAKDLATLPVPQDAPTAMKYQRGRVLVLAGSDRYRGAAVLAANGVMASGVGSFNAALPEAVAELIWQWIPELVVSAALPATASRGLAWGPWLALADLSRFDALLLGPGIGALEAQWDAWAEPLVSFQGLLVLDADGLNALAASKQGWRWLCRREFPTWITPHRSEFARLFPDSSGKEPLESAQWAAAESGAVVLLKGAHSLIADPNGVVHQLVDTSVQAARTGLGDLLAGFAVGWGARCLACGEEPQGTALAAAALLHAEAARTSEDASSAREIAKTLAELTRRICGN

SEQ ID NO: 34720 - protein, 101 aa, Glycine max
MIFNYFVFRPHTRWWQKSNYVLSHALDAGTPFMGVLIFFPPQNAAHNLKWWGSELAHCPLATCPPAPGIEVEACPVLKYQDPITIMGLAFSFFFVCPGGPS

SEQ ID NO: 34721 - protein, 599 aa, Triticum aestivum
MDKGALMTPDSDQGGPDGGSFSSLRSYGRALSQTPRRLARRACAATAPGEEMSRVRARSGAPMARALRWPDLVGLGLGGMVGAGVFVTTGRATRLHAGPGVVVSYAIAGLCALLSAFCYTEFAVDMPVAGGAFSYLRVTFGEFAAFLTGANLIMEYVFSNAAVARSFTAYMGTAVGVDAPSKWRIAVPGLPNGFNQVDLVAVGVILLISVCICYSTKESSKVNMVLTAVHVAFILFIIVMGFWRGDARNLTHPADPAHPGGFFPNGVGGVFSGAAMVYLSYIGYDAVSTMAEEVERPARDIPIGVSGSVIIVTVLYCLMAASMSMLLPYDAIDTEAPFSGAFRGSDGWGWVSNVIGAGASLGILTSLMVAMLGQARYLCVIGRSGVMPAWLAKVHPKTATPVNASAFLGLLTAALALFTELDILLNLVCIGTLFVFYMVSNAVVYRRYVVGPTGSGTESGDRQPSAWPTLAFLLAFSLIALSFTLVWKLAPEGGRTRVGLLSACGAAAVAMVGAFQALVPQAHTPELWGVPGMPWVPAASVFLNVFLLGSLDRPSYVRFGFFSAAAVLVYVLYSVHASYDAEESATLDGAKVQDEACRV

SEQ ID NO: 34722 - protein, 167 aa, Symbiodinium sp. C3
MPCGSAQRRLLRDFKKMTADAPKGIQASPVGDDLFNWSAIVLGPQDTAWEGGVWKLKMSFNEEYPEKPPSVRFENEVFHPNIFPDGQICLDLLKGSGWSPAYDVCTILLAIQSLLADPDTHATPEGGANPEAESLFVRDRQGYYAKVKSLVDKQLEEDDMGCLSAVP

SEQ ID NO: 34723 - protein, 295 aa, uncultured archaeon GZfos9D1
MLKIEGVYPALITPFTKDDEVDKEGLRRLVEYMIEGGVAGIVPCGTTGESATLSHKEHEEVIDVVVDCSKVPVIAGTGSNNTKEAVEFTKHAADAGADACLLITPYYNKPNVKGLKEHFKRIGDSVEIPLILYNIPSRTGQNVSAGTMVELASEITNIKGVKEASGDLKQVGAIIRSVAERGLDFTVVAGDDFLTLPIMSLGGKGVISVAANIAPREMTEMVAAMLKSEVEKAKEINIRLFSLFESMFLETNPIPVKKAAEMMGLSAGHVRLPLGALSEGNEERLRKVLEGLGMV

SEQ ID NO: 34724 - protein, 429 aa, Gonyaulax polyedra
MARGSFLAPLCLAAVVLGVWQLLPISFVAPSPRLRGVTSESAQVATAAPLERSHGSQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVFCASCTTNGLAPAVKAVNDALGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVDLIKHMAKVDAAAA

SEQ ID NO: 34725 - protein, 485 aa, Oryza sativa (japonica cultivar-group)
MSRAHGSPRSFFPVGNPFRVMFPGGAHLSRKLQELLASYEDALALSLRKLKPEAASDVLTLSWMRLAVDCLSELHTNIANLITDLELPVSDWDDKWVDIYLNSSVKLLDICIALSSELSRLDQGQLLLQYALHVLGSESGVPSQEQLKRAEPSLREWMELVGVRCARLVSCSATLQELAGNLSLMKVKNSAKGKVLMRALYGIESVTVFVCSIFVAVLSGSPKPLVELHVPEKFGWSQAFNDLHTAVSEELTRQLSGGSVAAVKELEEVEACARRLHVLASTSQLEEEAANLANAVSHTEEEVMSDSIAQEGDHHCGLKLADDTTREGGIVISESIAEGGTQEAEMKKDISYEKEVAMVERISYKEHQDSNVKQANGSSDESALVVPERTSVQESKEELLNCISSMSKSAEGLRHGLDSLSKRVGDFFQIVLTGRDALLCNLRISDAASKVAEPCQVLYSHFVYFLVRVSALLVVAQVICECIEA

SEQ ID NO: 34726 - protein, 687 aa, Oryza sativa (japonica cultivar-group)
MAILTVLPLVLVMLLLPLAAIASGDPPWQHYCGSSGNYTAGSKYQANLQALAATLPSTASSSSPALFAKDAAGGGDAEPDRVFALTLCRGDTASANASSSSCADCASRAFRDAQSVCPYSKEVAVYYDPCLLYFSGDDFLSSPANPAQVRLYDVDRSTRRGGGGADFVTLVRALLSYTMQWAVPYNSTGGGAAAVRWYTTVRMDVVTPPLFSLMQCTPDMSGGDCRQCLQDLVGNTTFNGSVSGVRNIGARCGYRYDTYKFYGGEPKLKIGSLSEINSTAPSSPPPPPPVTETRSGRKKVLTVALLVPLIALCPVVIFCFAWIRRLRNHKSMLRKKDTMAREEVLKLWRLEESDSEFMLFDFSQIEDATSNFSEDKKLGEGGFGSVYKGQLPNGLEVAVKRLAAHSSQGLVEFKNEIQLIAKLQHTNLVNLRGCCIQGEENLLIYEYMPNKSLDFFIFDLKRAALLNWKTRLNIIEGITQGLLYLHKHSRLCIIHRDLKASNILLDRDMNPKISDFGLAKIFDSNDVQRNTKRVVGTYGYMAPEYASEGCFSLKSDVFSFGVLVLEIISGKRNAGFHQYGDFFNLLGYAWQLWKDGSWHELVDPSLVSEGQMMEIKKCMKVALLCVQENAVDRPTMSAVVKMLSSELKILPEPKQPAFFNVRVKHGELSNTAPSSINDVTITIVNGR

SEQ ID NO: 34727 - protein, 691 aa, Arabidopsis thaliana
MVSPLTLFLILFFFFLSSALSSSSSELDILLDIKSSLDPEKRFLTSWTPDADPCSSGSFDGVACDGNRRVANISLQGMGLTGTIPPSIGLLTSLTGLYLHFNSLTGHIPKDISNLPLLTDLYLNVNNLSGEIPPLIGNLDNLQVIQLCYNKLSGSIPTQFGSLKKITVLALQYNQLSGAIPASLGDIDTLTRLDLSFNNLFGPVPVKLAGAPLLEVLDIRNNSFSGFVPSALKRLNNGFQYSNNHGLCGDGFTDLKACTGLNGPNPNRPDPTNPTNFTTVDVKPESADLQRSNCSNNNGGCSSKSLKSSPLGIVMGLIGSILAVAIFGGSTFTWYRRRKQKIGSSLDAMDGRISTEYNFKEVSRRKSSSPLISLEYASGWDPLGRGQSSNNNSALSQEVFESFMFNLEEIERATQSFSEINLLGKSNVSSVYKGILRDGSVAAIKCIAKSSCKSDESEFLKGLKMLTLLKHENLARLRGFCCSKGRGECFLIYEFVPNGNLLQYLDVKDETGEVLEWATRVSIINGIARGIVYLHGENGNKPAIVHQNLSAEKILIDHWYNPSLADSGLHKLFTDDIVFSKLKASAAMGYLAPEYITTGRFTDKSDVYAFGMILLQILSGKSKISHLMILQAVESGRLNEDFMDPNLRKNFPEVEAAQLARLGLLCTHESSNQRPSMEDVIQELNNLAADY

SEQ ID NO: 34728 - protein, 254 aa, Zea mays
MGRRHSGGGGGGRGRGRGRGRDEEEDLPLHKAARSGDAAAVESVCESNPLAVNSRDRLSRTPLHLAAWAGHVDVVRCLCKHKADVGAAAMDDTAALHFASQKGHVEVARELLASGASVKAKNRKGFTALHFAAQNSHLDLVKYLVKKGVDVTAKTKGGQTALHVAEDDEVRAFLKECEQSLKKGAELPSEKDDSAEKEGDSKSSGEVMKDEEDAEQGEKRKSELVGASSLSGVKKAKVSLGHLVCENDMDEEEE

SEQ ID NO: 34729 - protein, 467 aa, Aspergillus oryzae
MQWTWALITALATATSALPHEARKDVWGQLRSNIKHVVYLMMENHSFSNIAGYWDFHPEIDNLRNRKYCNEYTNPNWTVWGEPLDICAGPYETEVPLEDPDHEFAGVTYQIYRKWNVTNDDVPNMGGFIERQSEKYQATPGESAFVIKAYDEKKSSTLAEIAQNFAFWDSYFAEHPGPTNPNRQFATSGSTCGFVDNAGQAAGFFNNVTGTTCATSIFEALSNKNISWKNYYETDIIDGWMYKWVQDNAIDNLAHASDFYRDLEEGTLPTFSYINPECCTIDSMHPKSNMAAGEQMIKHLYDAVRRSKYWDDVLIIINFDEHGGFADYVPPPVNVPRPEDGIAFDGESEGRPVTYDFTRLGVRVPAFIISPYIEPNTLIHNDGTNYANNSAYTHTSMLHFLQELWELKGLNNRVQWAKTFEHVFSDTKREDTPKTLSTPIWYGDSWEPKPEPFYLLNQNEDYYANRP

SEQ ID NO: 34730 - protein, 502 aa, Triticum aestivum
  misc_feature (270)..(270): Xaa can be any naturally occurring amino acid
  misc_feature (280)..(280): Xaa can be any naturally occurring amino acid
  misc_feature (377)..(377): Xaa can be any naturally occurring amino acid
MSPYAVLVAVLLTFCYVVWKARGSRSGKLPPSPPSRPLLGHLHLLGRQPHRSLRELHARYGTDGGLLLLQLGRRRTLVVSTAAAAADLYKNHDLAFASRVPSAPVDKLTYGSINVSFSPYGDAWRRSKKMAVVHLLSPRRADSFAPVRAAEAAALVAGVRRAAEAGEIVELRELLSAYSNAVVTRATTGAAGATAEKLKKLLGNSAAIMSGLQAGDVLPDAAAKVVRWATGLEKRLDAELEQWDKFLSEIIAEHLEKKKCDGSARDEDFXDVLLRLREEXAAGLELTDDRIKSIIKDIIAAGTDTSSLTLEWAMAELVGNPRAMAKLQDEIDRVTEGKPTIEEDDLSRMEYLRAVLKEVLRLHPAAPLLIPHQSTTXAVVQGYEIPAETALFVNAWAIGRDPAAWGATAEEFWPERFLGGGSAQGVDLRGNDYQLLPFGAGRRLCPGISFAMPVLEIALCSLVRHFDWEIPAEARLDMNEAPGLITPPLAPLRLVPKCRRQQ

SEQ ID NO: 34731 - protein, 716 aa, Mycobacterium avium subsp. paratuberculosis K-10
MTSAKAAAPTPTGEVWPGKAYPLGASYDGAGTNFAVFSEVAERVELCLFDGDGTESRVALPEVDGFVWHAYIPGIEPGQRYGYRVHGPYDPAAGQRCNPNKLLLDPYSKAVDGTFEWNQSLFGYNFGDPDSRNDDDSAPSMPKSVVINPYFDWGNDRPPDHHYADTVVYEAHVKGLTQTHPDIPEQMRGSYGAVAHPVIIEHLQSIGVTAIELMPVHHFANDSTLIEKGLSNYWGYNTIGFFAPDTKYSSAATPGGQVQEFKAMVRSLHEAGIEVILDVVYNHTAEGNHLGPTLSMRGIDNAAYYRLVDDDKRYYMDYTGTGNSLNVGHPHALQLIMDSLRYWVTEMHVDGFRFDLAATLAREFYDVDRLATFFELVQQDPTVSQVKLIAEPWDVGPGGYQVGNFPPQWTEWNGKYRDTVRDFWRGEPATLDEFAYRLSGSADLYEHTGRRPVASINFVTAHDGFTLRDLVSYNEKHNEANGEDNNDGESHNRSWNCGAEGPTDDEQVNALRARQQRNFLTTLLLSQGVPMICHGDELGRTQNGNNNGYCQDNELTWIDWANADVDLLAFTRVVSALRAEHAVFRRRRFFSGKPVGRRGQDGLRDIAWFTPDGTEMTDEDWGANFAKSVTVFLNGHGIPDRDARGQRLLDDSFLLCFNAHHESIEFTLPPKEFGASWQVVVYTGPEETTPADEVPGAGVLNVDAHTAVVLRAPDGG

SEQ ID NO: 34732 - protein, 278 aa, Mycobacterium leprae TN
MSLTACANKGPRKAGIIGSPIAHSRSPHLHLAAYRALRLHDWTYERIECDAEELPTVVSGFGPQWVGVSVTMPGKFAALRFADEHTARASLVGSANTLLRTQRGWRADNTDIDGVAGALAAIGPLAGRALVCGSGGTAPAAVMGLAELGVTDITVLARNPDKASRLVDLGVQVGVATRLCGLDSGGLADEVKAAEVLVSTVPADVAARYVDVFATVPVLLDAIYDPWPTPLVAAVSAAGGRVISGLQMLLHQAFAQVEQFTGMPAPREAMACALAGLH

SEQ ID NO: 34733 - protein, 393 aa, Mycobacterium avium subsp. paratuberculosis K-10
MKAVTWHGKRDVRVDSVPDPKIEQPTDAIIEVTSTNICGSDLHLYEILGAFMKPGDILGHEPMGVVREVGTETGDLRVGDRVVIPFQICCGSCYMCGQQLYTQCETTQVRDQGMGAALFGYSELYGEVPGGQAELLRVPQAQFTHIKVPVGPPDSRFVYLSDVLPTAWQAVAYADIPDGGTVAVLGLGPIGDMAARIADHLGYRVIAVDLVPERLGRAAQRGIHTIDLARLDAGLGDAIRDLTDGRGADSVIDAVGMEAHGSPAAKLAQQVAGVLPDALGKRLMQTAGVDRLSALYSAIDAVRRGGTISLIGVYGGMADPLPMLTLFDKQVTLRMGQANVKRWVDDIMPLLTDDDPLGVDDFATHVLPLERAPHAYEIFQKKQDGAVKVILKP

SEQ ID NO: 34734 - protein, 434 aa, Mycobacterium avium subsp. paratuberculosis K-10
MTSIVIVGSGFTGFTCARRLAKTLRRAPVDITMISPVDYMLYTPLLPDVAGGVVDARFVAVPLANSLRGVHAVRGRVDAVDFTGRTLTYRDPEERSHSMSWDRLVLTPGSVTKLFDVPGLARHARGLKTTAEALYLRDHFVEQLELANIEDDPRVAAARRTVVVVGASYSGTELVAQLRALADAAARQMGFDPGAVRFLLLDLAEQVMPEVGKKLGDAALKVLRRRGIDVRLGTTLKEAHADHVVLSDDSRIDTHTIAWVTGVTGAPLIQDLRLPTEKGRLKVQPDLQVPGHPGVFAAGDAAAVPDLTQPGKITPPTAQHATRQGKVLARNVAASLGHGSAKEYKHRNLGLVVDLGPRYAVANPLNIHLSGLPAKAVTRGYHLYAIPRGVNRWAVSLAYLTDALFARSVVSIGLSSEDDAQFTASEGIPMPKTG

SEQ ID NO: 34735 - protein, 174 aa, Burkholderia xenovorans LB400
MSSRRIAVRRSGVHGKGVFAVEPIAAGERLIEYKGERISWKEALRRHPHNPAEPNHTFYFALDSGKVIDGKVNGNSARWINHSCAPNCEAEEIDGHVYVHALRDIAEGEEVFYDYGLVIDARQTNKLKKEYECRCGARKCRGTMLAPPEKEKGAGKSGKSAKKAGTTVKKAKKK

SEQ ID NO: 34736 - protein, 663 aa, Francisella tularensis subsp. holarctica
MSLSIPREFSNAIRFLSIDATLKAKSGHPGMPMGMADIATVLWTKFLKHNPNNPHWINRDRFVLSNGHGSMLLYSLLHLTGYDLSIEDIKNFRQLHSKTPGHPEYGYMPGVETTTGPLGQGVANAVGMALGEKLLSDRYNTPDLKVIDHHTYVFLGDGCLMEGVSHEACSLAGTLGLNKLVAFWDDNNISIDGDTKGWFSDNTPERFRAYGWHVIENVDGHEFVAIEKAINEAHSQQQKPTLICCKTVIGFGSPEKAGTASVHGSPLSDQERASAAKELNWDYQAFEIPQDVYKYWDAREKGQALEANWQGQWNLFKDSPKFDEFERVLSKELPVGLESAINDYIASQLSNPVKVATRKASQMALEVLCKNMPEMFGGSADLTGSNNTNWSGSVWLNNTQEGANYLSYGVREFGMAAIMNGLSLYGGIKPYGGTFLVFSDYSRNAIRMSALMKQPVVHVMSHDSIGLGEDGPTHQPIEHVPSLRLIPNLSVWRPADTIETMIAWKEAVKSKDTPSVMVLTRQNLMPVVQTQHQVANIARGGYLVKDNPDAKLTIVATGSEVELAVKVANEFEKKGIKLNVASIPCVEVFATQAHEYKKTVIKDDIPAVFVEMAQPDMWYKYMPKAGGEVKGIYSFGESAPVEDLFKHFGFTVENISNIVAKYV

SEQ ID NO: 34737 - protein, 368 aa, Aspergillus oryzae
MASTTSQPAEKQLVPAPSNPVLLATQAQWLFTDEELTRAPSQLDGMTLEAEHTSRSKGVNFITQVGIMLKLPQLTIATAAVYLHRFFMRYSMVDLPQRPGMHPYPIAATALFLSTKVEENVRRMRELVVACCRVAQKQPNLVVDEQSKEFWKWRDTILHHEDLLLEALCFDLQLEQPYRILYDFICYFGVNENKPLRNAAWAFVNDSMFTVLCLQFSARNIAAAALYAAARHCDVGFEDDASGRPWWEQVDVDLAQVRRACTRMAQLYENNAMQKHSQYYPTTPIFADEGGPPPRDRRNSDRYREHEDPSRRRRSDLSSTSRKSIDEQHPPPPPPPPPSDMPQNQQPPPPPPPPDQDEEGGGSEEGEL

SEQ ID NO: 34738 - protein, 401 aa, Oryza sativa (japonica cultivar-group)
MALPATMKVLGLAPGLVAILLAALLTDASIELLVRSSRAAGAPSYGAVMGDAFGWWGRRLLQVCVVVNNIGVMIVYMIIIGDVLSGTSSGGEHHYGVLEGWFGPQWWNGRFFVLLVTTLVVFTPLACLKRVDSLSYTSAISVALAVVFVIITAGIAIVKLIKGQIPMPKLFPDVPDLASIWELFTAVPVLVTAYVCHYNVHPIHNELKDPSQIKPIVHTSLVLCSTVYITTSFFGYLLFGESTLSDVLANFDSNLGIPYSQMLNDAVRVSYAVHLMLVFPMIFHALRLNLDGLLFSSSSPLSSDNRRFSVMTAVLLLVIFLSANFIPSIWDAFQFTGATAAVCIAFIFPAAITLRDPHSIAKKWDKILSIFMIVLAIVSNVVAVYSDAYSMFHRKSSPSIA

SEQ ID NO: 34739 - protein, 195 aa, Thermotoga maritima MSB8
MIIRDVELVKVARTPGDYPPPLKGEVAFVGRSNVGKSSLLNALFNRKIAFVSKTPGKTRSINFYLVNSKYYFVDLPGYGYAKVSKKERMLWKRLVEDYFKNRWSLQMVFLLVDGRIPPQDSDLMMVEWMKSLNIPFTIVLTKMDKVKMSERAKKLEEHRKVFSKYGEYTIIPTSSVTGEGISELLDLISTLLKEN

SEQ ID NO: 34740 - protein, 1051 aa, Oryza sativa (indica cultivar-group)
MLVPHQELPAAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCRDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHRYKFDDERVTKEDTKKALEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVLDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKRRDVYGAWEQYLGLEHTDTTPKRSYTANQCCMCLD

SEQ ID NO: 34741 - protein, 198 aa, Oryza sativa (japonica cultivar-group)
MITLSSPVMCFIHASSVFDRSMAAPAAPQETNAAAGEMVTLISSDGARFEVPEAAVRLSQTVLDEMKKDDYNAINGIPLPNVAGDVLAKVVEYCTKHASAAAAAINADTAKTSKEEEELMMKSFDDEFILVDNHMLYSLLTAADAMRIQGLMDLACQRLADMIKGKTSEQMRQTLGITNDFTPEEEEEFRREDEEQWL

SEQ ID NO: 34742 - protein, 706 aa, Zea mays
MATRRLTPDCFPSLLAGVLAAFLHAALHAPLAVAQERQPPWLLCSPPPDSGIAGNYTENSPYQGNINLISATLPKNTSSSPVLYAKDRVGSVPDIVYAHALCRGDANASACESCVATAFKGAQQGCPLVKDVLAFYDLCQLRFSNRNFFLDNDNFITAYYLQGSKLAAGTGTGTPMGAFDAAVLLLVNATANYAAGNSSRRFGTGEMGLGDDNRTRIYALAQCTPDTAPDICQTYLQPIVNQLPVSFSSVSGGGIFGTWCSFRYELYPFFSGSPLLQLPTFVGTTPAPAPAPPPPATSQDKSRNKTGIVLAILMPSIAALLGINMVLFWIRRRRSAEQRPLQSASAPPPGVQGADVLILDLSTLRVATDDFAESKMLGKGGFGMVYKGVLPDGQEIAVKRLCQSSRQGIGELKSELVLVAKLHHKNLVRLIGVRLQEQEKILVYEYMPNRSLDTILFDSERNRELDWGKRFKIITGIAKGLQYLHEDSQLKVVHRDLKASNVLLDLDYVPKISDFGLAKIFGGDESKCVTHRVAGTYGYMAPEYAMRGLYSIKSDVFSFGVLVLEIVTGRRNGGLYNSDQDVDLLNLVWEHWDRGNVIELIDPSLSDHHHHPPIEQMLKCLHIGLLCVQRKPAARPMMSWVSVMLCSSTVRLPSLSRPALCVQEVVTATDDDSSSGASALLCAAESSVMTTIMSCNDASITELLPR

SEQ ID NO: 34743 - protein, 797 aa, Thermus thermophilus HB8
MRWVRFFHEVGLEDVPLVGGKNASLGEMIRELSPLGVRVPEGFATTSEAYWHFLEHNGLKEAIARELGELDPEDPKALQRVSRRLRNLILKGEYPQDLREEILEAYRRLSEEAGEEEIPVAVRSSATAEDLPTASFAGQQESFLYVQGEADLLLHVKRAMASLFTARAISYRAHMGFDHLKVALSVGVQRMVRADDAASGVIFTLDPDTGHRGFVYLTAIYGLGENIVQGRVIPDGYYVHKETFREGFRAVVYRRLGAKELTLAFDPREGRLKNRPTPLYLRNRFALRDEEVLLLADWAMKIEDHYSKKRGSPTPMDIEWAKDGPTGELFVLQARPETVHSQKTPVLRVFRLLKRGEVLAEGLAVGEAIAMGRARVLKDPKEMDRFQEGEVLVTETTNPDWEPIMKKAAAIVTERGGRTSHAAIVARELGVPAVVGAVGATRSVPEGEEVTVSCAEGERGVVYRGRLPFEVEEIRPETLPRTRTRILVNVGTPEEALRTSLLPTDGVGLLRMEFVFASHVRVHPLALTRFETLPKEVRRQVEEVTEAYPDKRAYFVETLSQGIGLIAAAFYPRPVLLRFSDFKTNEYARLLGGHLFEPKEENPMLGWRGASRYYHPDYKEGFLLEVAAVRRVREEMGLKNLMVMVPFCRTPEEGEKVLEVMAEGGLRRGEGGLEVHVMAEIPSNVLEAEAFAELFDGFSIGSNDLTQLALGLDRDSERVAHLFDERRETVKRLAAMLIEKAHAKGKKVGICGQAPSDYPEFAAFLVERGIDSLSLNPDALLRTVREVAEVERRLGIG

SEQ ID NO: 34744 - protein, 207 aa, Schizosaccharomyces pombe 972h-
MSGPHHCSADCDEHPFESGPNDTLYSCIRKESIVTLNEAVPDSGKLVFKPWDLRYDDTDIVESDADDQLLFQVPFAGAATLKSILVRIFPNETAPHSFSLFPNRTDLDFDTIGDVQATETFEFPLTFEGSHIFEFPVKTRLYQNLQNLNIFFTKSDGSDDPTQIAYIGLRGSFVPFKGDPVVTIYEATPRPSDHPKVNQEEVFRSYY

SEQ ID NO: 34745 - protein, 860 aa, Arabidopsis thaliana
MEFRFENLLGAPYRGGNAVITKNTQLISPVGNRVSVTDLSKNHSVTLPLETSTNICRLASSPDGTFLLAVDEQNRCLFINLPRRVVLHRITFKDKVGALKFSPNGKFIAVGIGKLVEIWRSPGFRRAVLPFERVRTFANSDDKVVSLEWSLDSDYLLVGSRDLAARAFTIARDGYIFSWGYTEKDVKMDESEDGHSEPPSPVTPDRADEVMVENGGGVGTELKKRKEYDGKGLESDEEGDDDDEEYMHRGKWVLLRKDGCNQASAKVTACDYHQGLDMVVVGFSNGVFGLYQMPDFICIHLLSISRQKLTTAVFNERGNWLTFGCAKLGQLLVWDWRTETYILKQQGHYFDVNCVTYSPDSQLLATGADDNKVKVWNVMSGTCFITFTEHTNAVTALHFMADNHSLLSASLDGTVRAWDFKRYKNYKTYTTPTPRQFVSLTADPSGDVVCAGTLDSFEIFVWSKKTGQIKDILSGHEAPVHGLMFSPLTQLLASSSWDYTVRLWDVFASKGTVETFRHNHDVLTVAFRPDGKQLASSTLDGQINFWDTIEGVLMYTIEGRRDIAGGRVMTDRRSAANSSSGKCFTTLCYSADGGYILAAGTSRYICMYDIADQVLLRRFQISHNLSLDGVLDFLHSKKMTEAGPIDLIDDDNSDEEGGIDKQSRGNLGYDLPGSRPNRGRPIIRTKSLSIAPTGRSFAAATTEGVLIFSIDDTFIFDPTDLDIDVTPEAVEAAIEEDEVSRALALSMRLNEDSLIKKCIFAVAPADIKAVAISVRQKYLERLMEALVDLLENCPHLEFILHWCQEICKAHGSSIQRNYRTLLPALRSLQKAITRAHQDLADMCSSNEYTLRYLCSVPNNH

SEQ ID NO: 34746 - protein, 392 aa, Francisella tularensis subsp. holarctica
MSFLTLKDVDLKDKKVLVRVDFNVPVKDGKVTSKVRIEAAIPTIQYILDQGGAVILMSHLGRPTEGEYDSQFSLEPVAKALSEIINKPVKFAKDWLDGVDVKAGEIVMCENVRFNIGEKKSTDDLSKKIASLGDVFVMDAFATAHRAQASTYGVAKYIPVACAGILLTNEIQALEKALKSPKKPMAAIVGGSKVSTKLSVLNNLLDKVEILIVGGGIANTFIKAEGFDVGNSLYEQDLVAEATEILAKAKALGVNIPVPVDVRVAKEFSENAQAIIKKVSYVVADEMILDIGPESQKIIAELLKSANTILWNGPVGVFEFDNFAEGTKALSLAIAQSHAFSVAGGGDTIAAIEKFGIKDQVSYISTAGGAFLEFLEGKKLPAIEILKEKAIR

SEQ ID NO: 34747 - protein, 105 aa, Brassica napus
MAKEKDQNTKDNKNLLICFLWNFSAELKLILMALLVLCTLATLLPFIPSSFSISASELRFCISRIAAPDAVNSTSLAVVTDPGLENGVIKRPLKDKANGDTKRLV

SEQ ID NO: 34748 - protein, 188 aa, Magnaporthe grisea 70-15
MDYVEQRVAQEAKKLAEQPATEYAFTTAAPGLIPRASFITPLNIILLAVVAYTLYAVFRPAPPPPMPREAPATVFRTFTPPTLIHYNGQDGKPVYLAVRGRVFDVTAGRNFYGPGGPYENFAGRDASRGLAHHSFDQDMLTLDLNGPLDKLDDLGPDELAALRDWEERFESKYLVVGRLVAVGDEEKK

SEQ ID NO: 34749 - protein, 904 aa, Zea mays
  misc_feature (76)..(76): Xaa can be any naturally occurring amino acid
  misc_feature (185)..(185): Xaa can be any naturally occurring amino acid
ARAPTAKTPGFLFFLQRFPSRPRELQDPNHGGRDGTLLLLSVTSNDTLPSPPAQPHQQQEAPLSLPTEPAVVPARXGHLHLLKKPLHRTLSALAAQHGPVLLFRFGSRRVVHVADPAVAAECWSTHDVTFANRPRLPSARYLSNDYTTLGSSSYGPNWRNLRRIATVDVFSSHRVLCSADVRASXVRNMARQLFKAAAGADASRPARCDVKARAFEIALNTVARVIAGKRYYGDGSVASEEAERFRAMVREYLAMHGASNLQDFVPVLALVDIGGVNKRAIRLSKARNEWAQRLIDEHRAAAAAGREQGKTMVGDLLEKQASDPETYSDKVIRALCLSILQAGTDTSSSTIEWGMALLLNHPAAMAKAKAEIDEVIGTARILEEADLPNLPYLGCIIKETLRLHPVGPLLAPHESASDCSVGGYDIPAGTMLLVNVHAMHRDARVWEEPERFSPERFEGGNSDGKWMLPFGMGRRRCPGEGLAVKMVGLALGTLLQCFEWRRTGDEEVDMTEASGLTMPKSVPLEAFYWPLPRADLHEDRNNYRQIGRFTSTATPPPLRVCGSRHMELLRDSISMVSLAVLVTAVCARAASSWLRPGLPRLASLLPMVAFLAAAPLAFSSAIIRGLAGFFLGWLGVFKVVLLAVGRGPLDPALPVLPFVFTTALPVKLRCSSTGAAAACRAKSVSLVSCAVKVAVIAAILHVYQYTDQLHLYTRLALYSVHIYCFLDFLLPCIAAAGGALGMDMEPQFDKPYLASSLRDFWGRRWNLVVSDILRPSVYGPVRARAGKAPAVLATFLVSGLMHEVMIYYLTLRSPTGEMTAFFLLHGVCCIAEESCARRWMQWGWRPPPRPVATLLVVVFVAGTAFWLFFPQICREGMEELLLEEWAAVGAFFNDAARKLLQMFT

SEQ ID NO: 34750 - protein, 487 aa, Mesorhizobium sp. BNC1
MAESYDVIIIGSGPGGYVTAVRSAQLGLKTAIVEREHLGGICLNWGCIPTKALLRSAEILHYAQHAKDYGLKLDGSIAPDTAAVVDRSRKVSARLNTGVGFLMKKNKVDVIWGEAKISKAAKANEPGEIVVSKPSKKAMEPQHPAPKNTLGEGTYKAKHIILATGARPRVLPGIEPDGKLIWTYFEAMVPKEMPKSLIVMGSGAIGIEFASFYRTMGADVTVIELLPQILPVEDAEVSKFARRQLEKQGMKFHVEAKVTKVEKGANQITAHVEMKDGKVEKITADRLISAVGVQGNVENLGLEALGVKVERGTVAVDGYGRTNVPGIYAIGDVAGPPMLAHKAEHEGVICVEKIAGVPGVHALDKSKIPGCTYCQPQVASVGLTEEKAKEAGRDIRVGRFQFGANGKAIALGEDQGFIKTILDKKTGELLGAHMVGAEVTELIQGFVVAMNLETTEEELMHTIFPHPTLSEMMKESVLDAYGRSLNA

SEQ ID NO: 34751 - protein, 465 aa, Arabidopsis thaliana
MDLFSSLPNELLYHILSFLSTKEAALTSVLSKRWRNLFAFVPYLEFDDSVFLHPEERKREKEGILQSFMDFVDRVLDLHGDSLIKTFSLKCKTGVDSDHVDRWICNVLARGVSDLDLFIDFRDLYSLPHEVGVSRTLVVLRVGSESDLYWWQKFLCLPMLKTLVLDSCWLCIGQFQILLLACPALEELDMTNTRWKDSNVTVSSSILKELTIDLHGCCSVVNLKSLSFDAPSLVYFYYCDSLAEDYPQVNLKNLVEAQINLLLTQAQIEQVRALNNEMLVADDVFPGLGNAWKLITGLRNVQQLYLSPDTLEVLSRCCEGMPVFNNLKVLSIWSDMNRGWQAMPVLLRNCPHLETLIIEGLLHYATDKCGDVCDCISRDYKDHSLTSCPVKKLQIYEFRGTIRELEMIKHFLKIFPCLKEMDIYAHENSHTLFKDPTIFERVGKVMNFYNMLSSCSVQLLVRGPL

SEQ ID NO: 34752 - protein, 433 aa, Triticum aestivum
  misc_feature (262)..(262): Xaa can be any naturally occurring amino acid
  misc_feature (310)..(310): Xaa can be any naturally occurring amino acid
  misc_feature (331)..(331): Xaa can be any naturally occurring amino acid
  misc_feature (381)..(381): Xaa can be any naturally occurring amino acid
MRGYLGEIIRVCTKKQAGTAPEFPWISSTHASEKTSRPPPSVLAASIHRQREPSPPNSHKHKLTRLRSEPKPTTNSTATQPHPVILTTGASPLLRSARARARPAAMTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTSRSPVVTXGVVIAQGARDQALNRLGFNIGLGTPLPQGGENPFCKGFLSSFEGGKAXNSITRFLNRAPIPVILFAPGXTSFREINVVGVPIDLAKKDFTIVWLLLFNSCLSYFVNLTNFLVTKHTSAXYLQGGGNPKGTLAVVVSILIFKNPVSVTGMLGYTLTVIGVILYSESKKRSKP

SEQ ID NO: 34753 - protein, 429 aa, Photobacterium sp. SKA34
MADKKATLHIEGKAPIELPIIGGSEGQDVIDVRKLGANGFFTFDPGFLATASCESQITYIDGEKGILLHRGFPIDQLANNADYLEVCFVLLYGEVPTRAEYEQFRTTVTRHTMVHEQIASFFHGFRRDAHPMAIMCGVVGALSAFYHDSLDINNDTHREITAFRLLSKMPTLAAMCHKYTLGQPFIYPRNDLDYAENFLHMMFATPCEEYEVSPVVARAMDKIFTLHADHEQNASTSTVRLAGSSGANPFACIAAGIASLWGPAHGGANEACLKMLEEIGSVENIPEFIERAKDKDDPFRLMGFGHRVYKNYDPRATVMREACHEVLEELKVEDPLLDVAMELERIALSDEYFVSKKLYPNVDFYSGIILKAIGIPVSMFTVIFAMSRTIGWIAHWNEMHSDPTNRIGRPRQLYTGESYREFKPLHERE

SEQ ID NO: 34754 - protein, 560 aa, Ralstonia metallidurans CH34
MYQYDQYDQRIVQERVAQFRDQVRRRLSDELTEEEFLPLRLQNGLYMQRHAYMLRVAIPYGLLASKQMRMLAHIARTYDRDYGHFSTRQNIQYNWMDLERVPDVLDDLASVEMHGIQTSGNCVRNITTDQFAGVAPDETVDPRVLAELLRQWSTFQPEFAFLPRKFKIAISSSADDRAVVQMHDIGIYAYKNAAGETRLRILAGGGLGRTPILGTIIKEDLPWQHMLTYVESAIRVYNRYGRRDNKYKARIKILVKAIGAEKFAAEVEEEWKFSKDGPGTLTQAEFDRVAQYFQPPAYEKLPDTDASFEKHLLENKAFARWVNRNVHAHKVPGYASVTLSTKPGPVSPPGDATSAQMDTVADFADRYGYGELRVAHEQNLVLPDVKKRDLFALWEDAKKAGLATANIGLLTDIIACPGGDFCSLANAKSIPIALAIQERFDNLDYVYDLGDISLNISGCINACGHHHVGNIGVLGVDKDGAEWYQVTIGGAQGNDTALGKVIGPSFSAHEMPDVVSRIIETFVANRVGDERFIETVGRIGIAPFKERVYADKQREERAEA

SEQ ID NO: 34755 - protein, 618 aa, Synechococcus sp. CC9311
MEAASLVSKDLSLDSVNEGLTTTSGTQEAGRDRMLDGPSTPTESIDTALSKAEKRKLYSGHLREPLLTELSNEEIRFSEDAVQLLKFHGSYQQNHRELRKIDKIKCWQMMLRLRNPGGRVPAQLFSALDDLSNQYGNGTLRITTRQAFQMHGIPKADLKTVIGTIIKNLGSTLAACGDINRNVMAPAAPFENNGYPAARKLADEIADLLSPKAAEGSYLDMWVNGDLSYRFKPAKPVKQARKRQFEEGVFSGSQDEPIYGDTYLPRKFKVAVTVPGDNSVDLLTQDIGLVLFTNKNGTMRGCNVYVGGGLGRTHNQEDTFARIADPLGYVDAENIFDLLQSIMALQRDHGDREVRKHARMKYLLHNRGIQWFRETLINHYFKRDIKSLIKESPAKLMDYLGWHRQKPGLWFVGLPFMCGRLEGSVKAGIRTIVERYQLEIRLTPNQDLLLCNIGSNQKSSIKSELTELGFELPAEVAPLVRHALACPALPTCGLAVTESERVLPDVLERLDSQLNHLEIKKSILVRMTGCPNGCARPYMAELGLVGSGVNQYQLWLGGSANLQRLARPFLQKMPLEDLETTIEPLLLSWKDAGGRRGFGEHISKLGDATVQEMLKVPS

SEQ ID NO: 34756 - protein, 318 aa, Shewanella sp. ANA-3
MANTLEQLKSYTTIVADTGDIEAIKRYQPEDATTNPSLILKAAQIPEYRALIDNAIAWAKLQSADIEQQIDDASDKLAVNIGVEILKLVPGRISTEVDARLSFDKEKSIAKAHKLVRLYQEAGVDKSRILIKLASTWEGICAAKELEQEGINCNLTLLFSFAQARACAEAGVYLISPFVGRILDWYKNDTGKDYDAVNDPGVVSVTEIYNYYKQHGYNTVVMGASFRNIGEIIELAGCDRLTIGPSLLEELANSQVAIQPKLLPASTTVAAGEPLTEAQFRWDFNQDPMAVDKLAEGIRNFAIDQGKLEVMLKAKLAN

SEQ ID NO: 34757 - protein, 301 aa, Triticum aestivum
  misc_feature (144)..(144): Xaa can be any naturally occurring amino acid
MLPYATAGEAEAALGRALTWAEAAWLRYSASVPDRYLHWPNIAITLVVYTLAPLPLALFDLAAPAAAAPYKLQPKVQHPPATFFRCYMDAVRVSLLIIGPYQLISYPAAKIMDIRTGLPLPSMGEIMAQLTVYFLVEDYLNYWXHRLLHTKWGYEKIHHVHHEFTAPMAYAAWYGHWAEMLILAVPSLAGPALVPCHVTTLWIWFAARLVESLNIHSGFKLPFNAEKYIPFYGGAEHHDYHHYIGGQSKSNFAPVFTYCDYIYGTDKGYKYHKATLAKLKELAGSDVQKGADNGFNGGKQD

SEQ ID NO: 34758 - protein, 545 aa, Shewanella sp. ANA-3
MTILTQSTTWQALAAHSQQIPHMRELFASDPARFSNMSLSTCGLFLDYSKNRATPETLNLLLTLAQEAKLDAKIKAMFAGDIINTTEKRAVLHTALRSTAEQTIIAEGQDIVPEVQQTLNKMQQFVTSVTSGQWKGFTGKTITDIVSIGIGGSFLGPKIVSQALRPYWMTGLNCHFVANVDGTSISEKLKLLDPETTLFIMSSKSFGTQETLTNTLTAKAWFLAKGGSQSDVAKHFVAVTSNVAKATDFGIDADNIFPMWDWVGGRYSLWSAIGLPIALLIGMDNFRSLLKGAHQMDTHFANAPLAENMPVIMGLFSLWYGNFFNAQSHVVLTYDHYLRGLPAYFQQLDMESNGKSVTLNGTHVDYSTGPVIWGGEGTNGQHAYHQLLHQGTALIPADFIMPLQSHNPIGEHHDQLASNCFGQTQALMQGRTLDEALAELSKSNLSDEEKLLIAKHKVMPGNKPSNTLLMDKLTPETLGALIALYEHRTFVQGAIWDINSFDQWGVELGKSLGNDVLARIGAEQDATALDASSNGLINLYRQGKI

SEQ ID NO: 34759 - protein, 362 aa, Haemophilus influenzae R2846
MQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDMQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 34760 - protein, 289 aa, Agrobacterium tumefaciens str. C58
MSSMADSRETLTINAFVVGYPIKHSRSPIIHSYWLKKFGIAGSYTAVEVSPDDFPKFIATLKEGKPGAAVGGNATIPHKEAAYRLADHPDALAEELGAANTIWMEEGKLHATNTDGYGFVSNLDERHPGWDKTQRAVVFGAGGASRAVIQSLRDRDVAEIHVVNRTVERARELADRFGPRVFSHPQAALQEVMHGAGLFVNTTSLGMNGTEAPHLDFSHLAANAVVTDIVYVPLKTPILNMAQEQGIATVDGLGMLLHQAKPGFRRWFGRIPEVDETLRSLIIADMEKH

SEQ ID NO: 34761 - protein, 464 aa, Sulfitobacter sp. EE-36
MAAKSFDLIVIGAGPGGYVAAIRGAQLGLSVAIVEREHLGGICLNWGCIPTKALLRSSEVFHLMQRASEFGLKAENIGYDLEAVVKRSRKVAGQLSGGIGHLMKKNKVSVFMGAATLAGKGKVSVKSKDGEETLTAKNIVLATGARARNLPGLEADGKRVWMYKDALQPPHMPKKLLVIGSGAIGIEFASFYNTLGADTTVVEVMDRILPVEDEEISKFAKKQFEKQGMKIMQKAVVKQLDRADDKVTAHIETGGKVTKHDFDTVISAVGIVGNVEDLGLEDLGVKIDRTHVVTDEYCRTGVEGLYAIGDIAGAPWLAHKASHEGVMVAELIAGQHAHPVKPESIAGCTYCHPQVASVGYTEAKAKELGFDVKVGRFPFIGNGKAIALGEPEGMIKTVFDAKTGELLGAHMVGAEVTELIQGYVVGRQLETTEEDLMNTVFPHPTLSEMMHESVLDAYGRVIHM

SEQ ID NO: 34762 - protein, 373 aa, Picrophilus torridus DSM 9790
MSISLGLEDVFIKYTSLTSIDGEKGELRYRGYDIKDLVEHCSFEEVAYLMFYGELPKRDELEHFKSNVMKNYKIPENVKNIIKNMPRDGDALAIMEAAFAALSTEEYTWEKERDREKAAEIMGRALGIVSAVFRYRDGREIKDPENKGYAEAFLNACFDSGIDEDKIKAMNAALILYIDHEVPASTTAALVASSTLSDMYSCVTAAIAALKGPLHGGAAEAAYKQFLAIKSPENVDSWFNENILNNKKRLMGFGHRVYKTYDPRMLIFKELARKNAKTDEQKKILELAERLEALGVKNFGQKKIFPNTDYYSGIVFNEIGFPLYMFTTLFALSRVVGWVAHISEYVESEERLIRPRAIYIGPEKRDVVPIDKR

SEQ ID NO: 34763 - protein, 1129 aa, Mycobacterium leprae TN
MRPERGTLVPRRTDLNHVLVIGSGPIVIGQACEFDYAGTQACRVLRAEGLQVSLVNSNPATIMTDPEFADHTYVEPITPAFVERVIVQQAERGNRIDALLATLGGQTALNTAVALYENGVLERYGVELIGADFEAIQRGEDRQRFKDLVAKVGGESARSKVCFTMDEVRETVEDLGLPVVVRPSFTMGGLGSGMAHSDEEVGRMAGAGLVASPSANVLIEESVYGWKEFELELMRDGHDSVVVVCSIENVDPMGVHTGDSVTVAPAMTLTDWEYQRMRDLGIAILREVGVDTGGCNIQFAINPHDGRLIVIEMNPRVSRSSALASKATGFPIAKIAVKLAVGYTLDEILNDITKETPACFEPALDYVVVKAPRFAFEKFPGADPTLTTTMKSVGEAMSLGRNFVEALGKVMRSLETGRFGFWTAPDPQGDVDQVLLRLKTPTEGRLYDVELALRLGASTEKVAQVSGIDPWFVAQIGELVKLRDELVAAPVLDAELLRRAKHNGLSDRQITALRPELLGEDGVRSLRKRLGIHPVYKTVDTCAAEFEAKTPYHYSSYELDPAAETEVVPQTEKPKVLILGSGPNRIGQGIEFDYSCVHAAITLSHNGFETVMVNCNPETVSTDYDTADRLYFEPLTFEDVLEVFYAEEQSAAGGAGVAGVIVQLGGQTPLGLAQRLADAGVPIVGTSPEAIDLAEDRGAFGDVLTAAGLPAPKYGTATTFAQARRIAAEIGYPVLVRPSYVLGGRGMEIVYDEETLKDYITRATALSHEHPVLVDRFLEDAVEIDVDALCDGTEVYIGGVMEHIEEAGIHSGDSACALPPVTLGRSDLEKVRQATEAIARGIGVVGLLNVQYALKEDVLYVLEANPRASRTVPFVSKATAIPLAKACARIMLGSSISQLRFEGMLAASGDGGNVASHAPIAVKEAVLPFNRLRRADGAAIDSLLGPEMKSTGEVMGIDHDFGRAFAKSQTAAYGSLPTQGTVFVSVANRDKRLLVFPVKRLADLGFHVIATEGTAEMLRRKGIPCDEVRKHFEPPKAGRPALSAVDAIRAGDVDMVINTPYGNSGPRIDGYEIRSAAVSVNIPCVTTVQGASAAVQGIEAGIRGDIGVRSLQELHSAIGAGIAADNEVQ

SEQ ID NO: 34764 - protein, 452 aa, Mesorhizobium sp. BNC1
MPIQITMPALSPTMEEGNLAKWLVKEGDSVSPGDVIAEIETDKATMEVEAVDEGTVAKIVVPEGTQGVKVNALIAILAGEGEDAAQAAKASGNGGAAAAPEPKPEAKPEATPSASKQPEEAENRPAPAAKPAAPQPSADKDGRVFASPLARRIAKDAGIDLSAISGSGPRGRVVRADVEAAISGGTAKPAAAAPEGPAPAPKPMSDEAVLKLFEEGSYELVPHDGMRKTIARRLVEAKSTIPHFYLTLDCEIDALLALRKQLNDAAPMVKAEAGEKPAYKLSVNDLIIKAWALALKAVPEANASWTESAMIKHKHADVGVAVSIPGGLITPIVKRADEKTLSVISNEMKDLAARARNRKLKPEEYQGGTSAISNLGMFGIKDFAAVINPPHATILAIGAGEERPVVRNGEIKIATVMSVTLSTDHRAVDGALGAELLTAFKRLIENPFGMLV

SEQ ID NO: 34765 - protein, 466 aa, Mesorhizobium sp. BNC1
MPTQILMPALSPTMEEGNLSKWVKKEGDKVAPGDVIAEIETDKATMEVEAVDEGTLGKILVEEGAQGVRVNTPIAILLADGESADDLGKDAVTPPPARAQAPAEVHADQQAEGFPRPAATPKAATQPMPSDPDIPEGTEMVEMTVREALRDAMAEEMRRDADVLIMGEEVAEYQGAYKVTQGLLQEFGAKRVIDTPITEHGFAGVGIGAAFAGLKPIVEFMTFNFAMQAMDQIVNSAAKTLYMAGGQMGAPIVFRGPNGAAARVAAQHSQDYAAWYSHIPGLKVVMPYTAADAKGLLKAAIRDPNPVIFLENEILYGQSFQVPKLDDFVLPIGKARIHKQGRDVTIVSFGIGMTYAIKAEEELRGMGIDVEIIDLRTIRPMDLDTVVESVKKTNRLVTIEEGFPQSSVGDHIASKVMQRAFDYLDAPIITIAGKDVPMPYAANLEKLALPSVVEVVEAVKAVTYRA

SEQ ID NO: 34766 - protein, 471 aa, Anaplasma phagocytophilum HZ
MDKYEVVIIGSGPGGYIAAIRAAQLGYNVAIVEREDNLGGVCLNWGCIPTKALLKSAQLYKKILSASSFGIKITGDVEVDIQSIVAHSRDAVAKLSCGVSMLMKKNGVKVYKGCARIAGKGEIHVDNDGVKSALSAKHIILATGGRPRIATNLDTKLLWSSKDAMLPETLPKSLLIIGSGAIGIEFASFYSTIGSKVTIVEMQDRILPLEDRDISLSMHEILKNQGVDIFTACSVMDLVQSASSITAQIVNSGTKDTVTSSFERVICAIGILPNSGNLGLEDTKVQLDKGGFIITDGMCQTSEPGIYAIGDVAGPPCLAHKASHEAVICVEGIAKKDGRISTAPSTLHKNNIPSCIYSIPQIASVGLTEDAAKAQGLEIKVGISRASCNGKAIASGESEGFVKVILCSKTGELLGAHMLGSEVTEMINGYIVGRQLEATDLDIAHTIFPHPTLSEMMHSAILSAWNEPLDS

SEQ ID NO: 34767 - protein, 424 aa, Mesorhizobium sp. BNC1
MTAIVDIVGREILDSRGNPTVEVDVVLEDGSIGRAAVPSGASTGAHEAVELRDGGPRYLGKGVARAVEAVNGEIFEAIGGLEAEDQIHIDRTMIELDGTPNKSRLGANAILGVSLAVAKATAAASGLPLYRYVGGASAHILPVPMMNILNGGAHADNPIDFQEFMIMPVGAPTLRDAVRWGSEIFHTLKSGLKAAGHNTNVGDEGGFAPNLKDANAALDFIMASIEKAGFKPGDEVAIALDCAATEFFKDGKYVYEGEGQTRDAQAQAEYLSKLAGEYPIISIEDGMAEDDFEGWKALTDLAGSKVQLVGDDLFVTNAARLKDGINMGIANSILVKVNQIGSLTETLEAVETAHKAAYTAVMSHRSGETEDSTIADLAVATNCGQIKTGSLARSDRLAKYNQLIRIEEQLGRAARYAGRTVVRG

SEQ ID NO: 34768 - protein, 270 aa, Arabidopsis thaliana
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQEKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 34769 - protein, 254 aa, Mesorhizobium sp. BNC1
MTPTIRPLIAGNWKMHGTESSLGELKAIGSGFVEAAGAGADGVICVPATLLARASDILAKTPVATGGQDCHPATSGAHTGDIAAEMLADCGASYVIVGHSERRTDHHEADEDVAAKAEAAWRAGLTAIICIGETKIQREAGETLSVLSRQIAGSVPPGATAKNSVIAYEPVWAIGTGLTPTVEDVAQAHAHLRAELGMKLGIEADGMRLLYGGSVKPSNAGELLSILNVDGALIGGASLKAADFLAISAAVKGK

SEQ ID NO: 34770 - protein, 294 aa, Lupinus angustifolius
MASSEQKFPPQKQYTQPGKEHLMYPTPQFTCPDEYKPSDKLKGKIAVVTGGDSGIGRAVCNLFALEGATVIFTYVKGHEDKDAKDTLELIRRVKTSDSKEPKAIAVDLGFDENCKKVIDEVINAYGSIDILVNNAAEQYECGSVEEIDEPRLERVFRTNIFSYFFMTRHALKHMKEGSSIINTTSVNAYKGHPSLLDYTSTKGAIVAFTRALALQLVNKGIRVNGVAPGPIWTPLIPSSFKEEETAQFGSDVPMKRPGQPSEVAPSFVFLACNICSSYITGQVLHPNGGNVVNG

SEQ ID NO: 34771 - protein, 74 aa, Arabidopsis thaliana
  misc_feature (32)..(32): Xaa can be any naturally occurring amino acid
  misc_feature (35)..(35): Xaa can be any naturally occurring amino acid
  misc_feature (45)..(46): Xaa can be any naturally occurring amino acid
  misc_feature (54)..(54): Xaa can be any naturally occurring amino acid
  misc_feature (56)..(56): Xaa can be any naturally occurring amino acid
  misc_feature (61)..(64): Xaa can be any naturally occurring amino acid
  misc_feature (66)..(66): Xaa can be any naturally occurring amino acid
MASSMLSSTAVVTSPAQATMVAPFTGLKSSAXFPXTRKANNDITXXTSNGGRDXCXKVWSXXXXEXGRCEIKLF

SEQ ID NO: 34772 - protein, 524 aa, Hevea brasiliensis
MASSVLPSPSLQSQFMSLRSSTKPYSRRSSLSPIKASVSEKPSIGISSPTVSPTDSSKLPLRKIPGDYGLPFIGPINDRLDYFYKQGKEEYFKSRAQKYQSTVFRANMPPGPFISSNPHVVVVLDGKSFSVLFDVTKVEKKDLFTGTFMPSTELTGGYRILSYLDPSEPKHTQLKNFLFYLLKSRRDHVIPEFSSTYTGLFESLENDLASKGKVNFNNPGEQAAFSFLGRSYFGVNPVDTKIGTDGPTLIAKWVLFQLAPILTLGLPAFLEEPTIHTFRLPAFLVKKDYKRLYDYFYSSAGSLLDEAEKMGISREEACHNILFATCFNTFGGLKIFFPNILKWIGRAGVKLHTQLAQEIRSVIKSNGGEITMAALEQMPLMKSAVYEAFRIEPPVPAQYGKAKRDLIIESHDAAYEVKEGEMIFGYQPFATKDPKIFDTPDEYVPDRFVGEGEKLLQHVLWSNGPETDHPTMGNKQCAGKDFVVLISRLFVVELFRRYDSFEIEVGSSPLGSSITITSLKRASF

SEQ ID NO: 34773 - protein, 461 aa, Mesorhizobium loti MAFF303099
MSKTQTADQITEARRESHLFYLSSLRRPLIDRAEGIYMWTQDGRRFIDGSSGPMVANIGHSNRNVLDAMKRQMDRATFAYRLHFENEPAEELARELAKKLPEGMDRIFFVSGGSEATESCIKLARQWAVATGQASRWKVITRFPSYHGGTLGSLSITGDDALAETFEPMMRVMPTVPAPTAWRDRDNLSMEQRGVRYADMLEEKILAEGPESVVAFIMEPIGGAATAALVAPDSYYARTREICDHYGILLIHDEVMCGAGRTGKFLGGDHWNCKPDIVALSKGLGSGYAPLGALAAPMRLVQPLLASGGFQHGHTYAGNPLACAAGLAVLGEMDRLDLIANAAAMGDVLMDGLKGLAKRFPFIADVRGKGLLTGAEMVADPETLRPIEQGKKATQRLLDLAYERGLIIYGRRVKGGVDGDNFMVAPPMIVTSEQVGEIISIIGDSLEVLASELDLPVEGRG

SEQ ID NO: 34774 - protein, 442 aa, Bacillus subtilis subsp. subtilis str. 168
MPSLEKAVVLEFINLLAVAILILLTGFFVAVEFSIVKVRRSKIDQLVAKGKKGAKAAKHVITHLDEYLSACQLGITVAALGLGWLGEPTVQTLLRPLFHKAGLNESLTHLLSLVIAFLVVTYLNVVIGELAPKSFAIQKAESITLLFAKPLIWFYKIMFPFIWLLNHSARLITGVFGLKPASEHELAYTEEELRVLLAESYKSGEIRKSELKYMNNIFTFDKRMAKEIMVPRNEMVSLSLDEDSISNLQETVKQTKYTRYPVVREDKDNVIGVINMKEVLFSMLTKDFSIKKHQIEPFVQPVIHVIETIPIYKLLLKMQKERTHMAILIDEYGGTSGLVTVEDIIEEIVGEIRDEFDADEVPHIRELGKDHYLLNAKLLISDVNSLLGTDLSEAEVDTLGGWFLTQNIDAEPESAIEYDGYSFKVKDINSHHILFIEVKKAE

SEQ ID NO: 34775 - protein, 323 aa, Haemophilus influenzae R2846
MSHCVERKNITIQDKIMRKTLTVLGSINADHVISVPYFSKPGETLTGDNYQLVYGGKGGNQAVAAARLGANVEFIGCVGSDVIGETMKNAFAQEGIDTTHINTVSQEMTGMAFIQVAQSGENSIVLASGANAHLGEMVVRQSEAQIAQSDCLLMQLETPLSGVELAAQIAKKNGVKVVLNPAPAQILSDELLSLIDIITPNETEAEILTGIAVTDDEQSAVKAASVFHDKGIQTVMITLGAKGVFVSRKGKSRIIKGFCVQAIDTTAAGDTFNGGFVTALLEEKAFDEAIRFGQAAAAISVTKKGAQSSIPTRQETLEFLEHA

SEQ ID NO: 34776 - protein, 700 aa, Synechococcus sp. RS9916
MATIHRGSPWPMGSTITARGVNFSLAAPAANRVELLLFPHGDAAQPDRIIDLDSAHRSGDYWHVEVEGLGAGCCYGYRVFGPLQPGGHGFRPAKVLLDPCARAISGWNVYRRGSATGASPNTDACLKGVVCERDRFDFNTHPRPQHRWNRSVIYELHVGSFTRREDSGLEPNLRGTLRGLIRKLPYLQSLGITAIELLPIQAFDPQDAPPGRDNVWGYSPLSWFAPHHEFIEGHDPLAARQQVRELVAACHDAGIEVLLDVVYNHTTEGNQQGPTLSWRGIADCLYYHQTAKGEYQDVSGCGNSIAANRPLVRQLILESMRCWAIELGIDGFRFDLGIALSRGEKLKPLDHPPLFEAIDSDPELSDLKLVSEPWDCGGLYRLSDFPSKRIGAWNGRFRDDLRRFWKGDENSTWTLGQRLRGSPDLNDGKPLKLDRSVNFITAHDGFTLADLVSFNVKHNLANGEDNRDGENHNSSWNHGVEGPTTDRAVQTLRRRQQRNLLTSLLLSRGVPMLLMGDEVGRSQGGNNNTWCQDSPLSWMIWRQDDCDGDLLLFVQRLLKLRQRLPDLFSPETPISETRPRRGSEPDQLWRQWHGVELNKPDWASWSHCIATSLQRGDRGAVLWVGFNSYFKAMHFDLPPAASPWHRLIDTALPAGDDLPETPEPWTPQGVPLESRSLVVMAARELLPSETNTGSTTANNT

SEQ ID NO: 34777 - protein, 467 aa, Musa acuminata
MEAKSTGRFTLGKQSSLAPDRDDGELQALRSGDLDGLQVLEEVDANIRLMYLANEGDLAGIEETLASGVDVNFRDIDDRTALHVAACQGFADVVQLLLDRGALVDPEDRWGSTSNFITIAPAKQPLADAVHYKNHEVIKLFEKHGAKLQVTPMRVENAREVPEYEIDPSELDFTNSVNITKGTFIIAKWRGIQVAVKKFSDDVMADEDKLWDFFIFCRSAFRDELALLQQIRHPNVVQFLGAVTQSSPMMIVTEYLRKGDLRAYLNRKRTLRPSSAVLFALDIARGMNYLHEHKPEAIIHRDLEPSNILRDDSGHLKVADFGVSKLLKVAKTVKEERPLTCLDTSCRYVAPEVFLNEEYDTKVDVFSFALILQEMIEGCPPFSYKQDNEVPKAYVSKQRPPFRAPPKQYGHGLKELIEHCWSENPADRPTFREIIDRLSKIQNHIAQKRRWKVSLFNFYLGLQLFSL

SEQ ID NO: 34778 - protein, 930 aa, Brucella melitensis 16M
MSRPDFFGWPSASDRISNASRFRECLQQLQVFREPCPVSREAGMAKWVYTFGDGKAEGAASDRNLLGGKGANLAEMSSLGLPVPPGFTITTEVCTYYYNNDRVYPSELDAQVQAALAHIATLTGRNFGDAEKPLLVSVRSGARASMPGMMDTVLNLGLNDETVQAIARESGDERFAYDSYRRFIQMYSDVVLGVDHGFFEEILEDTKADLGVEVDTALSADDWKNVIGLYKAKVEEELGQPFPQDPREQLWGAIGAVFSSWMNARAITYRRLHNIPAAWGTAVNVQAMVFGNMGETSATGVAFTRNPSTGENKLYGEFLVNAQGEDVVAGIRTPQNITEEARIAAGSDKPSLEKVMPEAFAEFLKVANRLEQHYRDMQDLEFTIERGKLWMLQTRSGKRTARAALKMAVEMAAEGLISEEEAVLRIDPAALDQLLHPTIDPRAERQVVGMGLPASPGAATGEIVFSSEEAEQAKAEGRNVILVRIETSPEDIHGMHAAEGILTTRGGMTSHAAVVARGMGKPCVSGAGSLRVDYRNGTMLAAGQTFRKGDVITIDGASGQVLKGSVAMLQPELSGDFGKLMEWADRARRMKVRANAETPADARTARSFGAEGIGLCRTEHMFFDGSRIVAMREMILSDTEEGRRLALGKLLPMQRSDFAELFEIMKGLPVTIRLLDPPLHEFLPHTDEEVDEVARSMGVDAAKLRDRADALHEFNPMLGHRGCRLAVSYPEIAEMQARAIFEAAVEAGKKTGEPVVPEVMVPLVSLKAELDFVKARIDAVAKEVMSEAGIKIDYMVGTMIELPRAALRAAEIAESAEFFSFGTNDLTQTTFGISRDDAAGFLTTYQNRVVIEQDPFVSLDVDGVGELVQIAAERGRKTREKIKLGICGEHGGDPASIAFCEKTGLDYVSCSPFRVPIARLAAAQAAVRKV

SEQ ID NO: 34779 - protein, 589 aa, Musa acuminata
MWLRLLMHLTQGCDNSTYQLLDEHHHLHTPKRQGVFMDNNNDNDAYVVATSSLKLSMPDSDLFKDARISPVSLTYYGLCLLEGNYSVKLHFAEIKITNDGYGSLGKRIFDIYIQGNLVWKDFNIRDEANGSGNAIIKSTNVMVTDKLEIHLYWAGNGTQSLPVRGTYGPLISAISVEPNFSLSSGKRTKIIVGIIVSVSCLIFLLLSILWKKGWLGGQTAKDRELRALDLRTGRFTLRQIKMATGNFSASNKIGEGGFGPVYKGLLPDGTIVAVKQLSSKSKQGNREFLNELGMISALQHPNLVKLHGCCIEGNQLLLVYEYMENNSLARALFGSEEYQLKLDWSTRKNICIGIAKGLAYIHEESRLKVVHRDIKATNILLDKNLNAKISDFGLARLDEEENTHISTRIAGTVGYMAPEYATRGYLTEKADVYSFGVVTLELVSGTSVMSFRKEGGMHLLDWVQILREEGKLEKFVDPRLGTDFNKEEAIRLINVGLLCINSSPVPRPPMSAVVSMLVEAQTSIVDATPEQIFSTDDFEIQVSGKRYPSSGDSQTKSILVEGGSVHGSTTSSSDLYPLNLDSLYRNRRC

SEQ ID NO: 34780 - protein, 319 aa, Staphylococcus epidermidis ATCC 12228
MRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSADMLYQPENIDDIQVFQDDILHFCSVDLIESDMKYAHEKMIEKFESVDGTIVFDPNVRLPLWEDKLECQRTINAFIPKAHIVKISDEELLFITGKRNEDEAIQSLFRGRVNVVIYTQGAQGATIYTKDDYRIHHEGYQVQAIDTTGAGDAFIGAIIYCILESRYSECKDLFKEKGKDILAFSNRVAALTTTKHGAIESLPTKEDIKDYN

SEQ ID NO: 34781 - protein, 333 aa, Sulfitobacter sp. EE-36
MATKLAINGFGRIGRNVLRALMERGDDDLQVVAINDLAPLETNAHLFEFDSVHGRFGRPVTLGDNTMDVGQGPIRVTAERDPAALPWGDVDIVLECTGIFTTREAAAKHLANGSKRVVISAPGKDAMKTIVYGVNHDLITAEDTVLSNASCTTNCMAPLAKTLHDAFGIKHGHMTTIHSYTGDQPVHDTAHSDLYRARAAALSMIPTTTGAAKTLGKVLPELDGLIGGTAIRVPTPNVSCVDLVVELSKEATVEEVNATLRTAAEGPLKGILGLVDRPLVSIDLNHDSHSCVVALDQTSVQSGTQLRVLGWYDNEWGFSNRMLDTSREVAKTL

SEQ ID NO: 34782 - protein, 1051 aa, Picrophilus torridus DSM 9790
MRYKDIKCTLVIGSGPIVIGQAAEFDYSGSQACLALREEGIRTVLLNSNPATIQTDRDIADRIYIEPIEPDTVIEIIKREGIDSILPSTGGQVGLNLVVLLDKLGILSEYNIRVLGTPVKSIELAEDRKKFFNLMRDINEPVISSYTITKDNYINDVENIKRYPLILRTGFSLGGSGGTVINSRDELLNYCKEYFLTSDLDIEVDESLLGLKELEYEMIRDNNGNCISVCNMENLDPMGIHTGESIVVTPSQTLSNDDYQMLRKAAIHVVSAIGVIGACNIQFALDQKRNEYYVVEVNPRTSRSSALASKASGYPIARISTKIAIGYNLNEIINPITKNTYAAFEPSLDYVTVKIPRWPFDKFSVSRRIGIEMKSTGEVMGIGRTFEEALMKAISSIDIPYSRRLRIKATKDEIIKNLEEPTDLRIFYIFEALFSGLDPEYISKLTKYDVFFIYKMKNIVDLLSGLKNKMPDNLKELKKYGISDAIISYFTGIDELSIIRERLKNNIVPSYKNIDTCSGEFESDTPYLYSTYDDFSDMMPENKRKIIVIGSGPNRIAQGVEFDYGSVKAIKAIKSLGYQAIMVNSNPETVSTDFDVSDRLYFEPITLEHVSNIIYRERPAGIIIQFSGQTGQNIAMDLNRIFNGIILGTQPESINIIENRVEFSKLLSRLNIKQPDYIEVNNINDVDERIKMIKLPVIIRSSFIIGGRAMDIIYDVDDLKSRVSEVFRDMPGYPVLISEYISNATEMDVDFVSDGEKFQIAGISVHVEEAGTHSGDASMILGPRFPSDDIKMKIENIIDKLVKELKLKGISNLQIAVKNDEVYIIELNARSSRSVPFVSKATGIDWASIAVSVMLGMNLEKRDVRLDSYFLKIPVFPFRRFRDMDTILGPEMKSTGEAMCCGKTLEEAFYKASKLIKKNFELKSVLITVNDNDKERIIDMAYELYKNGVRIYATPGTSKFLREHGIENTTVYRIKDMREPRLMDIIINNDVSLIINTPTNSYGSIRDGFSIRQYAIRLNIPLITNVRFAEPFVKALIKKPRLNYMEISEYF

SEQ ID NO: 34783 - protein, 959 aa, Sinorhizobium meliloti 1021
MSLIHEIDYGTPASKSEKLVTLTIDGREITVPEGTSIMRAAMEAGIEVPKLCASDMMDAFGSCRLCLVEIDGRAGMPASCTTPVAAGISVSTQTQRLKDVRRGVMELYISDHPLDCLTCAANGDCELQDMAGAVGLRDVRYGYDGENHVTARNNGEINAKWAPKDESNPYFTYDPAKCIVCSRCVRACEEVQGTFALTISGRGFDSRVSAGMNEDFVSSECVSCGACVQACPTATLTEKSVIEIGQPEHSVVTTCAYCGVGCSFKAEMRGEELVRMVPWKDGQANRGHSCVKGRFAYGYSNHRDRILNPMVREKVTDPWREVTWEEAFAHVASEFRRIQYQYGRDSVGGITSSRCTNEETFLVQKLVRAGFGNNNVDTCARVCHSPTGYGLNQTFGTSAGTQDFDSVEHTDVAVIIGANPTDGHPVFASRLKKRLRQGAKLIVIDPRRIDLVRSAHVEASYHLPLKPGTNVAILTAIAHVIVTEGLANEAFIRERCDWSEFEDWAAFVAEPHHSPEATEAYTGVPPELVRGAARLYATGGNGAIYYGLGVTEHSQGSTTVMAIANLAMLTGNIGRPGVGVNPLRGQNNVQGSCDMGSFPHELPGYRHISDDATREIFEKLWGVTLNHEPGLRIPNMLDAAVEGTFKGLYVQGEDILQSDPDTKHVAAGLAAMECVVVHDLFLNETANYAHVFLPGSTFLEKDGTFTNAERRINRVRRVMRPKNGYADWEVTQKMAQAMGLAWNYRHPSEIMDEIAATTPSFAMVSYDYLDKMGSVQWPCNEKAPLGSPIMHVDGFVRGKGKFIRTEYVATDERTGPRFPLLLTTGRILSQYNVGAQTRRTENVVWHAEDRLEIHPHDAEQRGIRDGDWVRLASRSGDTTLRALITDRVAPGVVYTTFHHPSTQANVITTDFTDWATNCPEYKVTAVQVSPSNGPSDWQRDYDEQARQSRRIAGKLEAAE

SEQ ID NO: 34784 - protein, 353 aa, Pediococcus pentosaceus ATCC 25745
MYFISLFGWSLVTVFQAFIGGFGQLMGLRLGVGFFEAPVMPANNRAISYWFPEDERGSAIGIYSSAQFLGLAFSTPILYSIHNTIGWRGLFIVTGIIGIIWSVVWYILYADPNKSRFVGDDELAYIKAGGAISEGDDAQSNSNTKQEKTKITWENIKQLFTRRLLGIYIGQFAISGTFWFFLTWFPTYLTKAKHVNFLQSGMLSSIPYLAAFCGVILAGFMSDKLLKSGKSASFARKAPVITGLLLTLLILGANYVSSPALIIMFMSIAFFGNGLATITWVFVTALAPKHLIGLAGGIFNGCGALSSIVIPIVIGFLVSKGNFSSALIFIAAIALVGALSYILVVGKIEINED

SEQ ID NO: 34785 - protein, 534 aa, Cryptococcus neoformans var. neoformans JEC21
MPDPAPFWLCHECGAQMRPVTIDGTPHCASCNGEFIEILDPEVNPDPDYELPPPPPTRPGQQTPSRFDPHFLSNFPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTPNVGTEHTRNAEEERPATPTIPAAVSNFFRNLFGGSESQPSTPRAAAGGGHGSNASQDPHSSVNVVSESTISADASSRHSPTIHGATRREQVQPCDEVASEGSSNDSLVRVYPEHSSGETHGDGATDGEAGRIAEQEQQVASRDRLADRVNRDFNERWQRLRREREEDDTVYHPDLD

SEQ ID NO: 34786 - protein, 643 aa, Burkholderia vietnamiensis G4
MNANPKFLSADAHVDAAAVAPLPNSRKVYVTGSQPDIRVPMREITQADTPTGFGGEKNPPIYVYDTSGPYTDPDAKIDIRAGLPALRQRWIEARGDTEVLDGLSSGYGRERAADPATADLRFPGLHRNPRRAQAGKNVTQMHYARQGIITPEMEYIAIRENQRRAEYLENLKASGPNGAKLAAMMGRQHPGQAFGAAAFGANALAEITPEFVRDEVARGRAIIPANINHPESEPMIIGRNFLVKINANIGNSAVTSSIGEEVDKMTWAIRWGGDTVMDLSTGKHIHETREWIIRNSPVPIGTVPIYQALEKVNGKAEDLTWEIFRDTLIEQAEQGVDYFTIHAGVRLQYVPLTANRMTGIVSRGGSIMAKWCLAHHKESFLYEHFEEICEIMKAYDVSFSLGDGLRPGSIYDANDEAQLGELKTLGELTQIAWKHDVQVMIEGPGHVPMQLIKENMDLQLDWCKEAPFYTLGPLTTDIAPGYDHITSGIGAAMIGWFGTAMLCYVTPKEHLGLPNKDDVKEGIITYKLAAHAADLAKGHPGAQVRDNALSKARFEFRWEDQFNIGLDPDKAREFHDETLPKDSAKVAHFCSMCGPHFCSMKITQDVREFAAQQGVSETEALQKGMEVKAVEFVKTGAEIYHRQ

SEQ ID NO: 34787 - protein, 486 aa, Frankia sp. CcI3
MRQARRHEAGRGEMSEIDSPAVVPLEEKPLEENLWPATARLDADGVLRIGGIRVNELAAEFGTPAFVLDEADFRARCAAWRRAFAECDVYYAGKAFLCRTIARWVDEGGLNLDVCTGGELAVARSVGFPADRLLFHGNNKSVAELRAAVGYGVGRIVVDSFAEITRLAAVAAEAGVRQRVLIRVTPGVEAHTHHYVSTGQEDQKFGFSLAGGSAAEAVERVLAAAGSLELVGLHAHIGSQIFDTAGFGLAAHRLVGLLARIRDTHDLELPELDLGGGLGIAYTGEDAPLEVTDVAERLTAVVGKECAAAGLTVPRLAVEPGRAIVGSTTVTLYEVGTVKELPGLRTFVSVDGGMSDNIRTALYDARYTARLVSRTGLATTHVVTIVGRHCESGDVVAHDVPLPDDVRPGDLLAIPASGAYHRSMASNYNHVARPPVIAVRDGAARIIVRRETEDDLLRLDVDPGVKVDPGVKVEPGADPASPEVAR

SEQ ID NO: 34788 - protein, 793 aa, Oryza sativa
  misc_feature (371)..(371): Xaa can be any naturally occurring amino acid
MDEEARAAGCSPAPPRAPAASCGAAAELCLCSPTGVEGIEQVPGCPCFEDAGAVVVSGEAPEGPGVLCSEDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESERGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAXGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRRNPPHGTLLSPPPTTMAMATQASAAKCHLLAAWAPAKPRSSTLSMPTSRAPTSLRAAAEDQPAAAAAEDQPAAAATEEKKPAPAGFVPPQLDPNTPSPIFGGSTGGLLRKAQVEEFYVITWTSPKEQVFEMPTGGAAIMREGPNLLKLARKEQCLALGTRLRSKYKINYQFYRVFPNGEVQYLHPKDGVYPEKVNAGRQGVGQNFRSIGKNVSPIEVKFTGKNVFDI

SEQ ID NO: 34789 - protein, 473 aa, Brassica napus
MSATLTGSGTALGFSCSSKIPKRVSPSSSNRCSIKMSVSVDEKKKSFTLQKSEEAFNAAKDLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTLEFINGLRQLSRDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHAMCGGYISGMFGFFFTEGPVYNFADAKKSDTEKFGRFFRGMLEEGVYFAPSQFEAGFTSLAHTTEDVQFTIAAAERVLGRI

SEQ ID NO: 34790 - protein, 342 aa, Mesorhizobium loti MAFF303099
MTQDIETIGIADLFGPPSPGRDRADISIMAAASGIGFMAVRDFPGDAWLMPERRAQLLHIFALPDTEKQKLLRWNFDRTRKNVYRGWFSLQPTAVSYKEGIDMGPDIADAAGVSASDDPLCEPTPLPTEDALPGWRAAAADYYRAMETVSNALMRSIARGLDLPETIFDSYFEHGISTLRLIRYPLRDANAGIDISGPEFSVVHKGETRTIIGREHADSGFVTLLAQDGVEGLQAKNLAGEWIDVPPANSTLAVNFGQLLERWTGGRVRATRHRVIAPKTARFSIPFFYEPRVDAEIAPLPLSGAEPFEPFLYGDYLWEAATNFVEMAGIKHLRQPRRAKAS

SEQ ID NO: 34791 - protein, 616 aa, Ostreococcus tauri
MGLACVACETARGTAEHGWDLSRASFNPEFDARAVFIDGSDANANDDGRGVSGECAGDVCAMWLERARGLDANAIERILSQCETTESGMVRAVDVLRRSGALDEGNFPFAPTETDESEMTSEMSAYFVNSSHNTYLDGDQLFSRASVAAIAGALDRGCRVIELDVYDGKKRGDKPRPIVTHGGTAVRPMYFEDAIKVIAERAHVASEYPVIVTLENHASKETRAEMSRILRSTLGDKLWAPKSAVAGNQLKRWPSPLELKGRVIVRDKIKHKQDELQRRRDQRRGLCGLCGTKKQSKQRKVLPKSLNVRKNDKVCAMQSIIEFPRSSTGVFDEGAVSSSSSDSEGEQDDEDLKRIVSVPNVKFRSFHEARDVPRFSCSWSERKLKLKIEKESSKDIIEFTNAHLLRTYPAGHRIFSNNYDPSEAWDVGASFVALNFQALDRYVWANRAKFRVNGNCGYVKKPAYLLDPTIERPSKPRRLQVKVFAGIGWDNFKDADRFSPPDSLIRITTLGCLADRTKPGKSNRTSVYSKARAGPEAQPVWNDTFELAIFEPELALMQIQALDKDGNGDELLAHYDFPISKLREGVRIVPMLNRDDEFIHDKISCAGVLMSFKWLD

SEQ ID NO: 34792 - protein, 111 aa, Glycine max
  misc_feature (68)..(68): Xaa can be any naturally occurring amino acid
  misc_feature (88)..(88): Xaa can be any naturally occurring amino acid
  misc_feature (101)..(101): Xaa can be any naturally occurring amino acid
RGTVAPGSFFGSPIALSMRGQIDPWRKPKKLGGTWMFSEYMLAYGRDLLAMHAGTVEPWARALGVDNXTATGGSLWAALCLLKRRGSXVMACRSAIDLPYXKGRRRLDGNP

SEQ ID NO: 34793 - protein, 118 aa, Ustilago maydis 521
MIAHCSDLTSPNSPPKDDPISVEELKQYDGTDESKPVYVAVKGTVFDVSPKREMYSPGKGYHIFAGKDGSRGLGMSSLKPEDAVADYSTLDDKQLKVLNDWHSYYTKRYNIVGKVAQS

SEQ ID NO: 34794 - protein, 80 aa, Glycine max
VGPVCESADFLGKDRELPTPDKGAGLVVHDAGAYCMSMASTYNLKMRPAEYWVEDDGSIVKIRHGETFDDYMKFFDGLPA

SEQ ID NO: 34795 - protein, 315 aa, Photorhabdus luminescens subsp. laumondii TTO1
MTNNIVSPVNKDWIVFLDGEYLNFSNATFLANTQALNYGTGTFEGIRAYWDQDNNQLNLFRVHEHYERLIQSAKTLKIELPYTSQELTDITKNIIIKNGFKQDIYIRPLVLKKSLMPGEKFGVKLSGVNSTLCINALPMGAYAKKAEFTCLISKWRRVSNAAIPSSAKITGTYVNSALAHEDAKENGFDDAIMLNEQGMCAEASTSNVFIVKDNCVITPSLSAGILNGITRQSVFDICQFRNIPCIESEIQQKDLYEADGCFLTGTGLEISIVSQIDDVSYRQKEDSIANVIAQDYQEIIRGRVDKFSHWLNPVY

SEQ ID NO: 34796 - protein, 557 aa, Solanum tuberosum
MTTTAVANHPSIFTHRSPLPSPSSSSSSPSFLFLNRTNFIPYFSTSKRNSVNCNGWRTRCSVAKDYTVPPSEVDGNQFPELDCVVVGAGISGLCIAKVISANYPNLMVTEARDRAGGNITTVERDGYLWEEGPNSFQPSDPMLTMAVDCGLKDDLVLGDPDAPRFVLWKDKLRPVPGKLTDLPFFDLMSIPGKLRAGFGAIGLRPSPPGYEESVEQFVRRNLGAEVFERLIEPFCSGVYAGDPSKLIMKAAFGKVWKLEQTGGSIIGGTFKAIKERSSNPKPPRDPRLPTPKGQTVGSFRKGLRMLPDAICERLGSKVKLSWKLSSITKSEKGGYLLTYETPEGVVSLRSRSIVMTVPSYVASNILRPLSVAAADALSSFYYPPVAAVTISYPQEAIRDERLVDGELKGFGQLHPRSQGVETLGTIYSSSLFPNRAPNGRVLLLNYIGGATNTEIVSKTESQLVEAVDRDLRKMLIKPKAQDPFVTGVRVWPQAIPQFLVGHLDTLGTAKTALSDNGLDGLFLGGNYVSGVALGRCVEGAYEIASEVTGFLSQYAYK

SEQ ID NO: 34797 - protein, 126 aa, Bordetella pertussis Tohama I
MNLIAILEQEEIARLTGGNAVTEFAPGDTVVVSVNVVEGTRKRVQAFEGVVIAKRNRGLNSSFIVRKISSGEAVERTFQLYSPQIAGIEVKRRGDVRRAKLYYLRSRSGKSARIKEKLVLKKAKSA

SEQ ID NO: 34798 - protein, 956 aa, Musa acuminata
MLTTEMMGVAALRVIASKLAKKWDFSVDPCSQTNGWVVPGRSDMPVFTDNVTCDCNRTSNVCHVTSIKLKGLNLTGTLPAEFSKLPFLTDIDLTWNYLNGTIPAAWASLPLVHLSLLGNRVSGPIPEEFAKMITLEELVLEGNQLQGPIPAALGKLANLKRFLANGNNLSGELPESLGNLKNLIMFLIDGNPISGKIPSFIGNWTQLQRLDMQGTAMEGPFPPRFLALKNLKELRVSDLKGGIGSFPQLQNMRNMTKLVLRNLSISGELPDYIGEMKALNSLDVSFNNLSGPIPGTYAALTSSLNFMYLSNNNLNGKIPDWILNSAQKFDISYNSFTGSPAPAICQRGKGCWCNLTAPFYRTLSCLRRNLPCSGESRNYNLFINCGGPKMRIDDIEYEGDILDLGTSEFYDSESGKWAYSSTGDFVDNQNPKFITANTTALDITKPELYMTARLSPLSLKYYGRCLYKGNYTVNLHFAEIMFTDDETYSSNGRRLFDVSIQGRKVLKDFNIAKEANGTGKEIIKSFTVMVDGTLEIHFYWAGKGTNSVPLRGVYGPLISAISVTPNFKIDTGENKLTVGTILAIVAAACIIVLLILCLIFLYIRRKNSKNNELRGLELQTGQFSLRHIKAATKNFHPANKIGEGGFGPVYKGVLPDGSEIAVKQLSSKSKQGNREFVNEIGVISALQHPNLVKLYGCCIEGNQLLLVYEYMENNSLARGLHGRWKICLGIARGLAYLHEESRLKIVHRDIKATNILLDKDLNAKISDFGLAKLNEEENTHISTRIAGTLGYMAPEYAMRGYLTDKADVYSFGVVALEIVSGMSNTKYRPEEDCVYLLDWAYVCHEKGNLLELVDPALDSSFSTEEALQMLKLALLCTNISPTLRPNMSAVVSMLEGKTPIELLSVQSSITKGDDLRFKAFEKLSRDSQTEINSTDWPWPDSSVSAQSTKGDTSLLH

SEQ ID NO: 34799 - protein, 384 aa, Musa acuminata
MDSVSPVTLDLNKEEGHCSNGAVVFDTSFLRRQAKIPESFVWPRNERPHPLEELEVPVVDLRGLFEGDEASISRAAEASRAACVRHGFFQVINHKVDAKVSGDALDAAGDFFKLPLSTKLRARRQPGSAWGYVGAHADRFASKLPWKETLTFGYDYGERGDGVVDYFTSKLGEGFEPMGRVYRRYCEAMKELSLSIMELLGISLGVGREYYRQFFEDGSSIMRCNSYPPCQEPELALGTGPHCDPTALTILLQDHVGGLQVFTEGKWQAVRPVRSALVINIGDTFMALSNGRYKSCLHRAVVNSERERLSLAFFVCPRGDRVVRPPRELLLLLEEEEEEEEEAVPRAFPDFTWTELLEFTQTHYRADTTTLQNFARRRFLASSP

SEQ ID NO: 34800 - protein, 709 aa, Sulfitobacter sp. EE-36
MARRKSSAAGDALWALIFAGWLVLIRAIPFPPYKEACTVDLNALAKAHPAHWSKATAIRALTLDAVAAANSGHSGMPMGMADVATVLFEKHLKFDASNPLWPDRDRFILSAGHGSMLIYSLLHLTGYEQFPLEEIKNFRQMGARTAGHPENFLADAIETTTGPLGQGIANSVGFAMAEEIQRAQYGKKIVDHFTYVIAGDGCLMEGISHEAIALAGRHKLSKLIVMWDNNDITIDGPVSLSDKVDQVARFKAADWHVIEIDGHNPDEIDAALTEARKSDLPTMIACKTHIALGHAAQDTSKGHGALTDADQMAAAKAAYGWTTGPFEVPADVKSAWEEIGKRGADDRRAWEERFDAMSRTKREEFNRALAGDAPKKLSATIKAFKKQTSENAPKLATRASSEKTLEVLNPLYTETVGGSADLTGSNNTKTADLGVFDVDNRGGRYVYWGIREHGMAAAMNGMALHGGIRPYGGTFMCFTDYARPAMRLAALMQVPSVFVMTHDSIGLGEDGPTHQPVEHLAISRATPNTYVFRPADTVETAEAWEIALSSKKTPSVLSLTRQGLPTVRLEHKNKNLTEQGAYVLADAEGKRQVILIATGSEVEIALKARDLLQAEGIGTRVVSMPCMELFAAQDEAYRRRVLPAGPVRVGVEAAVRQGWDRWLTGERGKWNKADFVGMDRFGASAPAEELFEKFDITPQNVADKAKALL

SEQ ID NO: 34801 - protein, 137 aa, Brassica napus
  misc_feature (116)..(116): Xaa can be any naturally occurring amino acid
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAXKRVTIMPKDIQLARRIRGERA

SEQ ID NO: 34802 - protein, 548 aa, Glycine max
  misc_feature (116)..(116): Xaa can be any naturally occurring amino acid
  misc_feature (251)..(251): Xaa can be any naturally occurring amino acid
MENSDTTLTSSSLPPPPPVSAEEPEPKKLKMSTTTSDDEETGTKKRYKRRKVAIFFAYCGVGYQGMQKNPGAKTIEGDLEEALYVSGAVPEQDRGVPKRYDWARSARTDKGVSAVXGQVVSGRFYIDPPGLVDRLNSNLPSQIRIFGYKRVTASFNAKKFCDRRRYVYLIPVFALDPSCHRDRETVMASLGSGNELVKCLECSERGRKVIGLVGNRKKNLELEAVDVEAGISSNRDSGVTEDVEVSLSKGXIIINEEYGNDNKGGMNSKTGLETMVPVQEEGTPFNGESVNNSDILEDEKVNGEDKLTNGSGFCYGEKERERFNKILKYFVGTHNFHNFTTRTKAEDPAARRYIISLNANTTLVVEGMEFVKCEVVGQSFMLHQIRKMIGMAVAIMRNCAPESLIDKALQQDVNINVPTAPEVGLYLDECFFTSYNQKWKDHEELSMKAYEKEADEFKMKYIYSHIASTEQKEGTVALWLHSLNHRNYPDLHVINEEAIPNNKSADPKEAITDNKSADPEDATTKNKGADLKEAITDNKSADPEVVTE

SEQ ID NO: 34803 - protein, 120 aa, Sulfitobacter sp. EE-36
MTDAKTQIQETITANNVVLFMKGNKTMPQCGFSSRVAGVLNYMNVDYTDVNVLADEELRQGIKDFSDWPTIPQLYVKGEFVGGCDIITEMMLSGELDTLLEDNGVAFDKDAADKIREANG

SEQ ID NO: 34804 - protein, 186 aa, Brassica napus
  misc_feature (14)..(14): Xaa can be any naturally occurring amino acid
  misc_feature (24)..(24): Xaa can be any naturally occurring amino acid
MASIVEKQLFKSLXSFFLLVLLFXTVYSSRKTLDQKKPCKHFSFYFHDILYDGDNVANATSAAIVSPPGLGNFKFGKFVIFDGPITMDKNYLSEPLARAQGFYFYDMKTDYNAWFCYTLVFNSTEHKGTLNIMGADLMMEPTRDLSVVGGTGDFFMARGIATFVTDIFQGAKYFRVKMDIKLYECY

SEQ ID NO: 34805 - protein, 335 aa, Picrophilus torridus DSM 9790
MVDVALIPGDGIGREIMPGVAAAISSISDINFVTFDISSERYIKTGIIIKDDELEELKNYRAILFGAIGDPRVRPGIMEQGVILRLRRELELYMNIRPVRSFDDKIKITILRENTQDFYTDISGIIPGKRSFNVNGTRIEIDGSSCDEVYYTMGMLSYRYLKKFFNKAFSICDSTVTVTDKANAVKMYNLWRSTAMEAAIEKNINISFEYADALAYNMILNPKKYRYIIAPNLYGDIISDMGAALVGGLGYAPSANIGDKNALFEPVHGSAPDIAGRDMANPAASIMAGSMLLEYLGYRDESRIINDMVRNLYINGVFNSERTSKIIERFMTITK

SEQ ID NO: 34806 - protein, 197 aa, Brassica napus
MADGEDIQPLVCDNGTGMVKAGFAGDDAPRAVFPSIVGRPRHTGVMVGMGQKDAYVGDEAQSKRGILTLKYPIEHGIGNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDAFMKILTE

SEQ ID NO: 34807 - protein, 250 aa, Oryza sativa
AAAISPISMAAPPQPQPEPEPAAGGAGLEALEGLALDTVIAKAGARQAAALACASTRLRDAAGDDALWRRFCADDLALHAPLAPDGRALPSFKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYHDQLYVGTINLQDGEMLPCVPKSLIRPTNTDMP

SEQ ID NO: 34808 - protein, 441 aa, Phaeodactylum tricornutum
MKFVQAAIFALAASASTTAAFAPAKTFGVRSFAPVSLIELEAKASIEDLSDAELKGKKVLVRCDVNVPLDGKKITDDTRIRSSIPTIEYLKNKGAIVSVCSHLGRPKDGPEDKFSLGPCAERMGELLGQTVTLAPDCIGEEVAKIVNDAKEGDVIMLENTRFYKEETKNDPEFVEKLAAPFDLYVNDAFGTAHRAHASTEGVTKFLKPSVGGFLLAKELEYLDGAISNGKKPMAAIVGGSKVSSKITVLEALLDKCDKVIIGGGMVFTFLKAKGFNVGTSLVEDDFVDTAKEVLAKAEKLGKEILLPIDIVIADKFDAEAETKVVSAEEIPDGWMGLDNGPETTAQQKEALSDCKTIIMNGPMGVFEFEKFAKGTFDLVNILADLSKDKGAITIIGGGDSVAATEQSGRAGDMSHISTGGGASLELLEGKVLPGVAALNDK

SEQ ID NO: 34809 - protein, 490 aa, Sinorhizobium meliloti 1021
MANSAEETVSPTRPEDEKLGIGANLAYGLQHVLTMYGGIVAVPLILGQAAGLGSGDIGLLITASLFAGGLATILQTMGLPFFGSQLPLVQGVSFSGVATMIAISGNGGLQSVLGAVIAASLIGLLITPIFSRITRFFPPLVTGIVITTIGLTLMPVAARWAMGGNSSAPDFGSPANIQLAAVTLVIVLLLSKLGSAAISRLSILLALIIGTVIAYFAGMADFSQVTEGPFFALPLVFHFGYPTFEVAAIASMFIVIMVTLVETSADILAVGEIIETKVDSRRLGDGLRADMLSSLLAPIFGSFTQSAFAQNVGLVAVTGVKSRYVVATGGLFLVTLGLLPVMGRIVAAVPSSVLGGAGIVLFGTVAASGIRTLSKVDYANNMNLVIVATSIGFGMIPIASPTFYEHFPAWVETIFHSGISSAALMAISLNLIFNHMTAGNSDQQSVFVAGTERTLRYQDIARLHDGDYFLNGKLYDANGTEVPVLAAEAH

SEQ ID NO: 34810 - protein, 494 aa, Sinorhizobium meliloti 1021
MNDASSIHPVDERLPIGRLATLGIQHVLVMYGGAVAVPLIVGRALQLSPEDVAFLISADLFVCGIVTIIQSLGLTRGIGIRLPVMMGVTFAAVGPMVSMAAMTPGIDGARTIFGAIIGAGLVALLIAPIMGRLLKFFPPVVTGTIILVIGVTLMRVGVNWIFGNPFGPTAPKLVDPAHAQWLAGLKQLAATGGPAVPDGLVLGATVPNPIYAEPGHVALAAFVLVSILVVARFGKGLISNIAVLIGIVIGCVAAALLGMMHFDRVASAGWFAVVTPLRFGMPIFDPVLIATMSLVMIVVMIESTGMFLALGEMTNREVKQQQLTAGLRVDGLGTIIGGLFNTFPYTSFSQNVGLVGVTGVKSRYVCVMGGVIMILLGVIPKMGALVEAVPTFVLGGAGLVMFGMVAATGVRILSTVDFKSSRNNLFVVAVSVGFGLIPMIAPNFLMWMPHAIHPIIESGIVLAAVSAVVLNAFFNGLSIERSACVEAARLADGH

SEQ ID NO: 34811 - protein, 449 aa, Phaeodactylum tricornutum
MLFRMLTSTALRRSPVTTSLTCCCKANAFAVRIRSFHAAPVIQAKMTVEQLAQQVHMKGTNVLVRVDLNAPLATDDVTVTDDTRLRAIVPTTKFLLEQGANVILCSHFGRPKGEIIETGKNGRLNPVVKPLEVLLGQTITKLDDCMGPDVEAATKNLGEGKVVLLENTRFYSGETKNDPELAAGLGKLADYFVMDAFGTAHRAHSSTAGVTTHMKFNAAGKLMEKELQYLQGAVEEPKRPMMAIVGGAKVSTKIPVIESLLDKCDVILIGGGMIFTFYKALGYDIGASLVEDDIVELASSLMKKAEEKGVKLILPVDVVLADKFDNDANSAVAKVTDISGDWMGLDIGPETIDLFRSEIAEANTIVWNGPMGVFEFSNFAAGTNDVAQMLAQATAERGAVTIIGGGDSVAAVNKAGLGDKVSHISTGGGASLELLEGKVLPGVAALTEV

SEQ ID NO: 34812 - protein, 485 aa, Arabidopsis thaliana
MGGSDENRHGVIGPMNRQQGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNEVTFSVLFLYHYDHSSFKIETFSIILQCRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMVKSFTKSCPDYNHGCSALYVDDHYCVLQEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 34813 - protein, 698 aa, Oryza sativa (japonica cultivar-group)
MDAPPLRLRLAVAFLSLLLTVSASAATASGGGGGFNVSFDSAALAFSDLTLLGDSFLRNGSVGLTRDTAVPSSSAGSVLCSRAVAFGGGGGSAASFAARFSFVIAEQNAGSTGGDGIAFFISPDHATLGATGGYLGLFNSSSSAAKTNASIVAVEFDTMLNDEFGDPSDNHVGLDLGSPVSVNAVDLAAFGVVLNSGNLTTAWIDYHGADHLLQVSLSYSAAKPAKPVLSVAVDLSPYLRDAMYVGFSASTEGSTQQHTIKEWTFQTFGFPSATNSSSFSNTTGNASAQTVPGEAAAGGVASRKKRFGLALGILGPVALAVSFVFFAWVSIRKLIELTSRKNAGFLPELVKGPRKFSYKELSAATRGFHASRVIGKGAFGTVYKAAMPGTATASAVSYAVKRSTQAHQSRNEFVAELSVIACLRHKNLVQLEGWCDDKGELLLVYEYMPNGSLDKALYGEPCTLSWPERYTVASGIASVLSYLHQECEQRVIHRDIKTSNILLDGNLSPRLGDFGLARLMDHNKSPVSTLTAGTMGYLAPEYLQSGKATEQTDVFSYGVVVLEVCCGRRPIDKDDGGGKNVNLVDWVWRLHGEDRLIDAADPRLAGGFDRDEMLRLLLVGLSCANPNCDERPAMRRVVQILNREAEPVPVPRKKPLLVFSSSASIKLQEIAFACGDDVRGGLPAAATSPRSEGGDIER

SEQ ID NO: 34814 - protein, 560 aa, Photobacterium sp. SKA34
MDKVWLSRYPNDVPAEINPDAYSSLVDMFEQSVRKYADQTAFINMGQVMTFRKLEERSRAFAAYLQNELKLQKGDRVAVMMPNLLQYPIALFGILRAGCVVVNVNPLYTPRELEHQLNDSGAKAIVIVSNFAHTLEAVVKNTGVKNVILTSLGDQLSRPKGTLVNFVVKYIKKMVPKYYLPHATSMRIALRKGRRMQYVKPFIIGDDMAFLQYTGGTTGVAKGAILTHHNMVSNVMQAKGAYGPVLTEGRELIVTALPLYHVFALTVNCLLLMEMGGQNLLITNPRDIPTFVKELQRYQFTAITGVNTLFNALINNEDFQELDFSNLRLSVGGGMAVQRAVAEKWQKITGNYLLEGYGLTECSPLVAAYPYDLTQYNGSIGLPVPSTEVRMVDDEGNVVGIDEVGELQVRGPQVMKGYWQRPEATKEVLTEDGWLSTGDIVKFDDEGFLHIVDRKKDMILVSGFNVYPNEIEDVVALNDKVLEVAAIGQAHEVSGEVVKICVVKRDQSLTKDELIAHCRQHLTGYKIPKIVEFMDDLPKTNVGKILRRVLREESDKKAQQ

SEQ ID NO: 34815 - protein, 386 aa, Haemophilus influenzae R2846
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAINLFGIADKISYISTGGGAFLEFVEGKVLPAVEILEKRAKN

SEQ ID NO: 34816 - protein, 452 aa, Silicibacter sp. TM1040
MTDIKRKVLVIGAGPGGYVCAIRAGQLGLDTVIVDEARPGGTCLNIGCIPSKAMIHAADEFYKMTHAGAGPLGISAAGPTIDLEQTVAWKDGIVERLTGGVGGLLRKAGVKMISGRARFVDGKTVTVAGDEGEIQIRADYIVIATGSAPVELPFLPFGGAVMSSTEALSLTEVPESLAVVGGGYIGLELGTVFAKLGSKVTVVEAEDRILPLYDKALTRPVHKRLEELGVTVMTGTKAQSHEGGALQTDAGEIAAERVLVTVGRRPRTQGIGIDELSLTMNGPFIRIDKVCQTSMRGIYAIGDVTGEPMLAHRAMAQGEMVAEYLAGQAVEWDKRAIPAVCFTDPEIVTCGVLPGEVEGTKSAEFPFVANGRAMTTERDEGFIRVVWREADNAVLGLQGVGVGISELSSAFSLAIEMGACLEDIAATIHAHPTQSEGLQEACLKALGHALHI

SEQ ID NO: 34817 - protein, 337 aa, Silicibacter sp. TM1040
MAQMTMIEALRDAHDVAMEKDDRVVVYGEDVGYFGGVFRVTAGLQAKYGKSRCFDTPINEAGIVGTAIGMAAYGLRPVIEIQFADYVYPAIDQIVSEAARLRHRSAGDFTCPIVIRMPTGGGIFGGQTHSQSPEAFFTHSSGLKTVVPSNPSDAKGLLLAAIEDPDPVIFLEPKRLYNGPFDGYHDRPVTSWKKHPLGDVADGYNPIPLGKAAIRRKGNDVTVLAYGTMVYVAEAAAEESGVDAEVIDLRTLLPLDLETIVASVEKTGRCVIVHEATKTSGFGAELMSIVQENCFYSLEAPIIRVTGWDTPYPHAQEWNYFPGPERVGEALKKCMED

SEQ ID NO: 34818 - protein, 356 aa, Silicibacter sp. TM1040
MTLNLTEETAPEGYERLVFAQDPESGLQAFICVHSTVLGPAAGGCRMWNYATVDEARMDVLRLAEGMTSKNAMADLALGGGKSVIVGNPQSDKSPALLRAFGRAVQSLDGSYYTAEDVGISPDDMKIVAEETPYAVGLEDGAHGTGDPSPFTAQGVFQCLLVGAEVVFGTSDLSGRRVLVQGLGHVGMSLAEKLYGAGAELIVADINEAALQHAKTAFGATICDPAEIFETEMDIFAPCALGGVLTEATAQKLSAKLVCGAANNQLETPEVADALRARGIRYLPDYVVNAGGIISVAGEIHKAGTSYRTERLDGVAARIRTLVDLSDKTGRTTTAVADDMVADILAKASNTARGAA

SEQ ID NO: 34819 - protein, 678 aa, Oryza sativa
RGGVHLKSLVLSLLSLPPMEPSRRLLLSDYDGAIVSPLPSPPPSSATPFRPGVAVVVGILTSVFSITFLLLLYAKHCKRNAAESSGPYGSGGAFGSSGGGGAGERRNSGVDRAVVESLPVFRFGALRGQKAGLECAVCLGRFEPTEALRLLPKCRHGFHVECVDTWLDAHSTCPLCRSRVDPEDVLLLPEPPKPSTTGPPDPPETKVAAAAAAATAKDKEASLAPAAPAPSPAFRGFFSGRHSTGSVRAPGRVGPASRRSADLVGGDGGAVVGCFEAAKVRKDRVLLMEPAAAVAEPDPEAYDRRFGHRILVSTAGGCEDETAPAAKQRWSEVRPSDLMFVRSEMLVTEAGRVQLETITSRALFLSTIGCYYYPMVNMHVSRRQSGDVIVVRVSLIETWRTTDDDVLSRSSLLGGPDEHDVREHLLDVGGVGEEGAAAAAGPKIRVRGLTRRSEARGEEILRGVDLDVPRGVVVGVIGPSGSGKSTLLRALNRLWEPAPGAVLLDGVDICGIDVLALRRKVGMLFQLPAMFDGTVADNVRYGPQLQGKKLTDAEVQSLLSLADLDPALCSKPASELSVGQAQRVALARTLANDPEVLLLDEPTSALDPISTQNIEEAIVRLKKTRGLTTVMVSHSVKQIQRIADLVCLLVAGEVVEVLPPSELSEAKHPMARRFLELS

SEQ ID NO: 34820 - protein, 712 aa, Zea mays
QQSESSQFWRTSLTLPPSVQQRRFVAHPHRSHSGRVGADAPAAPWGDPPGLLLRICLFLCLSLRPRLASSEPDADKAALLAFLSGVGRGATARARINWPTTHLACSADGPGPGWTGVTCSADGARVVALHLPGLGLSGAVPPGTLGRLTALQLLSLRSNDLSGPLPADLLRLPALEGLHLHRNAFSGALPAALAGLTALQVLDLSFNAFDGAVPGALANLTRLVALDLSNNSLSGRVPDLGLPALRFLNLSNNRLDGTVPASLLRFPDAAFAGNSLTRPAPAQAPPVVVAPPPGLAAPPPARRRPRLSEAAILAIAVGGCVLGFAVAALLLLAFCNSSREGRDEETVGGGAAAGKGGEKKGRESPESKAVIGKAGDGNRMVFFEAPSLAFDLEDLLRASAEVLGKGAFGTAYRAVLEDATTVVVKRLKEVNAGRRDFEQQMELLGRIRHDNVVELRAYYYSKDEKLLVYDYYSRGSVSNMLHGKRGEDRTPLDWETRLKIALGAARGVAHIHTENNGRFVHGNIKASNVFINKHERGCVSDHGLASLMNPVTVRSRSLGYCAPEVADTRKASQSSDVYSFGVFVLELLTGKSPVQITGGNGGDVVHLVRWVQSVVREEWTAEVFDGELLRYPNIEEEMVEMLQVAMACVSRSPERRPRMADVVRTIEEVRRSGSGTATGTGTRPSTEASTPATAAEAAQSRAEEGGSSAVAQ

SEQ ID NO: 34821 - protein, 219 aa, Oryza sativa (japonica cultivar-group)
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 34822 - protein, 145 aa, Brassica napus
MGFFGRLFGSKKQDSSTNRRRWSFTTRSSKPASSSSSKRRSYPTEAPSVNEEESGDKHAIAVAAATAAVAEAALAAAHAAAEVVRLTSGTGGRNGGGSNRRWALEYLAAVKIQSAFRGYLARRALRALKALVKLQALVRGHIVRK

SEQ ID NO: 34823 - protein, 211 aa, Haemophilus influenzae R2846
MRNYIKIGVAGPVGAGKTALIEKLTREIASKYSVAVITNDIYTQEDAEFLTKNSLLPPERIMGVETGGCPHTAIREDASMNLEAVDEMVARFPDVEIVFIESGGDNLSATFSPDLADVTIFVIDVAQGEKIPRKGGPGITRSDLLVINKTDLAPFVGADLSVMERDACRMRNGQPFIFTNLMKKENLDGVIGWIEKYALLKNVEEPASLIR

SEQ ID NO: 34824 - protein, 334 aa, Oryza sativa
MSASIGINGFGRIGRIVLRAALEKGVNVVAINDPFIPLDYMVYMFKYDSTHGRFKGDIHHANGFLYVNGHQISVFTEKDPTQIPWGKSGAEYVVEATGVFTTIDKCQAHITGGAKKVIITAPSADAPMFVCGVNEKTYNPSINILSNASCTTNCLAPLAKVINDKFGIVEGLMTTVHSYTATQKTVDGPSNKDWRGGRTAATNIIPSSTGAAKAVGKVIPDLNGKLTGMAFRVPTADVSVVDLTVRLAKPAKYDEIKAAVKAASEGELKGILAYTEDEVVSSDFIGDHHSSIFDAKAGISLNDNFVKLVSWYDNEFGYSCRVIDLIKHVHSVSH

SEQ ID NO: 34825 - protein, 347 aa, Staphylococcus epidermidis ATCC 12228
MSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRPTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSKIFKLLKEKYL

SEQ ID NO: 34826 - protein, 554 aa, Sulfitobacter sp. EE-36
MYSYTEFDDAFIAERNAQFRAQVERRIDGSLTEDEFKPLRLMNGLYLQLHAYMLRVAIPYGTLSSRQMHKLADIAAKWDKGYGHFTTRQNIQYNWPQLRDVPDMLDALAEVNMHAIQTSGNTIRNVTADHFAGAAADEIADPRPVAELIRQWSTDHPEFQFLPRKFKVAVSGAPHDRAVIKAHDIGLQIVEKDGEIGYQVIVGGGLGRTPMIGKVLYDFVSSEDLLPTLEAIVSVYNLLGRRDNKYKARIKITVHENGIDDIRARVDARYALIRPQFTGVDQQMLSRIEADFASPTFKTAPTDAYTASYDSDPVFKSWADTNLTDHRDPSYAIVSISLKAHGKTPGDATAEQMHRMAELAAEYGHDELRISHEQNVILPHVHRGDLPALHAALKEVGLATANIGLISDIIACPGMDYCALATARSIPIAQEIATRFDELKLEHDVGPLKIKISGCINACGHHHVGHIGILGLDRAGVENYQITLGGDGTENAAIGERAGPGFSADDIIPAIERLVKGYLDLRSDAGETFLQTYRRLGLAPFKAVLYPEAQANAA

SEQ ID NO: 34827 - protein, 112 aa, Agrobacterium tumefaciens str. C58
MQEHPMSAFSLSDLERIVAKRAAASPDESWTAKLVAAGQERAAKKLGEEAVEAVIAAIAQDRDGLKNEAADLLYHLLVVLKIADIPLSDVFAELERRTGQTGLAEKAARPTP

SEQ ID NO: 34828 - protein, 1007 aa, Ustilago maydis 521
MSREESFVRALTERLKSEDSLRWAEPTPMPAHEIVVSAVNRVGVPIIRDYLIEIAVMAVGATSGVSGLREFCQLAALILLFDCIFLFAFYVSILTVMVEVHRIKVKRGVRKPKVSAELCLDSDSAPASPISDSSTSRDQSPSPNSRPFWKKVFSVILGSARSEKRRKSENPLGRLKLLLVASFLVLHSFNLISTLTRQSAITRHHATYEPSPYQIVANQSPIFAPAASSAIAPLLAQLSQSQPDDLDLVARISEPIILVLLESNEVVSSSRSTLANAALNASGVYAQATSTGVRPVPVGRGSSSLAVLDSLMSGWTVIVGDPVISKWMSLALGISIFLNAYLLKGIATGNAALSEGNAAGAAAYAAARFIGAHLDSEAKAIEEHSERNRRRWSARPENGKPGVQTRGHSADGISDYHNRLAQISATQASVPLSKLTRDNDKLASKPTSMTGAAVNAVPADAIKPDAMDAVKKHDVAPSSDADGAVATPGQQGQQICLQDATYVTPDGETVVRPLEELVEIYAGGAGVFFLTDEEIITLSQNGKIAAYALEKVLQDHERAVRVRRALVSRASATQTLETSLLPHRDYDYGKVMGACCENVVGYMPIPLGIAGPLNIDGQFMPIPMATTEGTLVASTSRGCKALNAGGGVTTVLTQDAMTRGPALEFPSVVQAAKAKRWIDSQEGAQTIKAAFDSTSRFARLSSLRCVLAGRTLYVRFATSTGDAMGMNMISKGVEKALGLMTEQYFPEMKVLSLSGNYCTDKKPAAINWIEGRGKSVVAEAVVPGNVVRSVLKCTVRDLVNLNTKKNLIGSAMAGSVGGFNAHAANILTAIYLATGQDPAQNVESSNCITLMEAINDDEDLLITVSMPSIEVGTVGGGTVLPPQRSMLEMMGIAGAHSTTPGANAQRLARIIAASVMAGELSLMGALCAGHLIQAHMKHNRSVPSTPGTMTPLPRPETPKHFAASMTPLVAPSVGQSTRGSPTGTRTMSMTNLSIPASDSTGRASSLT

SEQ ID NO: 34829 - protein, 431 aa, Thermotoga maritima MSB8
MRTNVRLLAYRLLRKYEKEKFISREDVDSVLSFLDDRDRRFFKELVWGVVRKEELLDWYINQLLKKKDIPPAVRVALRMGAYQLLFMNSVPDYAAVSETVKLVKNENFKKLVNAVLRRLRTVPEPKELHLVYSHPEWIVNYWRSFLPEEAVLRIMKWNQEPLPVMLRVNSLAATKEEVIKILAEEGTEAVPGKHAPFSLIVRKLGVPMNDSRVINDGLASVQGESSQLVPFFMELRPGLRVLDTCAAPGGKTTAIAELMKDQGKILAVDISREKIQLVEKHAKRLKLSSIETKIADAERLTEYVQDTFDRVLVDAPCTSLGTARNHPEVLRRVNKEDFEKFSEIQLRMVQQAWQLLEKGGILLYSTCTVTKEENTEVVKRFVYEQKDVEVIDIRDKMKEFEVEGIWDGYGFLMLPDETITPFYISVLRKMG

SEQ ID NO: 34830 - protein, 117 aa, Arabidopsis thaliana
  misc_feature (91)..(91): Xaa can be any naturally occurring amino acid
MYVKATYGTAYYVGGWIKVCKWVWGDDMGMIAPANNGSTSITFFGGRVNCIQVSPPIGKKKIETLSYLPDLTDSELANEVDYLIRNKRISXVEFQFQHGSVYREHSNSPRYYDGRYW

SEQ ID NO: 34831 - protein, 226 aa, Ustilago maydis 521
MSHNHTHTGACGQHHDHDDDSHVKPDQGDQDLLYSSIDRDRVIALNESVAGSAAATIKSWQHRTDPQPELISDTDDQLIIHIPFTSSVKLSTFLFRPSSQPLLTPSVIKLYKNLHDNSINFDDISSLPDTKIVTKLESIPTVQDTTQIINFPLHAVKWANTDAITIFVESSLGGQQSGIQFLGFKGKSSGYSRAAPQNIVYESAPQLKDHSKLGADSLSSTHGFGH

SEQ ID NO: 34832 - protein, 1053 aa, Ostreococcus tauri
MARARESSAIARASYARANALRAFYVGRGAPLAIACASVVDDGRVDARKGDARKGARKDAVDAEDVYYACATADGGVALARSRTTRGRKATTSRARELARADGDGEAMTAIAMDAKGSKVFCASRSGRLVRLDVVEIEGETVLRTIKAWNPHRSSPVLDMCVDSTGTLLCTGSADRTARVWDIERGFCTHAFRGRHGGAVTVTAFHPNTRVARAFTASDDGSVAMWSLTGGVSEGKKGKKGPSADGCLKFIADAHVSAVTTIKVDVDTNTLLTAGRDRIIRTYDLDTLTPRTTTAVHETIEDCVILGEKTAIVRDGKVKPPPSGRGVIFAVVGDGGRVRVWREGAAKHSLESGPLIAEKLKKGGGDENDDFEAAAATFTKCALSEGGDRLIGVSGDARLLTYKVNAETCALDIEREIVANTDEVIGLAFVPSANEVSVEEDTNEDEDETRELAIAPRQMAVVTNSPTVRVFDPTTMSCVGSLIGHTAVVLSVDATLTTDGTALIATGAKDHTVRLWDPNTQRCVAVGEGHVGAVSAVAFPPKSSRGVPFVISGGADRVLRVWDVEGALRSGDGELNALAATVAHDKSLNGVAVAPHLRLVATCSSDKTAKIWKMPDLVPLATLRGHRRGVWACAFSPTDRVLATAGGDKTVKIWSVDDRSGSDTSGACLRTLEGHTAAVLTVKFISRGTQLVTTGGDGLLNLWNVTVGSRVSSIDAHEDKAWALAVSSDGDWLSTGGTDASMSLWKDSTTSTTAEAAQKHALDVKQEQAFFNAERAGQLQKAIDLALTLERPASLLRVLTRLFEDDYANGDARLRECVEPLHGEKLKRVLTCIREWNTNGRTCHVAQHVLAAVFRTHSMNELSEVPDITQILRACRAYTERHRSRLERLYRGTFMVDTLLVRSGAIVDDEETQEQIARSYETIDDFGFMRSDSAPAPALAKAPEPSVEDPASDNEPEDVSEEDNDMEENTKDEDEDEDRFEDEEDNKSEDAEENDEDDEEDDKEEVVKDEEVVMGPPKKLARLNVIKRLSSNLEDRRKLMRDPSLDTRALVGI

SEQ ID NO: 34833 - protein, 117 aa, Oryza sativa (japonica cultivar-group)
MSLQMKFVPRFQDCWRPQSNASPPTGNGPGLRPAEQGVEEEAGRPLPKFGEWDVNDPASADGFTVIFNKARDEKKGGNGQDTDSPCKETRTERVESYAPKTNSKKWFCCVTSSPTQS

SEQ ID NO: 34834 - protein, 386 aa, Thermotoga maritima MSB8
MDILRKVAEIHGTPTYVYFEETLRKRSRLVKEVFEGVNLLPTFAVKANNNPVLLKILREEGFGMDVVTKGELLAAKLAGVPSHTVVWNGNGKSRDQMEHFLREDVRIVNVDSFEEMEIWRELNPEGVEYFIRVNPEVDAKTHPHISTGLKKHKFGIPLEDLDSFMERFRSMNIRGLHVHIGSQITRVEPFVEAFSKVVRASERYGFEEINIGGGWGINYSGEELDLSSYREKVVPDLKRFKRVIVEIGRYIVAPSGYLLLRVVLVKRRHNKAFVVVDGGMNVLIRPALYSAYHRIFVLGKQGKEMRADVVGPLCESGDVIAYDRELPEVEPGDIIAVENAGAYGYTMSNNYNSTTRPAEVLVRENGRISLIRRRETEMDIFKDVVM

SEQ ID NO: 34835 - protein, 413 aa, Rhodopirellula baltica SH 1
MKAFEATRIFFDQAADRLEIDPDLREALLMPQREVQVQVTIRLDDGRLANYIGFRVQHDHSRGPMKGGLRFHPEVDLDETRALASLMTWKTAVVDLPYGGAKGGIGIDPSKMSSAEIERLTRAFVDQIHDIVGPDTDIPAPDMGTDHQVMAWFRNQWEKYHGFHPAVITGKPVEEYGAKGREEATGRGVGTLTVKLTKRLGMDASKTRVAIQGFGNVGSHAAKFLHDAQFPIVAVSDITGTYYNADGLNIPELLRHKFAHPKGLLEGFERAEHLPLDALLKLDHVEVLIPAALGGVITQKNAQDINAKVIVEAANGPVDPDADAALHDRGVTILPDILANAGGVTVSYFEWVQNRQHYRWPLDRVRQELDHTMNEAFEKVWQMAAQHEVSLRTAAYMIGISRVRRATELAGLA

SEQ ID NO: 34836 - protein, 76 aa, Phyllostachys pubescens
GGNDMRTFYTLVMVDPDAPSPSDPNLREYLHWLVTDIPGTTGAAFGQEVVCYESPRPTMGIHRFVFVLFQQLGRQT

SEQ ID NO: 34837 - protein, 294 aa, Thermotoga maritima MSB8
MFRGVGTAIVTPFKNGELDLESYERLVRYQLENGVNALIVLGTTGESPTVNEDEREKLVSRTLEIVDGKIPVIVGAGTNSTEKTLKLVKQAEKLGANGVLVVTPYYNKPTQEGLYQHYKYISERTDLGIVVYNVPGRTGVNVLPETAARIAADLKNVVGIKEANPDIDQIDRTVSLTKQARSDFMVWSGNDDRTFYLLCAGGDGVISVVSNVAPKQMVELCAEYFSGNLEKSREVHRKLRPLMKALFVETNPIPVKAALNLMGFIENELRLPLVPASEKTVELLRNVLKESGLL

SEQ ID NO: 34838 - protein, 901 aa, Bordetella pertussis Tohama I
MSSFAQAGALAAANDEDTLETQEWLEALAAVLDREGPQRAHYLLERLIDEARRSGAHIPFSPNTAYVNTIPPGLEPAHPGNLELEARIRSYVRWNAMAMVVRANKHNPPDGGDLGGHIASFASLATMIGCGQNHFWHGETEEHGGDLVYFQGHTSPGMYGRAYLEGRLTEDQLNHFRQEVDGKGLSSYPHPKLMPDFWQFPTVSMGLGPLMAIYQARFLKYLHARGIADTSNRKVWVFCGDGEMDEPESLGAIALAAREKLDNLIFVINCNLQRLDGPVRGNGKIIQELEGDFRGSGWNVIKLIWGGYWDPLLAHDKEGILRRIMEEAVDGEYQAYKANDGKYVREHFFGKHPKLLEMVARMSDEDIWRLNRGGHDPHKVYAAFDAASKHAGQPTVILAKTIKGYGMGHVGQAKNPTHQQKKLELDSIREFRDRFGIPIPDDKLEELPYYKPAEDSPEMQYLHERRKALGGYLPKRRAKADEQLKAPALDAFKAVLEPTAEGREISTTQAFVRVLNQVLRDKDLGPRVVPILADESRTFGMEGLFRQIGIYAPEGQKYTPVDKDQVMYYKESADGQLLQEGINEAGAMSSWMAAATSYSTNNRIMVPFYIYYSMFGFQRVGDLAWAAGDMQARGFLLGGTAGRTTLNGEGLQHEDGHSHLLASTIPNCVSYDPTFAHELAVIIQHGLKRMVEDQENVYYYLTVMNENYPQPGLTAGDEEGIIRGMYKLKSHGKGKQRVQLMGSGTILCEVMAAQELLEADWGVASDIWSVTSFTELRRDGLDAERHNLLHPEGKQQVPYVTTQLAKSDGPIIASTDYMKLFADQIRPFVPKDRTYKVLGTDGFGRSDFRYKLREHFEVDRHFVVLASLRALADEGKIPAAKVAEAIKKYGINPNKANPHHA

SEQ ID NO: 34839 - protein, 553 aa, Bordetella pertussis Tohama I
MSNIVEIKVPDIGDFKEVEVIEVLVSAGDTIKAEQSLITVESDKASMEIPASAAGVVKSVKVKVGDKIAEGTVILEVEAAGEAAAAPKAEAPKAEAPKAEQAAETPKADAAKAEAPQAQAAQAEAPAAAGPIEVKVPDIGDFKEVEVIEVLVAEGDTIKAEQSLITVESDKASMEIPASAGGVVQSLKVKVGDKVAMGTVIAVVQGQGAAAAPAAAEPAAPASPVAPASAPAQRPAPAAALQDEDLKPGQLPHASPSVRKFARELGVNLSRVTGSAAKGRITADDVRAYVKQALSAGAPAGASGGGDGAALGLLPWPKIDFTKFGPIEAKPLSRIKKISGANLHRNWVMIPHVTNNDEADITDLEALRVALNKENEKSGVKVTMLAFLIKAVVAALKKFPEFNASLDGDNLVLKQYYHIGFAADTPNGLVVPVVRDADKKGILELARETSELARKAREGKASPAEMQGGCFSISSLGGIGGTHFTPIINAPEVAILGVSRSAHKPVWDGKQFVPRLTLPLSLSYDHRVIDGASAARFNAYLGQLLVDFRRIAL

SEQ ID NO: 34840 - protein, 87 aa, Pharus virescens
KPSQVVHQPRVDVGGNDLRTFYTLVMVDPDAPSPSDPNLREYLHWLVTDIPGTTGAAFGQEVMCYESPRPTMGIHRFVFVLFQQLGR

SEQ ID NO: 34841 - protein, 130 aa, Debaryomyces hansenii CBS767
MTRTSVLADALNSINNAEKTGKRQVLIRPSSKVIIKFLTVMQKHGYIGEFEYIDDHRSGKIVVQLNGRLNKCGVISPRFNVKVGDMERWTDNLLPARQFGYVILTTSAGIMDHEEARRKHVAGKILGFVY

SEQ ID NO: 34842 - protein, 450 aa, Silicibacter sp. TM1040
MTFEDLKEQIAAGQVDTVLVCIVDMQGRLMGKRFHAEAFLEMADGETHCCNYLLATDLAMATPDGYASTSWERGYGDYIMKPDLTTLRPVPWLEGTAMVLCDVIDHHTHAPVAHSPREMLKAQIARCEALGLSPVMATELEFFLFKGTHDEIAAGGFNKLEPISTYNEDYSIMQTSKEEPVMRPIRNHLRAMGLPIEGSKGEAEAGQEELNIKYDAALATADHHTIAKHGIKEIAHQQGFAATFLPKWHHERVGSAAHVHQSLWKDGGNAFFDESAPLGKSKLMDHYMAGLLKYAADYTYFMAPYINSYKRFAKGTFAPTQVVWSVDNRTAAFRLCGDGTKGVRVECRVPGSDMNPYLAQAAMLAAGLKGIEEKLELQDPFNGDAYAGDTQQHIPRSLLEARKALLGSEMLREAFGEDVITHYARAAEWEIEEFNRVVTDYEVARGFEKA

SEQ ID NO: 34843 - protein, 596 aa, Bordetella pertussis Tohama I
MSNIVEIKVPDIGDFKEVEVIEVLVAAGDTIKAEQSLITVESDKASMEIPASSAGVVKSVKVKVGDKVAEGTVILDVEAAGEAAAAPKAEAPKAEAPKAEAPKADAPKAPAAKASAPAAAAYSGSADLECDMLVLGAGPGGYSAAFRAADLGMDTVMVERYATLGGVCLNVGCIPSKALLHNAAVIDEARALAAHGISFGEPKVDLDKLRGYKDSVVAKLTGGLAGMARARKVRVVTGTGEFADPHHLTVTDGEGKKQTIRFKQAIIAAGSQSVKLPFLPDDERIVDSTGALQLRAIPKKMLIVGGGIIGLEMGTVYSTLGARLDVVEMLDGLMQGADRDLVKVWQKMNAPRFDNIMLKTKTVGAEARKDGIYVSFEGEGAPKEPQRYDLVLQAVGRSPNGKKIGAERAGVAVTERGFIEVDRQMRTNVPHIYAIGDVVGQPMLAHKAVHEGHVAAEAAHGEKSYFDARVIPSVAYTDPEVAWVGLTEDEAKKQGVKVEKGLFPWAASGRAIANGRDEGFTKLLFDAETHRIVGGGIVGTHAGDLISEIALAIEMGADMVDIGKTIHPHPTLGESVGMAAEVAEGVCTDLPPMRKK

SEQ ID NO: 34844 - protein, 87 aa, Puelia ciliata
KPSMVVHQPRVDVGGTDMRTFYTLVMVDPDAPSPSDPNLREYLHWLVTDIPGTTGAAFGQEVVCYESPRPTMGIHRFVFVLLQQLGR

SEQ ID NO: 34845 - protein, 177 aa, Brassica napus
  misc_feature (12)..(12): Xaa can be any naturally occurring amino acid
  misc_feature (101)..(101): Xaa can be any naturally occurring amino acid
  misc_feature (109)..(109): Xaa can be any naturally occurring amino acid
MSSDRLSDLPDXLLTQILSHLPIIDSVKTNVLSKRWESLWLTVSTLDLNDRDIAPPYKKLFATFIDSFLDHNFESPLLQSLKIKYDECNVNLFPISEWIAXAVDLRGIXHLDVEIRNPMHVVDFTPMTVYKSKTLVSLKLRHVRVRNLMEVSLPCLRLMSLENVCYGKDSAVRRLKT

SEQ ID NO: 34846 - protein, 575 aa, Oryza sativa (japonica cultivar-group)
MAATSAVTTTTGARWRSWAFANMGTLLAHFGSLSFFLGPLLAAYAPRRLLLTYFNLFLRRRARRLLNAVDPYITVDISECPAAARYYSRYDPVDARDTTYDEAKAYLSATCSSEARELHAEGAEEGDGLVISMRDGQDVADEFGGATMWWSSVAAEQQAAPPPPQGAAERRCLRLTFHMRHRRLVVDEYLPHVRREGREVLFSSRRRRLYTNNKMSEYASYSDEKAWSYVDFDHPTTFETLAMEPAKKKAIMDDLDAFRRSREFYRRTGKPWKRGYLLHGPPGTGKSTMVAAMANYLDYDIYDVELTVVGNNNNLRKLLIETTSKSIIVIEDIDCSLDITGDRAARRSRPPPSYRDGHDRRSSDVTLSGLLNFIDGLWSACGGERIVVFTTNHLDKLDPALIRRGRMDMHIEMSYCGFEAFKTLAKNYLDVDAHHLFDAVEELLRDVNLTPADVAECLMTARRSGSDDTSCLEICVDELKKRAEERAKEEAEAKAREEAEAKAMAEFEEKAKEKALAKAKAVVDAAAAAAAAAATTATAKPNATKEEEEEEEEEEEEEEEDSQEESSADTGQFTE

SEQ ID NO: 34847 - protein, 678 aa, Bordetella pertussis Tohama I
MSNPTAPKLALADAIRVLAMDAVQKANSGHPGAPMGMAEIAQALWLGNLRHNPADPAWANRDRFVLSNGHGSMLIYALLHLTGYDLPLEELKNFRQLHSRTPGHPEVGITPGVETTTGPLGQGLANAVGMALAEALLAAEFNRAGHTVVDHHTYVFLGDGCLMEGISHEACSLAGTLKLSKLVALYDDNGISIDGHVEHWFADDTATRFEGYGWNVIRGVDGHDVAAVDAAIKQARAQSEKPTLIVCRTVIGKGSPNMAGTHNVHGAPLGNDEIAATRAALGWSAGPFEVPQDIYAAWDSRPAGALAQAAWEDKFQAYAAQYPAEAAEFTRRMKGELPEGFAARFEAFLQATVAKGETVATRKASQFAIAELAGLLPEMLGGSADLTGSNFTDWKGVAPLRAGHHGVHFGRHINYGVREFGMAAIMNGIALHGGYLPFGGTFLTFSDYSRNAIRMAALMKQRVVHVFTHDSIGLGEDGPTHQSIEHAASLRLIPNLSVWRPCDTVETAAAWGAAVTRPASIGMDLHDGGPTALLLSRQNLPFVARDEATQKAIVRGGYVLRDAHDARAAIIATGSEVAIALAAQELLAADGIAVRVVSMPSTDVFDRQDAEWKREVLPAGMPRVAVEAGVTAFWHKYVGLEGAVVGIDRYGESAPAGALFKFFGLTAEKVAEAVKQVL

SEQ ID NO: 34848 - protein, 533 aa, Oryza sativa (japonica cultivar-group)
MAATAAETAAAATATAGGCRVVRWRRWTFASLGALLSNLGPVWFLIAPLLAAYAPRRLLLTYFNLVLRRRARRLLAAVDPYVTVDIPDPGAADAHQQYYHHRSRLGGRRAGDNAYEEVKAYLSAACSSEARELRAEAAAEGRGLVVSMRDGQDVADEFRGATMWWSSVDEEQQGGGARRRSQRLTFHQLHRRLVVDEYLPHVRRRGRELLFHNRRRRLYTNNKSLSYSSVYHKAWSYVNFDHPTTFETLAMEPAKKAAIMDDLDAFRRSGEFYRRAGKPWKRGYLLHGPPGTGKSTMIASMANYLDYDIYDVELTMVSDNNDLRKLLIETTSKSIVVIEDIDCSLDLTGDRATRRPGEIRGGGSMVTLSGLLNFIDGLWSASGGERVVVFTTNHVEKLDPALIRRGRMDMHIEMSYCRAAAFRTLAKNYLDVDAHHLFDAVDDILDKEDITPADVAECLMAAKRSSDSDVTSSLEFLVDELNKRAMENAKAVAEAKARAEAEAEAKAMADDDSEEDDDHYSDDYTDDDDYDDD

SEQ ID NO: 34849 - protein, 393 aa, Zygnema circumcarinatum
MLITKADPMVVSMGPHHPSMHGVLRLIVTLDGENVADCEPVLGYLHRGMEKIAESRTTLQYLPYVTRWDYLATMFTEAITVNAPERLANIQVPKRASYIRMIMLELSRIASHLLWLGPFMADIGAQTPFFYILREREMIYDLFEAATGMRMMHNYFRIGGVAVDLPYGWVDKCLDFCDYFLPKVNEYERLITRNPIFLKRVEGIGVIGREEAINWGLSGPMLRASGVQWDLRKVDRYECYHELDWQVEWQSGGDCFARYLVRIGEMRESVTIIQQALKAIPGGPYENLEARRMASMAQKNSQWNDFEYQFVSKKPSPTFKLPKQEHYVRVEAPKGELGVFLIGDDSMFPWRWKIRPPGFINLQILPQLLIGMKLADIMTILGSIDIIMGEVDR

SEQ ID NO: 34850 - protein, 181 aa, Zygnema circumcarinatum
MIKGLQNYSQQALRTARYIGQGFMVTLDHMNRTASTIQYPYEKLIPSERFRGRIHFEFDKCIACEVCVRVCPINLPVVDWEFQKSMKKKQLKSYSIDFGVCIFCGNCVEYCPTNCLSMTEEYELSAYDRHELNYDHVALGRLPFPAAKDPMVQPVYGIGYLEKGIVERTKGSKTITTLSTN

SEQ ID NO: 34851 - protein, 726 aa, Oryza sativa (japonica cultivar-group)
MQAAKRINLLAGGGRWGGGGARQERRCCIRRRRRGIRGGRRRRENGKAQLPVCLDAAVARRRGCGRGVDDEERRGVTQGRKRAWWWEEEGGGRRATRMTAIAPQWDPVGTRGTPTPTPTRRRGSRQEEQTWANGIRCKSGGGGGGVGEGAGKRGGIYPTGRERLSLDSSLLRFLQRRFLASTASSSESESWDHHWAHILTAPSTTSSHRVSHTVNALGSKVRRGELAMPAARRMRRAAAAAGVVERFAGMGSALAGVMFVWSMLSPLLPRQLFEHFVGRFLRRHARRLAGLVDPYLTVTISEHCGERMKLGDVYEQAKAYLSHRCARRARSLRAERAARDGGGDRFLLTMGDGEEVYDVFQGATVWWNSVSSGGGRRYESPWFGGGGVVYDDDRRAYRLLFHRRHRDLVVDSYLPHVCREGRAIMLRNRRRKLFTNAGGDRYRKSAWSYVAFEHPSTFDTLAMDPAKKKDIMDDLDAFRDGKDYYARIGKAWKRGYLLHGPPGTGKSTMIAAMANYLDYDIYDVELTSVATNTDLRRLFIETKGKSIIVIEDIDCSVDLTGKRKKRSPHAAAAAAEPVDAAKDESASKVTLSGLLNVIDGLWSACGGERIVVFTTNHVGKLDPALIRRGRMDKHIEMSYCCFETFKILAKNYLAIDAHHLFDDVRSLLQDARIKITPADVAEHLMRKCATAAADEAAACLASLVKALEKKAKGKETVEEEETVVDE

SEQ ID NO: 34852 - protein, 338 aa, Zygnema circumcarinatum
MLSCFIYNKKIMYMAEVLLFEALRQGLQEEMDRDPRVMVMGEDVGHYGGSYKVTKGFAERYGDLRLLDTPIAENSFTGMAIGAAMTGLRPVVEGMNMGFLLLAFNQIANNAGMLHYTSGGNFTIPIVIRGPGGVGRQLGAEHSQRLESYFQSVPGLQMVACSTPYNAKGLIKSAIRSDNPIILFEHVLLYNLKEDLAEEEYLVCLEKAEVVRPGNDITILTYSRMRHNVLQATKSLVYKGYDPEIIDIVSLKPFDLGTIGASVCKTHKVLIVEECMRTGGIGATLRAAIMEHFFDYLDAPILCLSSQDVPTPYSSPLEELTVIQPNQIIQVVEQLCEN

SEQ ID NO: 34853 - protein, 121 aa, Streptococcus pyogenes M1 GAS
MKSYPEPMGPYSTYTIEGHFLYTAGQLPLNPVTGQLSDGFEAQCRQVFVNLQSILAEQKLDLNHIYKLNVYLTDVTNVEILNHVMTDLFEEPYPVRTAVQVSALPLQALIEVEAVARVKQL

SEQ ID NO: 34854 - protein, 191 aa, Glycine max
MESNTPVIAKKELSIIHVALFMLRKGISKGKLMMHLNNMMLKRPGKAIANLMFHHNHGVSGNSLHFSAAREYEFSCSNTPNNFFAAIASSNKRHRHIPFFTCAHAPPTLDDDVATVNAVKGVLEMLNNETVVEASPAALPGFGRSPMVRQLIRVTDSPFPLVESQDDKDNQVDKAAEEFIKRFYKELRKQT

SEQ ID NO: 34855 - protein, 280 aa, Chromobacterium violaceum ATCC 12472
MNVRVVDYRAPDAAEQFTRSLHETGFGVLTNHPIPQDLVEKIYAEWLDFFNSEQKFDYAFSVEKQDGWFSPEVSETAKGATLKDIKEYFHIYPWGRVPPRLKADADRYYGVANQLAQELLSWVQQYTPADIAANYREPLSHMIEGSQQTLLRVLRYPPLTGEEPAGSLRAAAHGDINLLTILPAANEPGLQVQDKNGDWIDVPCDFGTLVVNIGDMLQEASAGYYPSTQHRVVNPTGEGAKKSRVSLPLFLHPRPDVVLSDRHTAGSYLDERLRELGVKM

SEQ ID NO: 34856 - protein, 421 aa, Bacillus halodurans C-125
MEDKDKRSGKTTDVLASTQTVIKKALDKLGYPDEMYELMKEPIRMLTVRIPVRMDDGSTKIFTGYRAQHNDAVGPTKGGVRFHPNVTEKEVKALSIWMSLKAGIVDLPYGGGKGGIVCDPRDMSFRELERLSRGYVRAISQIVGPTKDIPAPDVFTNSQIMAWMLDEYSRIREFDSPGFITGKPIVLGGSHGRESATAKGVTICIREAAKKKGIDLQDARVVIQGFGNAGSFLAKFMHDAGAKVIGISDAYGALHDPDGLDIDYLLDRRDSFGTVTKLFKNTISNEELLELDCDILVPAAIENQITEKNAHNIKAQIVVEAANGPTTIEATEILTNRDILLVPDVLASAGGVTVSYFEWVQNNQGYYWTEEEVEGKLEAVMVHAFDNIYKLAKGRKVDMRLAAYMVGVRKMAEASRFRGWV

SEQ ID NO: 34857 - protein, 658 aa, Xanthomonas oryzae pv. oryzae KACC10331
MEIMGGSPVRARLRADARCNAFALPANARTGTLRDLEHVVILMQENRSFDHYFGVLRGVRGFGDPRALQLRDGHPVWSQPAADGRRLLPFAFDSQTTCAPLIKSLDHSWKAGHGQDPARWAEYDAWVPYKGELTMGYFQRHDIPYYHALADAFTICDGYYCSLHGPTNPNRMYLFTGTSGQSMGNFGAQAVTNADDSNWTADMARDKPGYAALEWTTYAQHLQAAGVDWRVYQEYDNFGCNSLAYFSHYRDLHTDDERYQRARACVPGSTAENAVITQAEHLVAAIAADVQANRLPQVSWVIPPTAYCEHPEAPPAYGESLVARLIAALTANPEVWAKTALIINYDENDGFFDHVPAPLPALDARMGRSNVDTRGEVYDGLPIGLGIRVPMLVISPWTRGGWVNSQVFNHTSVLRLLERRFGVAEPNISPWRRAVSGDLTSVFDFRKPDDSALSALPSVDDYRARTAAVRDKPLPVPPTAATMPKQESGQRPARALPYALQVHARVHAATGLQLQFVNSGAAAAAFNVYSSAANGGPWYYTVLPGTQLDDAPVDATQNGAYAHAFAWAEWLFARIRGRGVAGFPSIGSAVGGRAAGWRRLGAGDRQCGAARMHLAAACAGLRRSNRAHVAAGRRSARDHSLRARRQRPLVRPCSRATG

SEQ ID NO: 34858 - protein, 249 aa, Sulfitobacter sp. EE-36
MRRKLAAGNWKMNGTLAGLDMLADVAAAMDSTRAEAVICPPAPYLLPAVTKAQGTPVGIGAQDCHAEPKGAFTGDISASMIKEVGATYVIIGHSERRDAYGETDADVSAKARAAWDAGLTAIICIGESEADRSAGTTLDVIAEQLAGSLPDGCTGENTVVAYEPIWAIGTGKIPTLDQIVEVHDFIRATLAERFGTDVSDALRLLYGGSVKPDNAAEIFKVDNVDGALIGGASLRAADFVPIFQALAAT

SEQ ID NO: 34859 - protein, 344 aa, Xanthomonas oryzae pv. oryzae KACC10331
MAQTMKALVKRETNKGIWLEQVPVPTPGPNEVLIKLEKTAICGTDLHIYLWDEWSQRTIKPGLTIGHEFVGRVAELGSAVTGYQVGQRVSAEGHIVCGHCRNCRGGRPHLCPNTMGIGVNVNGAFAEYMVMPASNLWPIPDQIPSELAAFFDPYGNAAHCALEFDVIGEDVLITGAGPIGIIAAGICKHIGARNVVVTDVNDFRLKLAADMGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLHKVLTHQLPIDDFQKGFDLMEAGKAGKVVLSWN

SEQ ID NO: 34860 - protein, 408 aa, Frankia sp. CcI3
MTATTDQPTLGSTTSDFAGLSPRPSDDDPAFALHRGGKININATAPLNSREDLSLAYTPGVARVCTAIAGTPALADDYTWRSNTVAVVTDGTAVLGLGDIGPAASLPVMEGKAALFKRFGGVDAVPLALACTDVEEIVDTVARLAPSFGGINLEDISAPRCFAIERLLQDRVDIPVFHDDQHGTAIVALAALENAAKLTGRTLGDLRAVVSGAGAAGAAVARILLAAGIGDIAVGDSRGILYAGRDNLTPSKAALAAETNRAGLAGSITDALAGADVFLGLSAGQVPEEAVATMAPEAIIFAMANPDPEIDPAVAHKYARIVATGRSDYPNQINNVLAFPGIFRGALDVRASRVTEGMKLAAARALAAVIADELAEDLIIPSVFDDRVAPAVAAATAAAARADGVARR

SEQ ID NO: 34861 - protein, 332 aa, Kitasatospora griseola
MTRIAINGFGRIGRNVLRALLERDSKLEVVAVNDLTEPTALGRLLAYDTTSGRLGRPVTVEGDVLVVDGRRIKVLAERNPADLPWADLGVDIVLEATGRFTSAEAARAHLAAGAKKVLVSAPSDGADVTLAYGVNTEAYDPAAHTIVSNASCTTNALAPLAAVLDELAGIEHGFMTTVHAYTQEQNLQDGPHRDPRRARAAGVNIVPTTTGAAKAIGLVLPQLDGKLSGDSIRVPIPVGSIVELNTTVSRDVTREEVLAAYREAAGGKLAGVLEYSEDPLVSSDIVGNPASSIFDSELTRVDGRHVKVVAWYDNEWGFSHRVIDSLELLAAS

SEQ ID NO: 34862 - protein, 150 aa, Lolium perenne
MAEQTFIMIKPDGVQRGLIGEIISRFEKKGFYLKGLKLQNVEKSFAEQHYADLSSKPFFGGLVEYIVSGPVVAMVWEGKSVVATGRKIIGATNPLASEPGTIRGDFAVDIGRNVIHGSDSVENARKEIALWFPEGLAGWTSSQHNWIYEA

SEQ ID NO: 34863 - protein, 762 aa, Oryza sativa
  misc_feature (658)..(658): Xaa can be any naturally occurring amino acid
  misc_feature (673)..(673): Xaa can be any naturally occurring amino acid
MASSHHQEVQEQGHGDGEEEEQDNSQITSPLLRSSMRLGSPEENSPVEQVALTVPVGDDPATPVLTFRIWVLGTASCVVLSFLNTFFWYRKEPLTVTAISAQIAVVPLGRLMAAALPERVFFRGRPWEFTLNPGPFNVKEHVLITIFANAGAGSVFAINVITAVRVFYGKRISFFVSLLVVLTSQVLGFGWAGIFRRYLVEPAAMWWPSNLVQVSLFRALHEKERRSKGGMTRTQFFLVAFVCSFAYYIFPGYLFQMLTSLSWICWIFPKSVLAQQLGSGLHGLGIGAIGLDWSSISSYLGSPLASPWFATANIAAGFFIYIYVITPIAYWINLYKAQNFPIFSDGLFTVTGQKYNISTIIDSQFHFDTKAYEKNGPLYISTFFSISYGLGFACLTATVVHVLLFHGSEIWQLSRSAFQDKKMDIHTKLMKRYKQVPEWWFISILIASVAITMFTCEYYIEQLQLPWWGVLLACALAIFFTLPIGIVTATTNQTPGLNIITEYIMGYLYPGRPVANMCFKVYGYIGPQQALAFLQDFKLGHYMKIPPRTMFMAQVVGTLIAAFVYLGTAWWLMDTIPNICNTELLPPGSPWTCPYDHLFYDASVIWGLIGPRRIFGDLGTYSAVNWFFLGGAIAPLLVWFAHKAFPGQKWILLVNMPXVLIAGISQMPPATSXVNYTAWIFVAFLSGYVVYKYRRDWWERHNYLLSGALDAGLAFMAVLLYLCLGLEKISLNWWGNDLDGCPLASCPIAEGITVQGCPVASA

SEQ ID NO: 34864 - protein, 308 aa, Cicer arietinum
MAKNVEGFEFEQRHGKERVRVARVWKSKDGKRHFVVEWRVSINLLSDCVNSYIRDDNSDIVATDTMKNTVYAKAKECSEILSAEDFAILLAKHFTSFYRQVTTAIVNIVEKPWERVSVDGQPHEHGFKLGSEKHTTEAIVKKSGALQLTSGIEGLSLLKTTKSGFEGFIRDKFTALPETRERMLATEVTALWRYTYESFYSIPQKPLYFTDKYLDVKRVLVDTFFGSPKEGVYSPSVQSTLYQMGKATLNRFPDIASIQLKMPNIHFLPVNLSNKDGHIVKFDDDVYLPTDEPHGSIEASLSRTRSKM

SEQ ID NO: 34865 - protein, 336 aa, Bordetella pertussis Tohama I
MTIRVVINGYGRIGRNILRAHYENGKKHDIEIVAINDLGDPKTNAHLTRFDTAHGKFPGTVTVDGDYMVVNGDKIRVLANRNPAELPWGELGVDVVLECTGFFTSKEKAGAHLKGGAKKVIISAPGGKDVDATIVFGVNQNVLKAEHTVISNASCTTNCLAPLVKPLHDKLGVETGLMTTVHAYTNDQVLTDVYHEDLRRARSATMSMIPTKTGAAAAVGLVLPELNGKLDGFAIRVPTINVSLVDLSFVAKRDTTVEEVNSILQAAAEGELKDILTYNTEPLVSIDFNHNPASSNFDATLTKVSGKLVKVSSWYDNEWGFSNRMLDTTVALMSAK

SEQ ID NO: 34866 - protein, 397 aa, Bordetella pertussis Tohama I
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELDALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKTAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 34867 - protein, 483 aa, Debaryomyces hansenii CBS767
MSIVSQVIPPISVKTILACLLWYLISSITSQLTKLILVKFTYPLFLSQFQFLISTLLSFTFITIARRFPEVQQHFPLGSLPNNSNKPIFDKSILITVLPLGIFQFTGKYFSLNATSLIPLSTVSSIKALSPLLIVAGYRVIYNVKFPSITYLSLTPLVGGVVLIIASESMNNDPGSKSTLLKNDKDEFDYKQIKGLIFCLISTIVFAAQSIYGKKLFTWNNSSTSNNPASLALNTEASKPGTPAIEQNGFAFSPPDNKVFDFSPKKSKKFIRQRTNSIKLPFSTSDLRLDEKNEEIVRQQLPYTRAVQNNDTITNPFASFTNDSLEDNNKKPDRMTTIFYCSMIGFFFSFGGFIINELSSIFKELTDPVEIIGGIPNQTTDIVTVLCLIFLDSLSHFSQMILAFHLLGLIPALSYSIASMMKRIVIITVSIILAIGSTQSHERDSSKWFGKINTQQLYGLILIAIGLYCYDRWGSRSLKANRI

SEQ ID NO: 34868 - protein, 493 aa, Leptospira interrogans serovar Lai str. 56601
MFMVTELSCCQKMTQLKRSLNLFDSISLMFSSMVGPGIFITTGYILHQVPNPNIVLLAWILGGFLAVAGAMSYAKSASLFPYAGGDYVYLKEAYSPIVAFASGWLSLSINFSASISLSALAFSKSFFSLINPSWDIYFFEIPFLGLTISIGTAQILAMSAILVFTIVNFFGISTASRIQNLFTSVKILGLVSFVILGFVIGNYDISRFKSFSLFPSDLKGFELLLAGVIPVTYSYLGWNMITYVAEEVKDPDKNIYKAVLYSCALVTILYILMNFLFLSSGTLSELSGDKIGITASSALFGPKATVFITVFICWAFLASISAYIIGGSRIYFAMARDGFFFQNMAKLHSKHKSPYMSLLFQCGYACLFCFVKEIESLLYLITCSTLLLATITAYTPILFEKRNYKLKFRIPGYPYTTYLYIASNFGIIATLLWNKPTEAFWGVGFTFLSIPMYYYFKIMQNTLSKNSTPLETPEVLATSLLPENEPVPIASGE

SEQ ID NO: 34869 - protein, 72 aa, Castanea dentata
VGGVSDVKGHENSLQIDDLARFAVDDHNKKANTLLQFKKVVNAKQQVVSGTIYILTLEVEDGGKKKVYEAKI

SEQ ID NO: 34870 - protein, 280 aa, Carboxydothermus hydrogenoformans Z-2901
MRINGETKLTGIIGYPLKHTLSPQMHNEAFKALNLNFLYLPLEVAEESLPQAIYGLKAFNFRGINVTIPYKEKVFPFLDEVATEAKTIGAVNTIVHDRGRLIGYNTDAPGFLLSLKENDVEVTGKKVLLLGAGGAARAVAYALLTAGAELIIANRTIDKAKELAKDFQGVGKISEILELGDKPISLAPYHMAVNTLPLGMHPYENQMPAVDFTGVTSDFVAYDLIYNPAETKFLKASKEKGARTINGLSMLLWQGVLAFEKWTGVSPPVKVMKKAIGLSC

SEQ ID NO: 34871 - protein, 112 aa, Oryza sativa (japonica cultivar-group)
MASPIFATVGNNSKKLKKPKPWKHNQAITTTQLKQMRDEFWDTAPHYGGQKEIWDALRAAAEAELSLAQTIVDSAGIIVSNSDMTICYDERGAKYELPKYVLSEPTNLIREG

SEQ ID NO: 34872 - protein, 399 aa, Zea mays
MLAAVMDYFSSCWGPRSGAGHREKGSDAAGRQDGLLWYKDVGQLVTGEFSMAVVQANQLLEDQSQVESGSLSLADTGPQGTFVGVYDGHGGPETSRFINDHLFNHLRRFATEHKFMSADVIRKAFQATEEGFLSLVSKEWSLKPQIASVGSCCLVGVICAGTLYVANLGDSRAVLGRLVKATGEVVAMQLSSEHNACYEEVRQELQSSHPDDPHIVVLKHNVWRVKGLIQISRSIGDVYLKKPEYNREPLHSKFRLRETFQRPILSSEPQITEHRIQPNDQFVIFASDGLWEHLSNKEAVDLVQSSPHNGIARRLVKAAMQEAAKKREMRYSDLKKIDRGVRRHFHDDITVVVVFLDLNAMSKASWSKSPSVSLRGGGVTVPAKSLAPFSAPARLNSTY

SEQ ID NO: 34873 - protein, 364 aa, Arabidopsis thaliana
  misc_feature (47)..(47): Xaa can be any naturally occurring amino acid
  misc_feature (188)..(188): Xaa can be any naturally occurring amino acid
  misc_feature (239)..(239): Xaa can be any naturally occurring amino acid
SFLSGRVAKRGAKLLEELIEFGHGKSNPIKFFSGDEIRNATNNFSDXLVSRKEFYYHWYSGKNENHPMILIKKDLGLSSLFKVDLLSRDIAVSSMVSGHKTFLKLVGCCLEFEDSVKVYHGVKKHYKLEISEHPWKRRMKIVEDIATALAYLHTAFPRLFVYRILSHWNILLDEDGVAKLTDFSHCVXIPEGDTFVQVEAAEGFYSYFADNYISSGVVSERTDVFGFGMFMGIRLLLGXFFEHYRGEEEEESEGGFDRKMKRHARNLLSTLKEDRSMEEIADPKMIEKMGQISEEELCQMKAFRMLSLRCMGPSEEVPTMVEVVKELKKIQRSLFNDSSSLSSGQTQFNSAQDISSTVVLSNQT

SEQ ID NO: 34874 - protein, 180 aa, Zea mays
  misc_feature (55)..(55): Xaa can be any naturally occurring amino acid
  misc_feature (103)..(103): Xaa can be any naturally occurring amino acid
  misc_feature (133)..(133): Xaa can be any naturally occurring amino acid
  misc_feature (143)..(143): Xaa can be any naturally occurring amino acid
  misc_feature (151)..(151): Xaa can be any naturally occurring amino acid
MLNGLYARAQVDSELKDDLVFGDPNAPRFVLWEGKLKPAPSKPADLPFFDFMNHXIPGKPRAGLGALGFRPPPPGREESVEEFVRRSLGAEVFERLIEPFCSXMKAAFGKVWRLEEAGGSIIGGTINHQHYSXQERGKNLKPXRDPRLPEXKTVASFRKGLVMLPNSITSRFAFIVLYIY

SEQ ID NO: 34875 - protein, 368 aa, Arabidopsis thaliana
MLSGNNGNTAPPVFMNENQLQYQTNLRSNQLHLLGNMGGGCTVDPVNYFANDNLVPMIRPNKRGREAESISNNIQRQQQKLQMSLNYNYNNTSVREEVPKENLVSTGLRLSYDDDEHNSSVTSASGSILAASPIFQSLDDSLRIDLHRQKDEFDQFIKIQVLIVSACRLCFYVKRFFDSNVFVCFYVVQAAQMAKGVRDMKQRHIASFLTTLEKGVSKKLQEKDHEINDMNKKNKELVERIKQVAMEAQNWHYRAKYNESVVNVLKANLQQAMSHNNSVIAAADQGKEGFGDSEIDDAASSYIDPNNNNNNNMGIHQRMRCKMCNVKEVSVLIVPCRHLSLCKECDVFTKICPVCKSLKSSCVQVFFS

SEQ ID NO: 34876 - protein, 180 aa, Photorhabdus luminescens subsp. laumondii TTO1
MTLKELVVGFATQVRSIWMIGLHAFHKRETQMYPEEPVYLPPRYRGRIVLTRDPDGEERCVACNLCAAVCPVGCISLQKAEHEDGRWYPEFFRINFSRCIFCGLCEEACPTTAIQLTPDFEMGEFKRQDLVYEKEELTISGPGKYPDYNFYRKTGVAIDGKSKGEADNEAKPIDVKSLLP

SEQ ID NO: 34877 - protein, 151 aa, Zea mays
ACSTGLCFLASIPPLSASCSSGSSCFLMIKRVSSAPSLSRWTIQYKQLGHTIYRRSHVLAFASADAPQGKRSSGENVVMVDPLEAKRLAAKQMQEIRAKEKLKRRRQAEAINGALAVIGLTAGLLVEAQTGKGILGQLAGYLTAISSLFGQ

SEQ ID NO: 34878 - protein, 599 aa, Photorhabdus luminescens subsp. laumondii TTO1
MMIDQIAQESARPAWQTHDHLDDPVMGELRNHFGPDAFTVQPTRTGIPVVWVKREQLLEVMTFLKKLPKPYVMLFDLHGMDERQRTHRQGLPAADFSVFYHLLSIERNRDIMLKVALSEKELNLPTATPLFPNANWYERETWEMFGVVFNGHPNLRRIMLPPTWEGHPLRKDYPARATEFDPFELTRQKEDLEMEALTFKPEEWGMKRGTENEDFMFLNLGPNHPSSHGAFRIILQLDGEEIVDCVPDIGYHHRGAEKMGERQSWHSYIPYTDRIEYLGGCVNEMPYVLAVEKLAGIEVPDRVKTIRVMLSELFRINSHLLYISTFIQDVGGMTPVFFAFTDRQKVYDLVEAITGFRMHPAWFRIGGVAHDLPRGWDRLLRDFLNWMPKRLDSYVKAALKNSILKGRAIGVAAYNSKQALEWGTTGAGLRATGIAFDVRKWRPYSGYENFDFDVPIGNNGDCYDRVMLKVEEVRQSLRILKQCLDNMPEGPFKADHPLTTPPPKERTLQHIETMINHFLQVSWGPVMPANESFQMIEATKGINSYYLTSDGSTVSYRTRVRTPSYPHLQQIPSVIRGSLVSDLIVYLGSIDFVMSDVDR

SEQ ID NO: 34879 - protein, 306 aa, Zea mays
MATPLDVPLDDLIKSRAGRGTGRGRGQGGGRGRGDGQRLARGSWRGRGTGNFRERGLGVSSRRPLGVNTWSSSFAIAKSFNKAKDFVWRHDLFEDSMVAAGLSGIESGTKLYISNLHYGVTSEDLQELFSEMGHLKHCAVHYDSYRHPTGSAEVIFTRRSEALAALKRYNNMRLDGKAMKIEVIGAELGLSAAAVPQISVVPGASRRGQREVVMMPGGSGFGQGASGPSSSLPGWKRGGFVRRGQGRVSFPQRGRGQVRSRGRGRGRSSFVQSRGRGYVRRGNAEKSAKQLDNELDNYNSGAMNVD

SEQ ID NO: 34880 - protein, 292 aa, Brassica napus
MLSSSSPAATTAHPPPSPESCQPPLSLLSLPQITRRYLFKTLSLCLAAPSLSVAPVHARGLFQMPPLRLSNRYYLVRAGESDYESLGVINTNPVAKTSVDSGLSEKGKKQTVRAALQLKAMGACDRNCWLWPSITQRAYQAAEIIASINGISRSYIVPEYSFLDARGLGAYEGKKLDTISEVYALDSISMKTKPPPISDGTPNESVSDVFVRITQLMSILETQYSEDTVVIVSPDSDNLSILQAGVQGLDLRRHSELYFGPGEVRLLDADSIPVYKQPASAVYKCTNPPNCD

SEQ ID NO: 34881 - protein, 453 aa, Streptomyces avermitilis MA-4680
MDKQQEFVLRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALAKTSDLGFTFYTHPEIEFFLLKDKPLDGSRPTPADNSGYFDHTPQNVGMDFRRQAITMLESMGISVEFSHHEGAPGQQEIDLRYADALSTADNIMTFRLVMKQVALEQGVQATFMPKPFSEYPGSGMHTHLSLFEGDRNAFYESGSEYQLSKVGRSFIAGLLKHAAEISAVTNQWVNSYKRIWGGSERTAGAGGEAPSYICWGHNNRSALVRVPMYKPGKTGSARVEVRSLDSGANPYLAYALLLAAGLKGIEEGYELPPGADDDVWALSDAERRAMGIEPLPQNLGEALALMQRSELAAETLGEHVFDFFLRNKKQEWEEYRSEVTAFELRKNLPVL

SEQ ID NO: 34882 - protein, 355 aa, Arabidopsis thaliana
  misc_feature (52)..(52): Xaa can be any naturally occurring amino acid
MMITRGGAKAAKSLLVAAGPRLFSTVRTVSSHEALSASHILKPGVTSAWIWXTRAPTIGGMRFASTITLGEKTPMKEEDANQKKTENESTGGDAAGGNNKGDKGIASYWGVEPNKITKEDGSEWKWNCFRPWETYKADITIDLKKHHVPTTFLDRIAYWTVKSLRWPTDLFFQRRYGCRAMMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 34883 - protein, 350 aa, Lactobacillus johnsonii NCC 533
MAENSTYPLQNSLPEKLNNNKSNFTFWDNFPETQKDMIAINRIILKHVNTVPGLLGDALKDTFASPGKMLRPACVMLFGSFGPNGHEKRKELQKIATSIETLHNATLIHDDIIDESSMRHGRPSIQTKYGKHIAVYAGDYLFALSLTLLSENAQSLHSVIADGKTMQNILVGETEQYNNAYKINISEKEYLDQIKGKTGVLFGLACFIGAYESGLKVTKALKAKKFGDYLGQAFQLRDDILDYTTTSSTFKKPVLLDVKDGIYSGPLIFALQNDHTGRLHKLVKLGQDLTKEQLQEIEKMVNDLDGVKRAQKLADKFTDKALHNLQKHWPDNKTRQQLEKLTDILLKRSY

SEQ ID NO: 34884 - protein, 425 aa, Chromobacterium violaceum ATCC 12472
MSRNLELFERGKQVIPGGVNSPVRAFGQVGGTPRFVARAEGAYFWDADGKQYLDYVGSWGPAIVGHAHPEVVKAVQDAAVGGLSFGAPTEGEVVIAEEICKLLPSVEQVRLVSSGTEATMTAIRLARGFTGRDLIVKFEGCYHGHSDSLLVKAGSGLLTFGNPSSGGVPADFTKHTLVLQYNDVEQLSRTFAEIGDKIACVILEPIAGNMNLIQPSREFVQALRQLTEKHGAVLIYDEVMTGFRVAKGCAQGLHGVTPDLTTLGKVVGGGMPLAAFGGRADIMGKIAPLGTVYQAGTLSGNPLSVAAGLATLKLIQQPGFYETLGSRTARLAQGLAEEARKAGVTLSTDSVGGMFGFYFSDKAPKSYAEATGCDIERFKRFFHAMLDEGVYFAPSAYEAGFVSAAHSEQMIESTLAAAGRAFARL

SEQ ID NO: 34885 - protein, 359 aa, Glycine max
  misc_feature (76)..(76): Xaa can be any naturally occurring amino acid
MEPTSLTVPFVQEIAKDALTRVPERYVRPLHERPILLSATTTPLPQVPVIDLSKLLSQDLKEPELEKLHYACKEWXFFQLINHGVSTSLVEKVKRGAQDFFNLPIEEKKKLGQREGEGVEGYGQAFVVSEEQKLEWADMFFMLTLPPHIRKPYLFPNIPLPFRDDLETYSAGLKKLAIQIVELMANALNVDSKEIRELFGEGVQSMRMNYYPPCPQPELVMGLNPHTDGGSLTILLQLNEVEGLQIKIDGSWIPIKPLPNAFIVNLGDMMEIMTNGIYRSIEHRATVNLEKERLSIATFYNPGMEVKLGPAPSLVTPTTPAVFKTISVPEYYRGYLSRELRGRSYLDSMKIQNEDENSS

SEQ ID NO: 34886 - protein, 512 aa, Arabidopsis thaliana
MEISVSSVTFSLAVVVVSWWVWRTLKWVWFTPKMLERSLRRQGLSGTSYTPLIGDFKKMISMFIEATSKPIKPTDDITPRVMPHPLQMLKTHGRTNLTWFGPIPTITIMDPEQIKEVFNKVYDFQKAHTFPLSKILGTGLVSYDGDKWAQHRRIINPAFHLEKIKNMVHVFHESCSELVGEWDKLVSDKGSSCEVDVWPGLTSMTADVISRTAFGSSYREGHRIFELQAELAQLVMQAFQKFFIPGYIYLPTKGNRRMKTAAREIQDILRGIINKRERARESGEAPSEDLLGILLESNLGQTEGNGMSTEDMMEECKLFYLAGQETTSVLLVWTMVLLSQHQDWQARAREEVKQVFGDKQPDTEGLNQLKVMTMILYEVLRLYPPVVQLTRAIHKEMKLGDLTLPGGVQISLPVLLVHRDTELWGNDAGEFKPERFKDGLSKATKNQVSFFPFAWGPRICIGQNFTLLEAKMAMSLILQRFSFELSPSYVHAPYTIITLYPQFGAHLMLHKL

SEQ ID NO: 34887 - protein, 390 aa, Burkholderia vietnamiensis G4
MNAPSDMPTAPVFPSRLPNVGTTIFTVMSALAAEKGAVNLGQGFPDFDCDPRIVDAVAAAMRNGHNQYPPMAGVASLRDAIADKIEHLYGRRYDAATEITVTAGATQALLTAILCAVHPGDEVIVIEPTYDSYLPSIELAGGKPVFVTLDAPDYAIPFDRLAAAITPKTRMILINTPHNPTGTVWREADLRRLEEIVRGTNVLILSDEVYEHMVYDGARHESVARYPELAARSFIVSSFGKTFHVTGWKIGYVAAPAALTAEFRKVHQFNVFTVNTPMQVGIADYLRDPAPYLTLPDFYQKKRDFFRAGLERTRFKLLPCTGTYFQCVDYSAISDVSEAEFAKWLTAEIGVAAIPVSAFYHAPHESGVVRFCFAKQESTLASALERLARL

SEQ ID NO: 34888 - protein, 108 aa, Pseudomonas syringae pv. tomato str. DC3000
MDIIETIKEQIASNTILLYMKGAPNAPQCGFSAKASQALMACGEKFAYVDILQNPEIRANLPKYANWPTFPQLWVAGELVGGSDIITEMMADGSLQTLVKEASAAKAE

SEQ ID NO: 34889 - protein, 476 aa, Frankia sp. CcI3
MDAIFANLIGGVSTPAVDGETMSILNPSTADLLAQAPRSGPADVDAAVAAASAAFEGWRDTTPAQRSRALLRVADALEDRADEVAAVESANTGKPLRLTVDEEVGPSADQIRFFAGAARLLEGRSAGEYLAGYTSYVRREPIGVCAQVTPWNYPLMMAVWKVAPAIAAGNTVVLKPSDTTPASSLLLAEIAAEFLPPGVLNVVCGDRDTGRALVAHPGPAMVSVTGSVRAGMEIARAAADSLKRVHLELGGKAPVIVFDDVDPAVVARQIAEAAYFNAGQDCTAATRVLAAPGVHDELAAALAEAAGKTATGSPEEPDVDYGPLNNAGQLARVSGFVERAPEHAEVLAGGAPLDRAGYFYPATVVSGLRQDDELIQSEVFGPIITVQRFDSEDTAVAWANGVEYGLASSVWTRDHGRALRVARRLDFGCVWINTHIRLVAEMPHGGFKKSGYGKDLSVYGLEDYTRIKHVMSNIEF

SEQ ID NO: 34890 - protein, 457 aa, Frankia sp. CcI3
MTRVVARARVAELAARESARLDVRTRGSEALHARAVRSMTSGVPSSYQVRDPWPIYLTRGLGSKVWDVDGNEYSDFHNGFGSMVQGHAHPAIVRAVTERVALGTHFAMPTEDCVVVSEELARRFGLPQWRYVNSGSEATMDAIRIARGVTGRDTIVKIFGSYHGHHDYVMVSIGTPYDDIGPAENMNSLGYGAGIPRVVVDLTVPVPFNDAPAMERRIAALAAEGRLPACVIMEPAMMNLGVVLPEPGYLAAVREITSRYGVILIFDEVKTGLCVAAGGATERFGVRPDLVTLAKALGGGLPSGAIGATAELMEAVASDRVKQVGTYNGNPLTMAAARASLFEVLTPDAYTHLDRLGGRLTAGCDEILTRHGIPGYTVGISSKGCVHFTDAPIRDYTSFMAHQNAELPELAWLYNANRNVLMAPGREEEWTLSVQHTDADVDRYLDSLDQMARDLVG

SEQ ID NO: 34891 - protein, 804 aa, Oryza sativa
KTCWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 34892 - protein, 364 aa, Solanum lycopersicum
MAIENNDQSFFLDVLYCEEEEEKWGDLLEDEEGVIINPLLLSSEGTTKTNSLLLLPLLLLEQDLFWEDEELLSLFVKEKETRCCFESFGSDPFLCSARVDVVEWILKVNAHYDFSALTAILAINYLDRFLSSLQFQKDKPWMTQLAAVTCLSLAAKVEETQVPLLLDFQVEDAKYVFEAKTIQRMELLVLSSLKWRMNPVTPLSFLDHIIRRLGLKNNVHWEFLRRCESLLLSVMIDCRFVRYMPSVLATAIMLHVIHQIEPCNAIDYQNQLLGVLKISKENVNNCYELISEVSSKPITSHKRKYDENPSSPSGVIDPIYTSESSNDSWDLDLPSFKKSKVQEQQMKMSSSLSRVFVEAVGSPH

SEQ ID NO: 34893 - protein, 561 aa, Ustilago maydis 521
MNSKAAQDRQQRILLDLVRQPGNDVCADCKGRAPRWASWNLGIFICVQCAGVHRKMGVHISKVKSITLDTWTREQVDRMKEVGNLKSNRKYNPDEMRNRPPTNMEESERDSELEKYIRRKYEFRRFVEGRPPPVPSKDATFLTSPSGSVEYSHAPRSPVEPISSSQSSSSLAQGSSIARSRTAPIPSTWSEAQQRVKANAPPLPNPTAAGYRAASGSQINGTSALSTRSTALTQSSLQLPGASVPLRTTSALNTRDGGQIASASKPTTPTVQSSVFDDLISLNESSQPTATQPPLQMNPWASLQAQQQAVLSAPAIQEPTGLFWAGQPSPNGVASPMAPFGISPSNNNMTFDPVRNTPQHANTMPSLSVSSAQNPLSSQATGMLSASNGGMYSQFEQQRSVGLGSMAFSTSPLPSPGFAPSNPFNATQSNSAAPLPQTAGFVGVNSLFQHQPQQLGQVAFQGQANILAPNQAFYGQQQYSIQIQPASNGVGHFQSSMMPNGFGQAQFGTSHLMQQQQRQQQQQQQQQQQQQQQQQQQQQQQQQQQQQQQQQQNTQQFGQRP

SEQ ID NO: 34894 - protein, 406 aa, Burkholderia cepacia
MSADPFVIVGAGHAARRTAEALRARDADAPIVMIGAERELPYDRPALSKDALLNDDGEQRAFVRDAAWYDAQRIALRLGTRVDAIEREAQRVRLDDGTTLPYAKLVLATGSRVRTFGGPIDAGVVAHYVRTVADARALRAQLVRGRRVAVLGGGFIGLEVAAAARQLGCNVTVIDPAARLLQRALPEVVGAYAHRLHDERGVGFQMATLPRAIRAAAGGGAIVETDRGDVHADVVVVGIGVLPNVELAQAAGLDVDNGIRVDAGCRTADRAIFAAGEVTMHFNPLLGRHVRIESWQVAENQPAVAAANLLGADDAYAELPWLWSDQYDCNLQMLGLFGAGQTTVVRGDPARGPFTVFGLGGDGRIVAAAAVNLGRDIGAARRLIAAGAMPDPQQLADPTVGLKTFL

SEQ ID NO: 34895 - protein, 140 aa, Magnetospirillum magnetotacticum MS-1
MAIERTLSIIKPDATRRNLTGKINARFEEAGLRFVAQKRVQLTKAQAQQFYSVHAERSFFGELVDFMISGPVVVQVLEGEGAVARNREIMGATNPANAAPGTIRADFAESVEANSVHGSDSAENAAIEIAYFFAGSEIVG

SEQ ID NO: 34896 - protein, 742 aa, Glycine max
  misc_feature (77)..(77): Xaa can be any naturally occurring amino acid
  misc_feature (100)..(100): Xaa can be any naturally occurring amino acid
MAVAAKSSSTHAEKAANGESSAERCPENEVALQFPETDDPSLTVMTLLAWLLRIASCVLLIFLNTFFTLRTQPLTIXPFCMHIAVLPIGRFMGSTLPTKXYRFLGWSLTFNPGPFNMKEHVIITIFANCGVSFGGGDAYSIGAITVMKAYYKQSLSFLCALFIVLTTQMLGYGWAGILRRYLVDPVEMWWPANLAQVSLFRALHEKEPKSKGLTRMQFFLIAMGASFLYYALPGYLFMVLTFFSWICWAWPHNITAQQIGSGYHGLGIGAFTLDWAGISAYHGSPLVSPWSSIVNVGIGFIMFIYIIVPVCYWKFNTFDAHKFPIFSNQLFTASGHKYDTTKILTPEYDLNVDAYNKYSKLYLSPLFALSIGSGFARFTATLTHVALFYGRDIWRQSRSAMSNAKLDIHGRLMKAYKQVPEWWFLSILFGSMALSLLMAFVWKTDVQLPWWGMLFAFGLAFIVTLPIGVIQATTNQQPGYDIIAQFMIGYVLPGQPIANLLFKIYGRISTVHALSFLSDLKLGHYMKIPPRCMYTAQLVGTLVAGVVNLAVAWWMLDSIKDICMDDKVHHDSPWTCPKYRVTFDASVIWGLIGPKRLFGPGGLYRNLVWLFLIGAVLPVPIWVLSKIFPEKKWIPLINIPVITYGFAGMPPATPANIASWLVTGMIFNYFVFRYNKRWWQKYNYVLSAALDAGTAFMGVLIFFALQNAGHNLKWWGSELDHCPLATCPTAPGIEVEGCPVFK

SEQ ID NO: 34897 - protein, 533 aa, Emericella nidulans
MSILALVEDRPTPREVYNWRVYLLAAVASFTSCMIGYDSAFIGTTLSLQSFQNEFNWESLNTDLISANIVSLYQRGAFFGALFAYPIGHFWGRRWGLMFSALIFFLGAGMMLGANGDRGLGLIYGGRVLAGIGVGAGSNICPIYISEMAPSAIRGRLVGVYELGWQIGGVVGFWINYGVDETLAPSHKQWIIPFAVQLIPAGLLIIGALLIRESPRWLFLRGNREKGIETLAWIRNLPADHIYMVEEINMIEQSLEQQRVKIGLGFWKPFKAAWTNKRILYRLFLGSMLFLWQNGSGINAINYYSPRVFKSIGVSGGNTSLLTTGIFGVVTAVITFVWLLYLIDHFGRRNLLLVGAAGGSVCLWIVGGYIKIAKPENNPEGTQLDSGGIAAIFFFYLWTAFYTPSWNGTPWVINSEMFDPTVRSLAQACAAASNWLWNFLISRFTPQMFTSMGYGVYFFFASLMILSIVFVFFLIPETKGVPLESMETLFDKKPVWHAHSQLIRELRENEEAFRADMGASGKGGVTKEYVEEA

SEQ ID NO: 34898 - protein, 489 aa, Escherichia coli K12
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 34899 - protein, 59 aa, Sorghum bicolor
VLADTQMPEEPDGWFQGTADSVRKFIWVLEDYYNHKSIEHIVILSGDQLYQMNYMELVQ

SEQ ID NO: 34900 - protein, 183 aa, Coffea canephora
GAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQIPRGLKYIHSAKVIHRDLKPSNLLVNANCDLKIIDFGLARPNTKNEVMTEYVVTRWYRAPELLLNSSDYTAAIDVWSVGWIF

SEQ ID NO: 34901 - protein, 1429 aa, Alternaria brassicicola
MQRRGSSAYNIPAGAGEEIMRTISRTFSGKSRHEDDIEREREEDATDTDSAKTKVEEWRLARDVKNIQQNDPTEGRRLGVTWSGLTVKVVPSDARLQENVLSQFNIPQQMRESRQKPELKTILDNSFGSVHPGEMLLVLGRPGSGCTTLLKMLANKRKGYAQIDGDVHFGSMDDKEALKYRGNIVINTEEELFFPTLTVGMTMDFATKLNIPRTLPKNSATPEEYRQKFKSFLMDSMGISHTEDTKVGDAFVRGVSGGERKRVSIIETLANRASVACWDNSTRGLDASTALEYTRALRCLTDAMGIATIVTLYQAGNGIYDLFDKVLVLDEGKQVFYGTREQARPFMEEQGFVCSEGANVADFLTGVTVPAERQIRPGYEGFPRNDIELEQAYQRSSIRVAMEQELSYPTSDAAKSNTKTFVEAMAIDKSKHLPASSPMTVSFYHQVKACVARQYQILWGDKATFIIKQGSTLFQAIIAGSLFYNAPANSSGLFVKGGALLLSLLFNALLAMSEVTDSFFGRPILAKHKNFAFYNPAAFCIAQIAADVPILLFQVSIFIIVLYWMVALKATAAAFFTAWFVVYLVTFVMTAFFRMIGAAFPNFDAASKVSGFSITALILYVGYQIPKPSMHPWFVWIYWIDPLSYGFEALMANEFSDQDIPCVNNNLVPNFLPQYQNGVNQACAGVAGAKPGATSVSGDDYLRSLSYSKGNIWRNVGILFAWWILFVGLTIFFTLRWDDSAGSGGSLLIPRENKKKVRRSIIPGDEEAQANEKAPRTDGADEKAAGTEDLSTNLMRNTSVFTWRNLSYVVKTPSGDRKLLDNVHGYVKPGMLGALMGSSGAGKTTLLDVLAQRKTDGTIHGEILVDGRPLPVSFQRSAGYCEQLDVHEPFSTVREALEFSALLRQSRETPREEKLAYVDTIIDLLELHDLEHTLIGRVGAGLSVEQRKRVTIGVELVSKPSILIFLDEPTSGLDGQAAFNTVRFLRKLADVGQAVLVTIHQPSALLFAQFDTLLLLAKGGKTVYFGDIGDNASTIKEYFSRYDAPCPPGANPAEHMIDVVTGTHGKDWHQVWLDSPEAARMHKDLDHIITDAAGKEPGTVDDGHEFAMDLWAQTKIVTNRANVSMYRNIDYVNNKFALHIGTALFIGFSFWKIGDTVADQQLILFSLFNYIFVAPGEIAQLQPLFIDRRDIYETREKKSKMYSWIAFVTGLVVSEIPYLIICAILYFVCFYYTAGLPGDSNRAGAVFFVMLVYQFIYTGIGQFVAAYAPNAVFASLVNPLLIGVLVSFCGVLVPYAQIQEFWRYWIYYLNPFNYLMGALLVFTDFDWDVNCSESEFAKFNPPAGQTCGDYLQAWMAGPGSRTNLVNPDATSDCRVCQYRSGSDYLYPVNLNEYYYGWRNAAICVIFAISSYALVYGLMKLRTKASKKAE

SEQ ID NO: 34902 - protein, 235 aa, Rickettsia rickettsii
MKDIEYWEKNFESCKYSDQLIERLLFLNTQVKQPIDIREVQKGIYYARKYHGEQMRQSGDPYYSHPIAVTIMVAEFVAKEVPKLFTFRMLQAALLHDTIEDTELTEEIISNIFDEEVARHVAGLTRIKPWGKISSEKSLILLIKQQRYDTALIKLFDRIHNLQTLEAKSPEKAHKIIKETLKSFLVLSEILEIPSVSELIYAECYKNNLKFNINSTFNKIINFDSFPFSQNKLLP

SEQ ID NO: 34903 - protein, 380 aa, Oryza sativa (japonica cultivar-group)
MASLLIASTGGAHRLAWKDAAALGPAPRLARPWPAAVAAPAPLLRISRGKFALQAITLDDYLPMRSTEVKNRTSTADITSLRVITAVKTPYLPDGRFDLEAYDSLINMQIDGGAEGVIVGGTTGEGHLMSWDEHIMLIGHTVNCFGAKVKVVGNTGSNSTREAIHATEQGFAVGMHAALHINPYYGKTSIEGLISHFEAVLPMGPTIIYNVPSRTGQDIPPAVIEAVSSFTNLAGVKECVGHERVKCYTDKGITIWSGNDDECHDSRWKYGATGVISVASNLIPGLMHDLMYEGENKTLNEKLFPLMKWLFCQPNPIALNTALAQLGVVRPVFRLPYVPLPLEKRVEFVRIVESIGRENFVGENEARVLDDDDFVLVSRY

SEQ ID NO: 34904 - protein, 162 aa, Burkholderia vietnamiensis G4
MTAIQHFFKTFFLTELLKGLALTGRYTFRRKFTVQFPEEKTPISPRFRGLHALRRYENGEERCIACKLCEAVCPAMAITIESETRADNTRRTTRYDIDLTKCIFCGFCEESCPVDSIVETQILEYHGEKRGDLYFTKEMLLAVGDRYEKDIAAAKAADAPYR

SEQ ID NO: 34905 - protein, 327 aa, Xanthomonas campestris pv. campestris str. ATCC 33913
MSSPITLIEAITQALAWELEHDPAVLVLGEDVGVNGGVFRATAGLQQRFGSARVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGEALPLDVCFVLRDGTDVTLVTWGAQVKEALEAADKLASEGISAEVIDVATLRPLDFDTIAESVAKTGRCVIVQEAPRTAGFGAEIAAQLAEKSMYDLLAPVERVTGYDTHIPLFRLEMKFLPSVERIVTAARRAVAAG

SEQ ID NO: 34906 - protein, 137 aa, Oryza sativa
ICLEAFCKSDPSTLTGCKHEFHLQCILEWCQKSSQCPMCWQPISLKDPTSQELLEAVERERNVRTNQTRNTTIFHHPALGDFEVQHHLAAAAAMGRSHHLGRREGHRGRSGSHGRPQFLVFSSHPNMPSAGSVSSSM

SEQ ID NO: 34907 - protein, 362 aa, Xanthomonas campestris pv. campestris str. ATCC 33913
MSVAAQFEIEYLQYMDADGQLVRDDLPADAANPQQLLALFKRMLFVRTFDSKSIALQRTGKLGTYAASLGHEATHVGIGASMRSGDVFAPSYREYGTMFERGVRPRDVLLYWGGDERGSDYPRDADAAIDFPICVPISTQCLHAAGAALSFKLQGKAQVAVACCGDGGSSKTDFYAALNSAGAYTLPLILCVINNGWAISVPRSAQTGAQTLAQKGLAGGLHCLQVDGNDLIAVLEAMRQARARALAGDGGTVIEFLTYRLTDHTTADDARRYRGEDEVKQAWTREPMLRLRRYLTAQGLWDEAQEEAWKAECGARIDEEVNAYLNTPVQPVEAMFDYLYGDPPAELLAQRAEVIALEARHG

SEQ ID NO: 34908 - protein, 143 aa, Mesorhizobium loti MAFF303099
MTVKAILEKKGHDVLTLGPNEKLSEAIRILAEHKIGALVITNGDHKIVGILSERDIVRVVAKEGAAALDIAVRSAMTPKVKICNENHTVNEVMEIMTRGRFRHLPVEKDGLLDGIVSIGDVVKRRIEDVEREADEIRAYIATA

SEQ ID NO: 34909 - protein, 512 aa, Oryza sativa (japonica cultivar-group)
MVESFHGLVVVDLRTAAPLLATAVALYILIEQLSYHRKKGSMPGPPLVVVPFLGSVTHLFRDPVGFWDLQATRASKSGAGLTADFLFGRLMVFIRDSELSRRVFANVRADAFHLVGHPFGKKLFGDHNLIYMVGKEHKDLRRRIAPNFTPRALSTYAVIQQRVILSHLRRWIDRSVANGGKAEPIRVPCRDMNLETSQTVFVGPYLTVETRERFDRDYNLFNHGFITLPIDLPGSAFRRARLAVPRLKHILEDCARQSKQRMRGGGEPECLVDYLMQETVREIDEAAAAGLPPPPHTSDMETGNLLFDFLFAAQDASTSSLCWAVSALDSHPDVLARVRAEVAALWSPESGEPITAEMMTEMKYTQAVAREVVRYWPPGPVVPHIAGEAFQLTEQYTIPKGTIVFPSVYESSFQGFPDAGTFDPERFFSEARREDVVYKRNFLAFGAGPHQCVGQRYALNHLVIFMALLASLIDFRRERTEGCDVPVYMPTIVPRDGCVVHLKQRCAKLPSF

SEQ ID NO: 34910 - protein, 450 aa, Bifidobacterium longum NCC2705
MSIRKELTAQNVLLGFQHVLVSNVWLDPVFVAGAIGLPIALSSNMINAIFIVSGLVTLVQATRLVRLPVVQGPSAAFDALMIAAGTAGMLGAASSSILIASLVFLLLCLTGVIERMRFLFSPMISGVVIFMVGVSLSGFTLSEFLGGAPGDKTFADPHILTVSILTTAIVLVLSLLGKGLLKSFSFLIALVVGTVVAAAFGMVDFSPVASKGWLGLPTFLPYGPFTFDWKIFIPFFIAYMVAVMEALGVYQAASEIQGTSLERKQVRYGLAGEAAGSAISSLIGGFTTTAYPQNVGLLNLTGEGKLRTRTPVIIAAVLLLILGFVPKAGALLSVIPSAVVGGIFLPAAASLIVTGLRALRKVADDERRQTVIGMSLLLGIALPKALSGLTGGASVFFGNNIMVGVFSAIILNALFVALPDLVAKHRAPASVDVPAADPADGTGAAAYDER

SEQ ID NO: 34911 - protein, 187 aa, Leptospira interrogans serovar Lai str. 56601
MSSREITILKIQEPTRSIASLTRIMEEELSQYRKTLPKGFREEVDCDEDTVLFLHVDFLPLDFQKTTELLLTGKKNLVPVVAIDLQGQILMQAFGNEESQTLSLKTGYAHYFSRSRNQLWKKGDTSGHTQKILQILSPTDRSFLVYQVEQEVAACHEGYYSCFFRERMEGVTWKLLPVPRNFLPEKS

SEQ ID NO: 34912 - protein, 447 aa, Nocardioides sp. JS614
MEGSRVSRATTPQSKLERVTDSLTVRDNRTGQEYEVPITDGTIKAADLGQIKAEEDAPGLAVYDPGFVNTASCRSSVTFIDGDKGVLEYRGYPIEQLAEKSSFLEVAYLLVHGSLPTRAEYEAWVHEITYHTFVHENVKEFMQGFRYDAHPMGMLMASVGALSTFYPDARNISDADNRHMQIVRMIAKMPTLGAWSFRHAQGKPFVYPDNELGYTANFLSMLFKMSEHRFEADERLVKALDVLFILHADHEQNASTNAVRSVGSTQVDPYSAVAAGVGALYGPLHGGANEAVLRMLRRIGTKENIPSFIQGVKDGNERLMGFGHRVYKNYDPRAKIIKKSAEDVFEVTGTNPLLDIALELEKIALEDEYFVKRRLYPNVDFYSGLIYEAFQFPPEMFTVLFAIGRTPGWLSQWLELVQDKEQKIARPKQIYTGERGLDFVPAAERWA

SEQ ID NO: 34913 - protein, 175 aa, Zea mays
MAALIKLGSLLRQSAVASSASTGSAPALFNAARFMCAGQPADGSKLFVGGLAWATDDHSLKEAFQSFGEVVEARVITDRETGRSRGFGFVSFASGEDAKSAAENMDGKELAGRNVRVNFANERPSGGGGGGFSRGGGGYGGGGGGYGGGGYGGGGGYGGGRGGGGGGYGGDHESY

SEQ ID NO: 34914 - protein, 183 aa, Coffea canephora
LVIGAYGIVCSALNSETTEHVALKKIANAFDNRIDAKRTLREIKLLRHMDHENVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 34915 - protein, 426 aa, Thermosynechococcus elongatus BP-1 [sequence omitted]

SEQ ID NO: 34916 - protein, 365 aa, Silicibacter sp. TM1040
MTQTLTLLGLESSCDDTAAAVVRQTTGAKAEILSSIVFGQTELHSAYGGVVPEIAARAHAEKLDSCVRDALAEAGLTLGDLDAIAVTAGPGLIGGVMSGVMCAKGISAATGLPLIGVNHLAGHALTPRLTDDITYPYLMLLVSGGHCQYLIARGPETFSRLGGTIDDAPGEAFDKTARLLGLPQPGGPSVQAEAEHGDPERFRFPRPLLDRPDCNLSFSGLKTALMRMRDQIIAEKGGLTRQDRADLCAGFQAAIVDTLVEKTRRALRLYLEDKPQHPTLAVAGGVAANTEIRNGLMALCFELETDFLAPPLALCTDNAAMIAYAGLERYKTGARDGMSLSARPRWPLDKTSPALIGSGKKGAKA

SEQ ID NO: 34917 - protein, 304 aa, Carboxydothermus hydrogenoformans Z-2901
MTEILNKFRGVIPPMLTIFKEDGTFDWEGNKALIDFLINGGVHGIFVLGSSGEFSHLNAEERKEFAKFVVDYVAGRVPVLVGTGSSNTKEVVELTKHAKEIGADGVVVVSPYYWGLSEKNLYQHFATVAKVVDIPIVLYNFPDLTGQNLSPSLVAKLASDFPNIVGIKDTIDSIAHIRELILQVKTVRPDFSVLAGYDDHLFNTLAMGGDGVIPGTANFAPHIPVNIYNNFVKGNIEESMNWHRKLLRLPRIYSLDKPAISLLKEACKLCGLPVESYIRQPAGRADEAAVENLKTLLREAGLIK

SEQ ID NO: 34918 - protein, 400 aa, Oryza sativa
  misc_feature (56)..(56): Xaa can be any naturally occurring amino acid
MFAAICRRRLAALFPQIRGGGGGAYHVQSNPQAALLFHSYSSTAVTGGSDPEPCPXDTVSYLVSCGLPPAVARHTAANTRGLRIRSTEKADAVRTLLRSYGFSDADVARIARSAPLLLTVDPDRIIRPKLEFFATMGFQPSKLSTAPLLLARSLEKHLVPTIQFLRSIIGSDDGIRRGFSRIPRALLVSLDNCMRPAVEALHRHGLTGREDVSKVLVLQMGVLMLSPVRIGEIFEDLKAMGMSITDGRFANSFRAMCSMRRATWLRKVALYRSFGLSESEVFEAFKKQPTALLGADETIKKNASFFRDALKLEMREVMVHPVVMAYSFEKTILPRCAVLSVLMREGKINPDIQLLHALLGSAKTFSGRYVDRFAADVPDVVEAYEGKIKFKGFKGQGQGV

SEQ ID NO: 34919 - protein, 183 aa, Coffea canephora
LVIGAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQILRGLKYIHSAKVIHRDLKPSNLLVNANCDLKIIDFGLARPNTENEVMTEYVVTRWYRAPELLLNSSDYTAAIDVWSVG

SEQ ID NO: 34920 - protein, 320 aa, Arabidopsis thaliana
MRPPLTGSGGGFSGGRGRGGYSGGRGDGGFSGGRGGGGRGGGRGFSDRGGRGRGRGPPRGGARGGRGPAGRGGMKGGSKVIVEPHRHAGVFIAKGKEDALVTKNLVPGEAVYNEKRISVQNEDGTKTEYRVWNPFRSKLAAAILGGVDNIWIKPGAKVLYLGAASGTTVSHVSDLVGPEGSVYAVEFSHRSGRDLVNMAKKRTNVIPIIEDARHPAKYRMLVGMVDVIFSDVAQPDQARILALNASYFLKSGGHFVISIKANCIDSTVPAEAVFQTEVKKLQQEQFKPAEQVTLEPFERDHACVVGGYRMPKKPKAATAA

SEQ ID NO: 34921 - protein, 428 aa, Acidovorax sp. JS42
MSAIVDIVGREVLDSRGNPTVECDVLLESGVMGRAAVPSGASTGSREAIELRDGDKSRYLGKGVLKAVEHINTEISEAVLGLDASEQGFLDKTLIDLDGTDNKSRLGANAMLAVSMAVARAAAEESGLPLYRYLGGMGSVQLPVPMMNVINGGAHANNSLDLQEFMIIPVGAPSFREAVRWGAEVFHALKKIIHDKGMSTAVGDEGGFAPSVENHEAAIQLILQAIEAAGYTAGEQIALGLDCAASEFYKDGMYVLEGEGGLQLTAQQWTDMLASWCDKYPIISIEDGMHEGDWDGWKILTERLGHNVQLVGDDLFVTNTKILKEGIDKGIANSILIKINQIGTLTETFAAIEMAKRAGYTAVISHRSGETEDSTIADIAVGTNAGQIKTGSLSRSDRIAKYNQLLRIEEDLGDIAFYPGRAAFYNLR

SEQ ID NO: 34922 - protein, 271 aa, Zea mays
MRAAPTDPPTAPAKSMLRRLFDRQLLRISPAERLPSAGAGEKDEAEPSSVCLDGMVRSFMEDDVGSEKAAHGGRYCNCFHGGDNSDDEEDDEAAAAASDVAETIKGLVHCATLRERNLLADVCAHLERHREAGARRRDLLRLHAYIDVLLPAASDRGARERVLVDVDFRSAFEVARPTKAYRALLQRLPAVFVGKDDRLRLLVAAAADAARASLKKRGLHLPPWRKPEYMRAKWLSPYHREAPVAEEAASASADEDDGDGPGPGTGTGTAA

SEQ ID NO: 34923 - protein, 147 aa, Glycine max
SHSVILQHKTMGSLMAGWDSTHIDPQSATLKRNRSLTKDEIDAYWKSKKKIEEEHLRAISNLSETIQASKSTEPEKKLQKSMTMPVTRARDYLNMGIDTSLEHLIKKNGWWTKSSWAFLNEPPVTEAVSNKYKSQFHVTSMGSSIKI

SEQ ID NO: 34924 - protein, 158 aa, Brassica napus
  misc_feature (129)..(129): Xaa can be any naturally occurring amino acid
MLLGKRQRPQIKRTTSLSEIKFDLNLPNEPEEPSDHQVQMLSDPKGKLVTGDEQRQVHHGLLDQRLLATVSPRGTQRRHSADHSTHARADFLRSCSLCKRLLVPRRDIYMYRGDGAFCSLECRQQQITXDEKKEKSLVRSTFVVGAGSGKGERLSAAA

SEQ ID NO: 34925 - protein, 163 aa, Heterocapsa triquetra
MQRSVCIVAAALALYGASCFVMPCMMGAAPEAGRQAVREQALVAAPEAASASAGSWSPLALGAALGLLVAVATGRPALAADLENGESVFGANCAACHAGGNNSVVPEKKIKKEALVTYGKYDVAAIIKQVTYGNGSMPAFGERLGPDDIEDVANYVFGQADKW

SEQ ID NO: 34926 - protein, 201 aa, Lilium longiflorum
ELSVLCDAEVALIIFSNHGRLSEFCSSSSMMKTLERYHKCSYNATEDIIPSKETENSYHEYLKLKTRVDYLQRSQRNLLGEDLGPLSTKELEQLENQLEISLKHIRSTKTQLMLDELSDLKGKEHMLQDANQLLRRKSWKNCSRDSGPSMPSDCQPARPERFFQPLACDSSLQIGFHPVGIDQLNNGVSPQNGDDYAPAWM

SEQ ID NO: 34927 - protein, 508 aa, Oryza sativa (japonica cultivar-group)
MAAVVDFLDLRAAAPFVVAALAFYFLVEQLSYHRKKGPLPGPPLVVPFVGSVAHMIRDPTGFWDAQAARARKSGAGLAADFLIGRFVVFIRDSELSHRVFANVRPDAFHLIGHPFGKKLFGDHNLIYMFGEDHKDLRRRIAPNFTPRALSTYAAIQQRVILSHLRRWLDRSAANGGKAEPIRVPCRDMNLETSQTVFAGPYLTKEAREKFERDYNFFNVGLMALPVDLPGFAFRSARLGVARLVRTLGECARASKARMRAGGEPECLVDFWMQETVREIDEAKAAGKPPPAHTDDEELGGFLFDFLFAAQDASTSSLCWAVSALDSHPDVLAGVRAEVASLWSPESGEPITAEKIAEMKYTQAVAREVVRHRPPATLVPHIAGEEFQLTEWYTIPKGTIVFPSVYESSFQGFPEPDTFDPERFFSEARREDVVYKRNFLAFGAGPHQCVGQRYALNHLVLFMALFVSVVDFRRDRTEGCDEPVYMPTIVPRDSCTVYLKQRCAKFPSF

SEQ ID NO: 34928 - protein, 347 aa, Datura metel
MATLVSNWSTNNVSESFIAPLEKRAEKDVALGNDVPIIDLQQDHLLIVQQITKACQDFGLFQVINHGVPEKLMVEAMEVYKEFFALPAEEKEKFQPKGEPAKFELPLEQKAKLYVEGERRCNEEFLYWKDTLAHGCYPLHEELLNSWPEKPPTYRDVIAKYSVEVRKLTMRILDYICEGLGLKLGYFDNELTQIQMLLANYYPSCPDPSTTIGSGGHYDGNLITLLQQDLVGLQQLIVKDDKWIAVEPIPTAFVVNLGLTLKVMSNEKFEGSIHRVVTHPIRNRISIGTLIGPDYSCTIEPIKELISQENPPLYKPYPYAEFAEIYLSDKSDYDAGVKPYKINQFPN

SEQ ID NO: 34929 - protein, 231 aa, Arabidopsis thaliana
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKELSAKSFFLTLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 34930 - protein, 382 aa, Mesorhizobium loti MAFF303099
MVVSLSRRGNVEPFHAMDVLAEANRLKAQGVPVISMAVGQPSDPAPVRVRAAAARALQDGRIGYTDTLGLAGLRKAIAEHYADHYRLEVEPARIAVTTGSSAAFNLAFLAMFDPGDRVAIAAPGYPAYRNIMAALGIDVVEIELGDAAYLHAGHLETAHREKPLKGVLFASPANPTGAVIPADELSALVNTAEALGIAVISDEIYHRLAYGAPDTTALAFGNSVTVINSFSKYYCMTGWRIGWMVLPEELVRPVERIAQSLYISPPELSQIAAIEAFAATEELEAVKGRYAWNRELLMKRLPELGFPLAAPMDGAFYAFCDVTRHSNDSMAFARKMLAEAHVAATPGRDFDTQAGHRTMRFSYAGSHDDMVEAMARIERWLR

SEQ ID NO: 34931 - protein, 315 aa, Mesorhizobium loti MAFF303099
MPELERAPKLDQALAEVAAEMAERTDRGDVATYIPQLGKVDPRKFGIAAVTNDGRVLVAGDADQAFSIQSISKVFTLTLALGNVGDALWQRVGREPSGNPFNSIVQLEHENGIPRNPFINAGAIVISDILLAGHQPREAIGEILRFIQFLADDDTIIIDREVAASERATGYRNFALANYMKSFGNLHHAPELALGVYFHHCAIAMSCRQLAMAGRFLANGGKNPATGHSVVSAERARRIGAMMLTCGHYDGSGDFAFRVGIPGKSGVGGGILGIVPGVASLAVWSPGLNANGNSKLGSIALEKLARMMNWSIFAP

SEQ ID NO: 34932 - protein, 196 aa, Thermosynechococcus elongatus BP-1
MKFLNQITNYAKEAVQSAKYIGQGLSVTFDHMRRRPITVQYPYEKLIPSERFRGRIHFEFDKCIACEVCVRVCPINLPVVDWVFNKELKKKELKHYSIDFGVCIFCANCVEYCPTNCLSVTEEYELATYDRHELNYDSVAMGRIPYKVTQDPMVTPIREFAYLPAGVMSGHDLPAGAQRAGERPEAIANTAKSSEN

SEQ ID NO: 34933 - protein, 459 aa, Nocardioides sp. JS614
MRSAHTVEQVRAAEAELMVRLPEGALMQRAAAGLAYAVLDLLGSAYGRRALLLVGSGDNGGDALYAGALLARRGVQVQAWLLSDQAHAGGVAALRAAGGRTITGGPDRPDVVVDGIVGIGGRGGLREHAVAALATVPDVPVVAVDTPSGVGVDTGELDGPHVTATVTVTFGTHKVAHLVDPAASACGAVHLVDIGLDLPEAPVESLQPEDVAALLPRPHGEVQKYQRGVVGVRAGSAQYPGAALLSVAGASSGLCGMVRYVGDADVADRVCETHPEVVGTGRVQAWVVGSGGGEHAGDELRAALADEVPVVADADALGHVDGSVPVPAVLTPHAGELARMLGVERTEVEARPLAHARHAAATYRCVVLLKGRHTLVATPEGRVRATTTGTPWLATAGAGDVLGGVIGALLAAGLTPYDAASVGSWLHGAAATLAARRGPLVAGDVARALPAAVRNLPGW

SEQ ID NO: 34934 - protein, 298 aa, Acidovorax sp. JS42
MTSPSAPLTGSIVALVTPMHDDGSVDYPALRKLIDWHIAEGTDCIGVVGTTGESPTVNVEEHCEIIRVSVEQAAKRVPIMAGCGANSTAEAIELARFAKKVGADSQLQVVPYYNKPTQEGQYRHFKAIAEAVGDLPMVLYNVPGRSVADMQHETVLRLTQVPGIVGIKEATGNIERAQWLIRDVPKGFAVYSGDDPTAVALMLCGGQGNISVTANVAPRLMHELCVAALAGDTRRAMEIQFRLMPVHKQLFVEANPIPVKWAVQRMGLCGGALRLPMTPLSQGNEAVVEAALRAAGLL

SEQ ID NO: 34935 - protein, 363 aa, Geobacter sulfurreducens PCA
MARKVGILTGGGDCPGLNAVIRGVVKSSIIRRGWEVVGIRDGFDGLLYNNRIVPLGLNEVRGILPRGGTILGTSNRGNPFSYPVEADGKTVLTDVSDEVVANIKKQGIDALVAVGGDGSLKIALELMNKGIPVVGVPKTIDNDLMETDVTFGYNTALETATDALDKLHSTAESHHRVMIMEVMGRYAGWIALESGISGGADVILIPEIPYDISAVCRAVDERRRRGSSFSIIVVAEGAFPRGGNRVVQKRADETNTIERLGGIGQYVARQLGDCLDMDVRVMVLGHLQRGGSPSTFDRCLGSRFGVAAIDLIEQEQYGRMVCLRGRDIKSVSIERAVRKLKLVNPGGQMVTAAEELGIVVGRR

SEQ ID NO: 34936 - protein, 552 aa, Geobacter sulfurreducens PCA
MPKNRDAARASLENLYRIFTVPEAPDSTLGAIDQAISGDVTGFLQTHIVAIERDLEDIEANFSSFSIPEEPTYVSEYTEFVKENLVAHSVHTASPAFVGHMTSALPYFMLPLARLMTALNQNVVKVETSKAFTPMERQVLAMLHHLVYRRDEDFYPSWIHNSRHALGAFCSGGTIANITALWVARNRLFAPNGAFRGIAQEGLARALKHRGADGIAVLVSERGHYSLGKATDLLGIGRDDLVKVKTDANNRIDLKALREECRRFQDRNTLPLALVGIAGTTETGNVDPLEAMADLAQELGCHFHVDAAWGGPTLFSDRHRSLLKGIERADSVTIDGHKQLYVPMGAGMVVFKDPTALSAIEHHANYILRHGSKDLGSHTLEGSRPGKAMLVHAGFSIIGRKGYELLIDMGIERARTFADMIKQHPDFELISEPELNILTYRYCPAAVQQTLHDVTDRERADINALLDLVCQLLQKFQREAGKTFVSRTRLHVARHDRELTVLRVVLANPLTTDEILESVLAEQCELVQLPEIQAVLQQVEELCTGLAKAASW

SEQ ID NO: 34937 - protein, 4682 aa, Nostoc punctiforme PCC 73102
MTSLNCATFVDLLSYRSLSQPNQIAYTFLVDGDTEEVKLTYQELDQKARAIAVELQSLKAAPGERALLLYPSGLEFIVAFFGCLYAGVLAVPVYPPRRNQRMTRLQAIVKDSEARFALTTASVLTNIQQGFAQEPELTALHCIAIDKIVSDASNWQKPPLEKSTLAFLQYTSGSTGTPKGVIVTHGNLLQNSEYIKSAFELTPNSVSVTWLPSFHDMGLIDGVLQPLYTGFPSVMMSPASFVQQPIRWLKAISDYKATHCGGPNFGYELCVSKITPEQRANLDLSSWCSAYSGAEPVRRETLEKFAATFKSSGFQAKFFYPCYGMAEATLMISGGGVADEPVYCVVDPKALEKNQIIQVSEDTPKVKHLVGCGYAWLDTKIAIANPQSLTLCAPEQVGEIWVSGSSIAKGYWNRPEQTKETFHAYLADTAEGPFLRTGDLGFLKDGQLFITGRLKDVVIIRGCNHYPQDIELTVEQSHQALKAGSGAAFSVDIDGEEQLVIVQEVERTYLRHLNLDEVVEAIKTSVSQIHELQVYAVLLLKTGSIPKTSSGKIQRHACRAGFLAGTLNALNTVDVVIEPQLQNPKESKKMQFSLLYFSSNEAEFSDEKYKLFLEGAKFADRNGFTAVWTPERHFHAFGGLYPNPSVLSAALTSLTKRIRLRAGSVVLPLHNPIRVVEEWSVVDNLSHGRVDLAFARGWNPNDFVLSPDTHADSKEVMFSGIQTVQKLWRGENISLPNGVGKQTDIKVYPLPMQRELSIWITCTGGKERFIEAGASGFNILTALLFQPVEELAQKIALYRETRKQHGYDPDSGQVTLMLHTFIGEDIKVVRNQVREPFIEYMKSSVNLWRHGSDDLDKLTETEKANLLAYAFERYFHTSALFGTPSTCLEMVQRLHEIGVDEIACLIDFGIDGNTVLASLDSLNNLRQLVNGVDEPSIKETIESYNQPKTDVLKQTNNAIINNSLPAFSIETSLKIPSRQNEEVQVPQGSLLQWIGEVIVQQIANSLGKKSSQISLDKSFYSFGIDSLKAVEIMETLGEKFGFSISPTLLFEYPTPTEFALYLIQEQKTQLQKYLLVNWEPAKLWAVNLERQKAVVLSNKLFNPASTKVVEPINDRIRAEDIAVIGMSGRFPQSPDLQSFWELLSQGKNAIAQVPSLRWNLSDWYDKNPGAANKTYSCWGGFIDHIDQFDPLFFQISPREAELMDPQQRLFLEVAWEALENAGYSPESFAQSQVGVFVGCSNNGYYQRIAPALNTSDYSAGIGNQNAIIANRVSFLLNLRGPSVLIDTMCSSSLVALHMACRSLQQGECTTALAGGVNLLLSPEYYVGMSRMKMHSPNGRCATFDSQADGIVLGEGAGALLLKPLSQALKDGDRIYAVIKGSAVNHDGRTNGITAPNSRSHAEVICQALDAAGISADTISYVEAHGTGTSLGDPIEVEGLTKAFRKYTERKQFCKIGSVKTNIGHLECAAGMAQLLKVILAIQHRQIPANLHFQQPNPLIPFAETPFQVNTKLCSWESSGLRRAGISSFGIGGTNAHIVIEEAPPLEPVIPEIERPKHLLTFSAKTENALVQLVSRYETYLAANLDLPLGDICFTANTGRSHFQHRLSAIATSTSDLHQRLLNFISQQEVTGIKIGRIHENTPPKIAFLFTGQCSQYVGMGSQLYETQPTFRKILDYCNEILRPYLKEDLLKVIYPQPGETSLIDQTAYAQPALFALEYALVQLWKSWGVEPSVVMGHSVGEYVAACVAGVFSLEDGLKLIAERSRLMQSLPQTGAMVAVFACEADIWAITEIDLAEVAFAPRLEEKPSVGIAAYNGPQNTVISGEREAIERICANLKAAGIQTKKLVTSYGFHSPLMEPILAEFRQVAATVTYNAPQIDIISNVTGQLIGEAINPEYWCDHLISSVQFAKSIQTLHTADYEIFVEIGPKPILLGMGSKCLLGKGLWLASLRQGREDWQQILESLGELYVHGVQVEWSGFDRDYFRRRVQLPTYPFQRKRYWIDAPVSTSDNKFDTQKSLPSQLSTSQFDTEIAPPLKALQPKVDTTPQIKRLDLIVSKLHSYIVNLLKAEPSEVDFYAPFLEIGADSLMLIDAINYIDITYRIKITISQLFEQLTTIYAVASYIDQNLLPEPIFVDVQLPEPVYQTQPPTPQSPPLAFVESNGNGHSHTQQPTLKSTVQQTAGETAVERIMLQQLQVMSQVMSQQLDVLRATGNVLSSNGNSHLASSPPTPQNQVVKETGIAINQVQSNQTVTKNFSPIEPPPPREINQPQQQHLKTLISNYTQKTQSSKQYAQTYRSFLADSRAVAGFRPSTKEMVYPIIGERAKGARCWDIDGNEYVDITMGFGVLLFGHAAPFITAAVDEHLQQGIQIGPQANYAGEVAALISELTGMERVTFCNSGTEAVMTALRLARTKTGRSKIAIFAGSYHGHFDGILAKESLDGLSTVPIAPGITANAVEDVLVLDYGEPKSLEILQAHAAELAAVLVEPVQGRNPDLQPREFLQQLRQFTAVAGVALIFDEVLVGFRIHLGGAQAWFGIEADIVTYGKIVGGSIPIGVVAGKASYMNGIDGGLWNYGDASYPQVEKTFFAGTFNKNHLGMAVARAVLKYLKSQGPALQQHLNQRTSDLAIALNTYFEQEEVPIKIVYFGSLFRFAFSGNFDLLFYHLIYKGVYIWEGRNCFLSTAHTDEDIEYVIQAVKHSIEEMRAVGFIPKRSPKLSAGSNGNGTVKTTQNGVLTKPVVTESVPVLEAIAREGKLPLSLAQQRLWFLDQLEPNSAFYNIPAAVRLQGQLNVAILEQSFREIIRRHEALRTNFITLDGQPHQVIHPNLNWQISVVDLQHLPVSKRENESQKIAIAEAQRPFNLETESLVRATLLVLSQTEYILQVTMHHIVSDGWSMSILIEEFTALYTAFSQGQPTPLVELPIQYVDFAVWQRKWLQGTVLQSQLTYWKKQLSGAATILSLPTDRPRPTMQTVRGAHQPFALSFELTEALKALSKKEGVTLFMTVLAAYNILLYRYTGQADILVGSPNASRNRPEIQGLIGYFLNILLLRADMSGNPSLREFLKQVRKTALGAYAHQDVPVEELIEALQPVRDLSYTPLFQVMFILDSATPISEMQLPGVTWSSMTVENYTSKLDLTLTLENTAQGLVGEWEYNTDLFEAATITRMAEHFRNLLEGMVANPEQRIAELPLLAAWERQQLLVEWNNTQREYPHKCIHQLFEEQVELTPNAVAVVFGNQRLTYQELNSRANQLAHYLQELEIKPDTLIGICLERSLDIFVGILGILKTGAAYVPLDPDYPQERLDYMFSDSQVSILLTAKKLVTQIPRHSAQLVYLDADWDVIATKSQQNLASEVKPENLAYVIYTSGSTGRPKGVMVPHRSLVNAYFGWEQAYELRTKTSSHLQMANFSFDVFTGDLVRGLCSGAKLVLCPREWLLTPELLYKLMQEEKVDCAEFVPAVIRNLIAYLEKTKQNLDFMRVLAVGSDSWYVKEYEEFQRFCGLETRLINSYGVSEATIDSCYFESTNVKLPVEALVPIGKPFPNVQIYILDSDLQPVPIGVLGELYIGGAGLAHGYLNRPDLTQERFIANPLSNEPTSRLYKTGDLARFLADGNIEFLGRIDNQVKIRGFRIELAEIEAVLRQYPTVSQTVAMAREDIPGDKRLIAYVVGNQESVPVISDLRRFLKEKLPEYMIPAAFMVLQTIPLTPNGKVNYRELPAPEISRAGLEASFIAPRNPIEEILAQIWVDVLGVKQVGIHDNFFELGGHSLIATQLISRIRTALKVELPLRSLFEASTVADLAERIALQQDAPHLNAPSLQSVVRDGQLSLSFAQQRLWFLNQLEPNSALYNIAGTARLQGELNVIALEQSLGEIIRRHESLRTNFITQEDGQAVQIIRPDAAFTMPVVDLRQLSASEQEIEIQRLATVEAQQAFDLANQLLIRATLLVLSKTEHILLFCMHHIVSDGWSMGVFVQETAAIYGAFSQGQPTPLPELAIQYVDFAVWQRQLLQGEIKESQLAYWQQHLAGATALLELPTDRPRPAVQTFRGANQSFVLSFELTGSLILLSRQEGVTLFMMLLAAYDTLLYRYTGQTDILVGSAIANRNHNEIEGLIGFFVNTLVFRTDVAGNPSFRELLNRVREVALGAYSHQDLPFELLVETLQPERNLSYTPLFQVAFVLQNAPMSEIELPGLTLSSMTPDNKTAKFDLTLTLENTATGLMGVWEYNTDLFEASTIERMTGHFQTLLESVVIQPEQRIGELPLLTAKEQYQLLEEWNHTQKDYLGNICIHQFFEMQVERTPDAVALVFENQQLTYRELNQQANHLAHYLRTLGIRVDVLVGLCVERSLEMLVGLLGILKAGGAYVPIDPEYPQERISHILSDSQVSLLLTQHRLVARLPEHQATLVVIDESWEQIIQHSQENPISGVKDSDLVNVIYTSGSTGKPKGVMVKHSGLCNLAQAQIDLFDLLPSSRILQFASFSFDASIWEVVMALGSGARLYLGTKESLLPGLELIELLRDYGITHITLPPSALAVLPQAELPALQNIIVAGEACAPDLIKQWSVGRRFFNAYGPTETTVCATVAECGNGERSDKPPIGRPIPNTQAYILDSYLQPVPIGVPGELHIGGAGVAQGYLNRPELTTEKFILNPFEDSAALASPRASAEGSRLYKTGDLARYLPDGNIEY

SEQ ID NO: 34938 - protein, 563 aa, Oryza sativa (japonica cultivar-group)
MERMSRVAVAVLLLLCLQLQLGISGGGGGGHGARRGVDPCQEVIIIFAAAAAAAAEQAGRQQGRMAVDVVDAVEPVRTPDAAAAAAAAQGLAAMARHAAASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKKVLLLPPFVNITIIIVYFIVNWFIIKCNLNICKEKLNKDNDNEPVEGEPQELCEPSWLLRGGAAVHEDDGVRVRPKRHTIRASPRKHEKWQLTLTVGNAARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 34939 - protein, 887 aa, Schizosaccharomyces pombe
MSSKDISSKSPSGNDALNDKKGTKTSETNDRNSTNNTKERDELEDLSEEDLQLKNDLELLVQAVQDATPELEGSSLTQLKEIIRTSTSSMTAVPKPLKFLRPHYFTLVKIYDSWPQSPQKTQLADILSVLGMSYSNTSKHESLKYRLQGVTTDPSLWGHEYVRHLASEIEEEFASRQEEEAPTDDLMELALTIVPFFLTHNAEADAIDLLQELGAIEKVVPFVELDNASRVCLYITSCVNLLPFPEDVAMLRTAHAIYRKFDQLTQALNVAIRLDDMSLIKEDCEAATDPLLKKQMSYMLARQQIPMDMGDEELNDALNNTHLSDHFHYLGKELNLMDPKVPEDIFKTHLEVARTGLGASGVYSAKQNLANTFVNALVNAGYSNDRLILVDDEKTSWIYKNKESGLISATASIGLLQLWNVDMGLSLLDKYLYSSEENTKAGALLGIGVTNVAVRNEADPAMAILSEYLETGSVKLRASAILGLGLAYSGANREDLLDMLSPIVTDTDCPMQLSCLAALSLGLIFVGTCNGDVASTILQTLMEREESAQNDQWGRFMALGLALLFNGKQDLADATVETLKAIEGKIARQAEILVDICSYAGTGNVLHIQKLLHICSEPPSDDAKESETTIQTFAALGVATIAMGEDIGAEMVLRHFDHMMHYGEPSIRKAIPLALGLLSASNPQMRIFDTLSRYSHDNDLDVAYNAIFAMGLVGAGTSNARLAQLLRQLASYYHKESNALFMVRIAQGLLYLGKGTMTLNPYHTERQILGQTAFAGLMTVVLAMLDANTFVLDTSHWLLYAITLAIRPRMLITLGEDGQYLPVSVRVGQAVDVVGQAGRPKVITGWVTHTTPVLLHHNERAELATEAYTTFDFVGRYCYFKKKYGGH

SEQ ID NO: 34940 - protein, 666 aa, Rhodopseudomonas palustris CGA009
MNIRSNPETTRAAVTTGALPSSKKIYATPASAPDLRVPLREIILSEGAGEPNLPVYDTSGPYTDPTVVIDVNKGLPRPRTEWVKQRGGVEQYQGRDIKPEDNGNVGAAHAAKAFTAHHQPLRGLDSPPPRGEGSGVGGATPAAFARGADHPPMITQYEFARRGIITKEMIYVAERENLGRKQQLERAEAALADGESFGAAVPAFITPEFVRDEIARGRAIIPANINHGELEPMIIGRNFLTKINANIGNSAVTSSVEEEVDKMVWAIRWGADTVMDLSTGRNIHTTREWILRNSPVPIGTVPIYQALEKCEGDPVKLTWELYKDTLIEQAEQGVDYFTIHAGVRLQYIHLTASRVTGIVSRGGSIMAKWCLAHHKESFLYTHFDEICDLMRKYDVSFSLGDGLRPGSIADANDRAQFAELETLGELTKIAWAKGCQVMIEGPGHVPMHKIKINMDKQLKECGEAPFYTLGPLTTDIAPGYDHITSGIGAAMIGWFGCAMLCYVTPKEHLGLPDRNDVKTGVITYKIAAHAADLAKGHPAAQLRDDALSRARFEFRWQDQFNLGLDPDTAQAFHDETLPKDAHKVAHFCSMCGPKFCSMKITQDVRDYAAGLGDNEKAALYPVGHAGMTISGTIEDGMAQMSAKFKEMGSSVYLDAEKVKESNKALS

SEQ ID NO: 34941 - protein, 204 aa, Oryza sativa
  misc_feature (83)..(83): Xaa can be any naturally occurring amino acid
AAEQVSVEVAIAAGCWHSLSPCQCPNQGFGTANHQAIFALQHPSVRATPNSSFHGSESSTPCPARQQEAPVNLESSSESSEDXEVRRATRTNWTEEENLRLISAWLSNSVDPIDGNDKKGEYYWKDVADEFNNNRPTNGHKRTVKQLKTHWGNVKKDIGKFCGVYAQVRRTCTSGHSDDMIMEKAHLWYKNQSNQKKPFTLEYM

SEQ ID NO: 34942 - protein, 548 aa, Coccidioides immitis RS
MEQSAWKRHFSGSKIIFYILFHGMHLGVFIFGWYKQAGDIRLAPLNTLQFSVWISRGAGLVLSVDGLLILLPMCRTLLRVVRPKFRWLPLDESIWFHRQVAYSLLFFSLLHTLSHYVNFFNVEKSQVRPETAVQIHYTQAGGITGHIMLLCMLLMYTTAHARIRQQAFETFWYTHHLFIPFMLGLYTHATGCFVRDTVDPFSPFAGKDFWDHCIGYEGWRWELWGGGIYLIERLYREIRAARETQITKVVRHPYDAMEIQFSKPSMKYKAGQWLFIQVPDISRGQWHPFTITSCPFDPYISIHIRQVGDWTRALGNRLGCGPQQAKDIDGLDPLGMYEIAVQNGQTMPKIRIDGPYGAPAEDVFDNEIAILIGTGIGVTPWASILKNIWHLRAGPNPPTRLRRVEFIWICRDTSSFEWFHALLSSLESQSAADSSTGQQFLRIHTYLTQRFDQDTAANIMLNSVGQQVDPLTELRTGTKFGRPDFKTFFSAMRTGLVDQSYMPGLDASLRTDVGVYFCGPNVAAKEIKKAAKECTTREVRFRFWKEHF

SEQ ID NO: 34943 - protein, 397 aa, Aquifex aeolicus VF5
MLRKKTLRDVDVKGKRVLVRVDYNVPLDEQGNIVDDTRIRASLPTVEYLLDANAKVILMSHLGRPKNRDPKYSLAPVAKRLSRYINKEVKLAPDCVGEEVKRIVNSMKEGDVVLLENLRFHKEETECDENFARELASLGEVYVADAFGTCHRKHASVYLVPKFLKPAVMGFLLEKEITYFEKAMVAPQRPVVAILGGAKVSSKLEVIKNLIRRVDKLFIGGAMAFTFLKAMGYKVGNSLVEDDLQDVARDLIDVAKKLEIKLYLPVDFVIGQEVSENTPTKVVPWQEIPDGWMGLDIGPVSVELVKEIISDAQTIVWNGPMGVFEIDKFKHGTIEVAKLLAQSSALTIAGGGDTDHAIHKAGVYHAFDFVSTGGGAFLELLAGKELPCLVNLDDKEA

SEQ ID NO: 34944 - protein, 117 aa, Triticum aestivum
MAGSRRALRFVLLLPAILGALLPPAAAGPPKVSLALYYESLCPYCSRFIVTRLAGIFDSGLIHAVDLLLVPYGNAHVHGANNTISCQHGPDECLLNNVEACAIDAWPDLNVHFGFIN

SEQ ID NO: 34945 - protein, 215 aa, Debaryomyces hansenii CBS767
MKLFTTDHYFNYPWEQVTAANWQKYPNELSTHVESVDIINREIDVERKVLRTERLIGCKQSIPRWLVYLVGALDQSYVREVSEVDLVNKTLVMKSHNLTMNHLLLVNETVVYKPDADMPQSRTSFNQEAEITAYASIKKICEKVEEWSVERFGQNAKVGKLGFESVLETLNKKWEESGVFVSDVSFSIIKDINQVSDRTHSVLSEVTKLGNVFSK

SEQ ID NO: 34946 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 34947 - protein, 750 aa, Leptospira interrogans serovar Lai str. 56601
MALKPKEHIMNILYSFPRVSWDNLRHDFSAGLVVFLISLPLCIGIGFASGAPIVSGLISGIVGGIVISLISKSPLSVSGPAAGLTVIVFDSIKTLGNFNDFLLALCLAGIFQIILGFLKAGILSNFFPSAVVKGMLAAIGVVLILKQIPHAIGYDIDYEGDMGFFQKDRENTFSEILTAFYRFTPGAIILFTVALVLILIWEKFKLHEKFIIHGSLVAIVTGVLLNEMFRIFELGIVVSGEHLIQPIQLNGALDLFLDDYSPNFSQWKNQTIYFIAIKLCLVMSLETLLNLDAIEKIDPQRRIVSKNRELVAQGTGNLCSAILGGLPITSVIIRSSANLHAGARTRFSSFLHGLLILVSVILIPVWIAKIPLASLAAVLLVVGYKLTDYKILQTQYKKGMDQFLPFISTLVGIVFTDILVGIGIGCLFSVFFIMRRNILNPYQFNKKEMAYGVEVKIDLSEDVSFLNKSSMLYKLDKVPDNAHLIIDGSRSKYIDPDVLEIIEDFKIVARSRNIKLEIIDVTSSYEKIQNKPLDLVLQQDYQKLFENNRIWVEEKLSKDPDYFKNLALGQTPQYLLISCSDSRLSVNEMTGTSAGELFVHRNIANLVIDTDMNLMSVLQYSVEVLKVKHIVVCGHYDCGGVKTAIDGKYHGLIDAWLRHIKQVYRMNRKELSGILDENEKHERLVELNVREQVYNLCMTTIVQNAWSRGNDLQLHGWVYDLKQGKILDLNIDIDKDFRDYDIFRYQFETH

SEQ ID NO: 34948 - protein, 123 aa, Oryza sativa (japonica cultivar-group)
MAPIVIASLATSVAPFQGLKSTAGLPVSRRSTNSGFGDITNGGRIKCMQVWPVDGKKKFETLSSPGYYDGRYWTIWKLPMFGCSDNSQVIKELEEAKKAYPDAFIHIVGFDNVRHVQCISFIA

SEQ ID NO: 34949 - protein, 261 aa, Triticum aestivum
NKFVQKSRLVPVRNSRDIVDPRVRNQNCATSNVDSSSRRKGMVLPFAQLSLSFNAVKYSVDMPQAMSAQGVTDDRLVLLKGVSGSFRPGVLTALMGVSGAGKTTLMDVLAGRKTGGYIEGDITISGYPKKQETFARISGYCEQNDIHSPHVTVYESLAFSAWLRLPSEVDLVTRKMFIEEVMELVELTSLRGALVGLPGVNGLSTEQRKRLTIAVELVANPSIIFMDEPTSGLDARAAAIVMRAVRNSVNTGRTVVWPYPP

SEQ ID NO: 34950 - protein, 405 aa, Frankia sp. CcI3
MPDQTATPARPRVSAKAATFTESVIREMTRLALAHDAVNLAQGFPDFACPPQLKEAAKAAIDADVNQYAITWGAAEFRAAVAAKVAGTYPGWSVDPDTEICVTCGSTEAMIAAMLALVDPGDEVIMFEPFYENYGPDAILSGARPKLVRLHAPDWTIDEAELRAAFSDRTRAIVLNTPHNPTGKVLRRAELDLVAELCQRHDALVFTDEIYEHIHYLGPGGHIPPATVPGLEDRTVTINALSKTYAVTGWRVGWTIAPAAYTSAIRKVHDFLTVGAAAPLQAGGVAAMNLPQTYYVDLARQYRERRDLLCAALARTGFTFREPDGAYYVMCDTRALDPAGDDVAFARRLATGIGVATVPGSSFFADPADGRHIIRFGFPKKLTTLEAAARRLARLTPAATPATPG

SEQ ID NO: 34951 - protein, 517 aa, Oryza sativa (japonica cultivar-group)
MRIPRRKGGAGPLVGAPSRRAQVAAVFALALLLGVSVLYDSAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSKANPRKFADCIHWCLPGLPDTWNEFIYGHIVSSPQRRPVEPIENQPQR

SEQ ID NO: 34952 - protein, 506 aa, Crocus sativus
MVSTGCSGNGAKGTNGGIVVPEIKFTKLFINGEFVDSVSGSTFETRDPRNGDVIANIAEGDKEDVDLAVKAAREAFDHGKWPRMSGYERGRIMMKFADLIEAFIEELAALDTLDAGKLLSMGKAVDIPAAVHIIRYYAGAADKIHGYTLKLSSELQGYTLKEPIGVVGVIIPWNFPTTMFFLKVSPALAAGCTMVVKPAEQTPLSALYYAHLAKLAGVPDGVINVVPGFGPTAGAALSSHMDVDSVAFTGSAEIGRAIMESAAKSNLKNVSPELGGKSPMIVFDDADVDMAVSLNSLAVFFNKGEVCVAGSRVYVQEGIYDEFVKRAVEAARSWKVGDPFDQSRNMGPQVDKDQFESVLKYIEHGKSEGATLLTGGKPAADKGYYIEPTIFVDVTEDMKIAQEEIFGPVMSLMKFKTVEEGIDCANNTKYGLAAGILSQDLDLINTVSRSIKAGIIWVNCYFGFDLDCPYGGYKMSGNCRESGMDALDNYLQTKSVVMPLHNSPWL

SEQ ID NO: 34953 - protein, 212 aa, Brassica napus
MATQGQVITCKAAVAYEPNKPLVIEDVQVAPPQAGEVRIKILFTALCYTDAYTWSGKDPEGLFPCILGHEAAGVVESVGEGVTEVQPGDHVIPCYQAECRECKFCKSGKTNLCGKVRSATGVGVMMNDRKSRFSVNGKPIYHFMGTSTFSQYTVVHDVSVAKIDPKAPLEKVCLLGCGVPTGLGAVWNTAKVEPGSNVAIFGLGTVGLAVAE

SEQ ID NO: 34954 - protein, 322 aa, Limonium bicolor
MKTTLILTAAALPFLLLISFSSAEQCGSQAGGAVCPNGLCCSKYGWCGSTDTYCKDGCQSQCGGTTPTPTTPTPTPTQGGDVSSIISQSNFDEMLKHRNDNACSGHGFYTYAAFISAAQSFPGFGTTGDTDTRKRELAAFLGQTSHETTGGWAAAPDGPYAWGYCFVQEQGASGAFCTSPEYPCAPGKQYYGRGPIQLTHNYNYAQAGTAINQDLINNPDLVATDPTISFKTAIWFWMTPQSNKPSSHDVITGKWTPSSADSAAGRVPGYGVITNIINGGLECGKGSIAKQEDRIGFYKRYCDVLGVGYGNNLDCNSQRPFA

SEQ ID NO: 34955 - protein, 215 aa, Glycine max
MVSFHKALAESTPKPEIHAEFEASSKKRKWEEPLTEGFFKDQIEKRKSVFDIELHPETPFSSDKWRQYLTIQSGQIQLCNTRTTTENPKKSSEEPPSSHHMSLNLELNLMCESPRKKEEGYGYEMNEKKSSGSSPGGLSEREDLCKKDSDGKILSPSWLSSSEDDYKEMVATVCMRCHMLVMLCKSSPSCPNCKFMHPPDQNPSKFLKRRCSLFC

SEQ ID NO: 34956 - protein, 436 aa, Methanopyrus kandleri AV19
MEETGVKDVRDLCEKFLDFKREKERLEELLKEYFKRLEELERKLRAHEEKLRIEARRRKTLEKELEMERDEKAELREELRRKEVMIEKLRSDLQRMKKPPLIVGTVEEILDDGRVIVKSSTGPKFVSNVSPTVDRNELEPGANVALNQQSMAVVDVLPSEKDSRVLAMEVDESPDVSYDDIGGLDEQIREIREVVEKPLKEPELFEKVGVEPPKGVLLYGPPGTGKTLLAKAVANHADATFIRLAAPELVQKFIGEGARLVRELFELAREKAPSIIFIDEIDAIGARRMRDATSGDREVQRTLTQLLAEMDGFDPLDDIKVIAATNRKDILDPALLRPGRFDRHIKIPLPDEEGRYEIFKIHTRDMNLAEDVDLQKLAKITEGASGADIKAICTEAGMMAIREDRDIVTMDDFLKAVDRVMGKKEEESGEFKRAYH

SEQ ID NO: 34957 - protein, 589 aa, Oryza sativa
MAVAARVVEEEDPDVVQMMKRRDDEEEVVGEAWDYKGRGAIRGSTGGWRSAAMILCVELNERLTTLGVAVNLVTYLTGTMHLGSAASANAVTNFLGTSFMLCLLGGFLADTYLGRYLTIAIFTAVQAAGMAVLTISTAAPGLRPPPCSSGGSGCAAANGTQLGVLYLGLYMTALGTGGLKSSVSGFGSDQFDESDGGERGSMARFFSWFFFFISMGSLLAVTVLVYVQDKVGRRWGYGICVVAILTGLLFFLAGTTTYRFKKLLGSPLTQIAAVTAAAWTNRNLPLPSDPSMLNHDDSAHTTAKPNQKLPHSKQFRFLDHAAIVETTTAEAKKRKRWAACCTVTEVEEVKQLVRMLPTWATTILFWTVYAQMTTFSVSQAAVMDRRLSTSFVIPAGSLTVFFVAAILLTVPLYYRLLAPLVRRLTANPRYDLSPLHRIFVGLLLAALAMVAAALTERARRDAAVTLSVFYLLPQFLLVGAGEAFTYIGQLDFFLRECPKGMKTMSTGLFLSTLSLGFFFSTALVTVVHKVTAESRRPWLADNLDEGRLDNFYWLLGGISVVNLAVFVAAAARGYVYREKRLADAGIIHI

SEQ ID NO: 34958 - protein, 446 aa, Methanopyrus kandleri AV19
MRVVVVGGGAAGVVAARTAREHGADVVLISADEHIAYSPCAIPFVISGEIERPEDILMRDPTHYERLGIDVRLGVRVEEVDPEEKVVTTEDGDTVEYDSMVLATGGEPLVPPIEGSELDGVFTVRRFSDIEPLLRAVQESERAVIVGAGPIGVEMAYALHERGLEVTLVEMLDRVLPQFLDDDVAAIVQERMEKEGVRVLLGSPVEAIEGDDRVEAVVVNGEEIEADLVVMAAGVRPVTDLFESIGASVLPFGVEVDPALRVKREDGGVFDDIYAAGDCVADWCPITGERVPSQLGTVAVRQGKIAGKNAAGGPRATWMGTLNTAVIRVFDLEAAGAGLTQTRAEELGLEVVSATVETTTRARYYPGGEPIAVKLIADADTHRIVGVQSVGGERVRERVDGVALAIRLAAKVEDLLSWDYSYSPPVARVIEPIYEAAELLREELHS

SEQ ID NO: 34959 - protein, 363 aa, Arabidopsis thaliana
MLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPIPYTANLERLALPQIEDIVRASKRACYRSK

SEQ ID NO: 34960 - protein, 638 aa, Oryza sativa (japonica cultivar-group)
MRSSWADSAANAEESAPAAAANHGNSRLPRSSYVPPHLRGQAAPAAPAQAGALPSAAAAAQPSVGQPGVVGGPRWAGIVNGGGGGGGGSVGGSRQGFGAGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQEREYALRSFKSGATPILVATDVAARGLDIPHVAHVINFDLPNDIDDYVHRIGRTGRAGKSGLATAFFNESNTPLARPLSELMQEANQEVPQWLERYAARSSFGGGGGRNRRSGGGARFGGRDFRRDRGSGGGGYGGGGGGYGGGGYGGGGGGGGYGGGSSYGGGGQGFSSAWD

SEQ ID NO: 34961 - protein, 200 aa, Zea mays
KVSSKIGVIESLLEKCDILLLGGGMIFTFYKAQGHSIGSSLVEDDKLELATSLLRKAKEKGVSLMLPFDLVVADKFAPDASSQVVPASAIPDAWMGLDIGPDSISAFSSALETTQTVIWNGPMGVFEFDKFAVGTKAIAKKLAELSGKGVTPIVGGGDSIAAVEKVGVADSLSHISTGGGASLELLEGKELPGVAALDEA

SEQ ID NO: 34962 - protein, 121 aa, Aquifex aeolicus VF5
MQEKDCIFCKIVRGEVPAKKVYEDDKVLAFHDINPVAPVHILIIPKKHIMGIQTLEPEDECLVGHMFYVARKIAEDLGIAPDENLNKGYRLVFNVGKDAGQSVFHLHLHLIGGREMSWPPG

SEQ ID NO: 34963 - protein, 387 aa, Zea mays
MIPSVRISPGSAAFSGSSLRLKLHSIPSISSLKPSKYVVSSLKPLYLAPLDGPHTSELKSWRQPLEFRCAASAADDKESKTQVVPVQLEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFTVLVSKFLLGETFPVPVYLSLLPIIGGCALAAVTELNFNMVGFMGAMMSNLAFVFRNIFSKRGMKGKSVSGMNYYACLSIMSLVILTPFAIAMEGSQMWAAGWQKAVAEVGPNVVWWIAAQSVFYHLYNQVSYMSLDQISPLTFSIGNTMKRISVIVSSIIIFHTPVRPVNALGAAIAILGTFLYSQAKA

SEQ ID NO: 34964 - protein, 335 aa, Zea mays
MQNLLSGASHETLPDSFIFPAEQRPPASAAAVALPVIDLSGPRDEVRRAVLEAGKELGFFQVVNHGVPEQVVRDMEACCEEFFRLPAEDKAAFYSEDTSKPNRLFTSTTYGTGGERYWRDCLRLACGFPVAADARDAWPDKPDGLREAAERFVASTRRLNLELLRLLCEGVGLRADYFEGDLSAGDVVVNVNHYPPCPDPARTLGLPPHCDRNLITLLLQGSVAGLQVSYRGDWIRVQPVPGAFVVNFGHQLEIATNGLLKSIEHRAVASAAVPRTSVATFIMPTDDCLVAPAAELAGGGDKPPPRYRAVTFRDFMKVYKTVGARRESVEKAFKI

SEQ ID NO: 34965 - protein, 301 aa, Mycobacterium sp. JLS
MPNTHIHAFHPDLRSVARYIPRQVITPVTLPVVRMVTRLQGKRTPKDIEELTLSSGVRVRLFRPTGVPVPAPALLWIHGGGYVIGTAAQDDELCRRFCRELGITVASVDYRLAPEHPYPTPVEDCYDALTWMARLPAVDPKRVAIGGASAGGGLAASLALLTRDRGEIEPVAQLLVYPMIDDRTVERQGLDHPGHRLWNQASNKFGWSAYLGDADPDVAVPARREDLAGLPPAWVGVGTLDLFHDEDLAYAERLRAAGVPCQVEVVQGAFHGFDGVLPKADVSRAFFRSQCDTLRQAFASG

SEQ ID NO: 34966 - protein, 868 aa, Pisum sativum
MATKVFGIFDKGQKIKGTVVLMPKNVLDFNAITSIGKGDVFDAAGNLVGGLTSIVGGAIDTATAFLGRNVSMQLISATKTDASGKGLVGKETFLSNHLPQLPTLGARQDAFSIFFEYDANFGIPGAFYIRNYTSAEFFLVSVTLEDIPNRGSVQFVCNSWIYNFKSYQKNRIFFTNDTYLPNQTPAALKAFREEELQNLRGDGTGERKEYDRIYDYDVYNDLGNPDSGDKLARPVLGGSSTFPYPRRVRSGRKPTRKDPKSEKPGAIYVPRDENFGHLKSSDFLMFGIKSLSHDVLPLFQSVIFDLNFTPNEFDSFDEVRGLYEGGIKLPTDIISKISPLPALKEIFRTDGEQVLKFPPPHVIKVSKSAWMTDEEFGREILAGVNPCVIRLLQEFPPKSSLDATIYGDQSSTITKEHLETNLGGLTVEEALNGKRLFLLDYHDAFMPYLERINISAKAYATRTILFLKDDGTLKPLAIELSLPHSNGIQYGAESKVFLPAEEGVESTIWLLAKAHVVVNDSSYHQLMSHWLNTHAVMEPFIIATNRHLSVLHPINKLLYPHYRDTININGLARQSLINAGGIIEQSFLPGPNSIEISSTVYKNWVFTDQALPADLIKRGLAVEDPSSPHGLRLVIEDYPYAVDGLEIWDAIKAWVQDYVSLYYPTDDTVQKDIELQTWWKEAVEKGHGDLKDKPWWPKMQTVQDLVQSCSIIVWTASALHAAVNFGQYPYGGYILNRPTLSRRFIPEKGTPEYDEMVKSPQKAYLRTITPKYQTLVDLSVIEILSRHASDEVYLGERDNKNWTSDSRAVQAFAKFGTKLTEIEGKIHSRNNEPGLRNRYGPVQLPYTLLLRSSEEGLTFRRIPNSVSI

SEQ ID NO: 34967 - protein, 478 aa, Acidovorax sp. JS42
MTYPDTRLFIAGQWQDAESGKTIAVHNPATGQEIGRVAHAGIADLDRALAAAQKGFEVWRDTPAIERAKTMRRAAALMRERADAIAAILTQEQGKPRAEARVEAMAAADIIEWFADEGMRVYGRIVPSRNLAVRQMVVKDPVGVVAAFTPWNFPINQVVRKLGAALAAGCAVLVKAPEETPASPAELIRAFADAGVPAGAVGLVYGNPAEISNYLIPHPIVRKVTFTGSTPVGKQLAGLAGQHMKRVTMELGGHAPVIVCEDADIELAVKASGGAKFRNAGQVCISPTRFLVHESVRADFVAALTRHAQGLKVGDGLAEGTQMGPLANPRRVAAMADLLADAVQQGATVRTGGERLGEVGNFFAPTVLDNVPTHARIFNEEPFGPVAAVQGFTQLEAAIAEANRLAYGLAGYAFTRSLKNAHLLSQRVEVGMLWINQPATPSAELPFGGIKDSGYGSEGGPEALEACLNTRAISITHV

SEQ ID NO: 34968 - protein, 407 aa, Mycobacterium sp. JLS
MTVRPDTRYPGPTLWSRARWLLNAKPADHMLAMSVASASLPVIGKHLEPLGALAAMGVWGYRQMPELLSASAKSWFDPGNAEVRQRERDMTHEVSHQALRGVVPASDLAIDWPAPEKVPPLWKTFEHRRNVHKSSVRYGPLPSQLLDVWRPKELPAEPAPVLVFVPGGAWVHGSRLLQGYAMMSHLAEMGWVCLSIDYRVAPHNPWPAHLHDVKTAIAWARANVDKFGGDRNFVAIAGASAGGHLAALAGLTINDPEMQCELPEGSDTSVDAVVGIYGRYDWEDRSTAERARFVDFLERVVVRRKISRHPELFRKASPMAQVHSEAPPFLVIHGSGDSVIPVWQARSFVDKLKAKSRSVVSYMELPGAGHGFDMIDGARTGSMATAIGLFLNQIHKNRTLVGAREVI

SEQ ID NO: 34969 - protein, 581 aa, Mesembryanthemum crystallinum
MVEGGVVKVDKTEFTECFRTVGKTPYIMRLAFSAGIGGLLFGYDTGVISGALLYIKEDFKEVAQKTWLQETIVAMAVAGAIVGAGLGGFLNDKFGRKPAMIVADILFLTGAIIMSVAPAPWVIIIGRIVVGLGVGMASMTAPLYISETSPAKIRGALGATNGLLITGGQFVSYLVNLGFTRVKGTWRWMLGVAAVPAAIQVVLMLTLPESPRWLYRQNKISEAEEILGRIYPPEQVKEEMDSLKTSIENEMADRKAVGEGNAFVRAKRAWDNKVVRRGLIAGISVLVAQQFVGINTVMYYSPTIIQLAGFASNSTALALSLVTSGLNAVGSIVSMMFVDRFGRRRLMIISMFAIITCLVVLSGLFYGAAQAAPKISQLESSHFGANSTCPAFASATSPDRWNCMTCLKASDCAFCSNSASEFHPGACVAQTSTMKNACLGEKRIYFTEGCPSKFGFMAIIVLGLYIITYSPGMGTVPWILNSEIYPLRYRGICGGIGAVTLWCANLIVSETFLTLTEALGSSGTFLLYAGFSLIGLIVIFLLVPETKGLPIEDIEKMLEKGFWPSLCGGNKDKDNKEEQQA

SEQ ID NO: 34970 - protein, 414 aa, Mycobacterium sp. JLS
MARRRFPLLRAVAELVNAANGVRPLGRDGYITLPVFAFGWPTTEAAPLYLAGSMLDAGRRGLRGDFRGGRGRIALLVTAVAWALLGVIIRRNVTSKRYFDEPLRETLGDDYEMVAARAQPARPRNLIGVPPNELTRRRYVEKAGTVQYGPHPKVNFADIWRRADLPRDGRAPVLLQVPGGAWAIGMRRPQAYPMLSHMAEQGWIGVSIDYRVSPRHTWPDHIVDVKRALAWIKEHIAEYGGDPDFVAITGGSAGGHLASLVALTPNDPQYQPGFEDADTSVVAAVPIYGRYDWFSVEGPGRREFIAFLQKFVVKKRILEHRQEYLDASPITRVRPDAPPFFVLHGQDDSIIPVGEGREFVDALRAVSRSVVAYAEIPHAQHAFDFFGSPRAHYTANAVDQFLSWVNATRARAVA

SEQ ID NO: 34971 - protein, 441 aa, Scutellaria baicalensis
MAVLAKFISKNHPSVPIIIISNAPESAAASVAAIPSISYHRLPLPEIPPDMTTDRVELFFELPRLSNPNLLTALQQISQKTRIRAVILDFFCNAAFEVPTSLNIPTYYYFSAGTPTAILTLYFETIDETIPVDLQDLNDYVDIPGLPPIHCLDIPVALSPRKSLVYKSSVDISKNLRRSAGILVNGFDALEFRAIGSHSQRPMHFKGPTPPVYFIGPLVGDVDTKAGSEEHECLRWLDTQPSKSVVFLCFGRRGVFSAKQLKETAAALENSGHRFLWSVRNPPELKKATGSDEPDLDELLPEGFLERTKDRGFVIKSWAPQKEVLAHDSVGGFVTHCGRSSVSEGVWFGVPMIGWPVDAELRLNRAVMVDDLQVALPLEEEAGGFVTAAELEKRVRELMETKAGKAVRQRVTELKLSARAAVAENGSSLNDLKKFLHATRD

SEQ ID NO: 34972 - protein, 581 aa, Mesembryanthemum crystallinum
MVEGGIVKADKTEFTECFRTIGKTPYILRLAFSAGIGGLLFGYDTGVISGALLYIKEDFKEVERKTWLQETIVAMAVAGAIIGAGVGGYLNDKFGRKPAIIIADILFFIGAIIMSLAPAPWMIILGRIFVGLGVGMASMTSPLYISETSPTRIRSALVSTNGLLITGSQFLSYLINLGFTRVKGTWRWMLGVAAVPAFVQLLLMLSLPESPRWLYRKNKVVEAEAILARIYPPEEVEEEMRALKASIEYEMAEEGEIGGGSMLSKVRKAWGNKIVRRGLYAGITVQVAQQFVGINTVMYYSPTIVQLAGFASNSTALALSLVTSGLNAIGSIVSMMFVDRHGRRRLMIISMFGIITCLIVLAIGFFQAAAHAPKISHAESTHFGLNSTCPAYTTTRNPATWNCMTCLQAASECAFCTNKGNQLLPGGCVSRTDAMKVACHGEKRVYFTEGCPSKFGFLAVILLGAYIISYSPGMGTVPWIVNSEIYPLRYRGVGGGIAAVSNWTSNLIVSETFLTLTEALGAAGTFLLFAGFSAIGLVFIYLLVPETKGLPIEEVEHMLENGFKPSIFRGNKDKETKASGT

SEQ ID NO: 34973 - protein, 1938 aa, Bacillus sp.
MKKRFQRGMAGLLSILLIVSMFAGYLPARAAAETGDKRIEFSYERPDGNYEGWNLWVWGTGVKDDQIDFTEFKEGKAYADIAVSDNADKVGFIIRKGDWEEKDFDGDRSITINKIDNITKVHVTSQQEKFGQIPDGSPPVVADGNADFFFRDKELYAAGEMDKVEKVELSILGEKYEMNGEPEKERFTYTLSDLPTGEHEYTYLVTVDGQTEEVTDPYNTVDGRSVVEYVTSDVQVSASFIPAKVDYNQNAVVKVDIESETETKIREMSINLSEIGGKEKATIDPALNELTVAVKQGVTAGVKNLPITAIDEFGNRHEGSATLEVQARTITGEKADFDWDQSVVYFMLTDRFFDGDSSNNDPHGIGYDTSKSGTYQGGDFKGITQRLDYLDELGINTIWISPVVDNIKFDVRHSEGPDTPYYAYHGYWADNFGELNPHFGSMADFHEMIDAAHERGIKIMVDVVLNHTGYGLKPGDSSSVANFPTDEDRARFDGMLRDGGSGEVRGELAGLPDFLTENPDVREQVVQWQTDWIEKSRTAKGNTIDYFRVDTVKHVEDTTWMAFKNALTKAMPEHKLIGEAWGANVNDDLGYLNSGMMDSLLDFDFKNYARDFANGQLDAVQQKLEARNSKLNNTATLGQFLGSHDEDRFYEVVEGDLGKYQVAASLQLTAKGQPVIYYGEELGLPGKNDYPYYTNRQNMPWDDVDGNEILEHYQKLLAFRNDNPNTFAKGDRKKVAGSDSEGYLLFSRTYGENSVYVGLNTEAAAKDVTLNFGSSEAVVTDRYSGQEYQANEEGQVTFSIPAMEDGGTVLLEVENGAVPPVEEEPTEPGEIEENTLRIHYQRTDNSYENLGLWLWGDVAAPSENWPSGGTPFQAGNVTDYGAYVDVELAEDAQNIGFLVLNTTNGDKDGGDKAVELFSPDLNEIWIKQGSDEVFLYEPVDLPANTVRIHYERTNADYEGWGLWNWEDVESPSDGWPNGAADAAGIGKYGAYYDIKLKEDANKIGFLFVNKQSGGQTGDMTFDMLKQYNQLFVKEGEDKVYTNPYGTVPLALVSGEVLSDKLISLTFTRTEGLDLEELKEQLEIKDVDGNDVSFTDVTIEGEKTVHVHGEFDLEKIPFSVTYLDRTISVKSGWKLIDEMYAYDGKLGAELHEDGTATLKVWSPKADNVSVVLYDKVDQNEVVDTIEMVKGDRGVWSVKLTKDNTGLDSLKGYYYHYEITHGDVTNLALDPYAKSMAAWNNEAGDKVGKAAIVDIGSIGPELDYADIPGFEKREDTIIYEVHVRDFTSDPNIGEDLKAQFGTFASFVEKLDYIQELGVTHIQLLPVMSYYFSNEFESGERMLEYASTGTNYNWGYDPHNYFSLSGMYSENPEDPELRIKEFKNLINEIHKRDMGVVLDVVFNHTAQVHIFEDLVPNYYHFMDADGTPRTSFGGGRLGTTHEMSRRVLVDSIKHWVDEYKVDGFRFDMMGDHDAESIQIAFDEAKKLNPNIVMIGEGWVTFAGDEGEPVQAADQQWMQYTEAVGSFSDEFRNELKSGFGSEGQPRFITGGAVNVQQIFDNIKAQPHNFMADQPGDVVQYIEAHDNLTLYDVIAQSIKKDPEIAENDLEIHKRIRVGNAMVLTSQGTAFLHAGQEFGRTKQWRAPATEAPYKSTYMTDADGNPFVYPYFIHDSYDSSDIINRFDWEKATDAEKYPVNNVTRDYTAGLIELRRSSDAFRLGSRELVDSNVTMVDAPEIKEQDLVVAYRSVSTAGVEYYTFVNADTSSRTLTLGQDLTEGVVVVDAEEANVAGVAEPAGFELTAEGITLEPLTTVVVRVGEQEGTDPGDGDGDGNTPPPGDGDGDGNTPPPGDGDGDGNTPPPGNGNGNNPGTPPGKGGENPGKGKNDKTPPGKGGDNPGKGNKLPLTATGTLNYILFGAIMLVLGTLLYLGVRRKAGLKEKTL

SEQ ID NO: 34974 - protein, 127 aa, Rhodopseudomonas palustris CGA009
MPIQHFAAPAHIKAPPLSFATRTGDLVFISGIPGFDETGQLPQAFEAQFGYVVVNFKRVLKEAGAEIRDLVKVNVLLTRAADVVPMNKLYAQAFGPAPYPARTTCVVQALPDPAMLIEIEGIASLAK

SEQ ID NO: 34975 - protein, 256 aa, Brassica napus
  misc_feature (155)..(155): Xaa can be any naturally occurring amino acid
KSCFAGRSSEQERLTGEFWGEAEILSKLHHPNVVAFYGVVKDGPGGTLATVTEYMVDGSLRHVLPRKDRHLDRRKRLIIAMDAAFGMEYLHAKNIVHFDLKCDNLLVNLKDPSRPICKVGDFGLSKIKRNTLVSGGVRGTLPWMAPELLNGSSSXKVSEKVDVFSFGIVLWEILTGEEPYANMHYGAIIGGIVNNTLRPTIPSYCDSDWRILMEECWAPIPTARPSFTEIAGRLRVMSTAATSNQSKPPAHNKASK

SEQ ID NO: 34976 - protein, 373 aa, Bordetella bronchiseptica RB50
MAKRDYYEVLGVAKNASDEDLKKAYRKLAMKYHPDRNPDSKEAEEKFKEAKEAYEVLGDEQKRAAYDRYGHAGVDPNAAGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 34977 - protein, 503 aa, Leifsonia xyli subsp. xyli str. CTCB07
MREANVYSEIVPHTVTAADIAAKRPAGIILSGGPSSVYEEGAPRLDEGIFELGVPVLGICYGFQVMAVALGGEVAKTGHREYGSTAVRVSAGARGGAGFLLDGQPGDQTVWMSHGDSVAKAPEGFDVLASTDDTPIAAFANDGRKLYGVQWHPEVKHSEHGQAVLENFLHRAAGIPADWNSGNVIADQVAAIRAQVGSGRVLCALSGGVDSAVAAALVHKAIGDQLVCVFVDHGLLRRDEARQVQEDYVSATGVRLITVDAEEQFLAALESVSDPEAKRKIIGREFIRVFERAQADLVAEAASEGDPIRFLVQGTLYPDVVESGGGAGTANIKSHHNVSGLPEDLQFELVEPLCTLFKDEVRAIGRELGLPEVIVGRQPFPGPGLGIRIVGDVTRERLDLLRDADAIVRAELTAAGLDSEIWQCPVVLLADVRSVGVQGDGRTYGHPIVLRPVSSEDAMTADWTRLPYHLLAKISNRITNEVEGVNRVVLDVTSKPPGTIEWE

SEQ ID NO: 34978 - protein, 319 aa, Glycine max
MMAGNPNWWTMHPPSLIPPQYVLGSSSIPFNSSTQNQEPPHSLSQLLFTGLPGEEERVAFSHFQSKKLDEWNEQMLNPSSIVPMADVIKQEVSQSGNLYHHGHDQEFQVSGAPWSHMVPVSSSPRSSVASFSSNNLLDFTYNKTDHRKNQLPDHTSECNSTATGGVYKKTKSQPSSSQPPLKVRKEKLGDRITALHQLVSPFGKTDTASVLLEAIGYIRFLQGQIEALSSPYLGNGSKNMRNPQSQQVHGERNSVFPEDPGQLLNDNGLKRKGAPNQDAKDKPSDLKSRGLCLVPVSCTQHVGNENGADYWAPAYGSGF

SEQ ID NO: 34979 - protein, 294 aa, Listeria monocytogenes EGD-e
MMNKENPLNKYHTGKFEKQRQDYPGLQSKMTPVPDTGESSYQGANKLTGKKAFVTGGDSGIGRAAVIAYAREGADVAINYHPDEEVDAQEVKAIVEEAGQKCVLLPGDLRKEGLAKDLVKKAYNELGGLDILVLNAGLQQYQLDIQKLPAEQLRDTFEVNVFSVVFAIQEALNYLKAGASIILTSSIQGVKPSAHLVDYAMTKSSLISLTKSLAAQLGEKGIRINAVAPGPIWTALQISGGQPQDSIPEFGQDQPLGRAGQPAELASAYVLLASDEASYTTGQVYGITGGAPIN

SEQ ID NO: 34980 - protein, 602 aa, Arabidopsis thaliana
MEVCGDLKSDNLKNRPLTPLRILRGLMILLVFLSTAFMFLLYFAPIAALGLRLLSVQQSRKVVSLIFGLWLALWPYLFETVNGTTVVFSGDIIPVEKRVLLIANHRTEVDWMYLWNIALRKGCLGYIKYVLKSSLMKLPIFGWGFHVLEFIPVERKREVDEPVLLQMLSSFKDPQEPLWLALFPEGTDFTEEKCKRSQKFAAEVGLPALSNVLLPKTRGFGVCLEVLHNSLDAVYDLTIAYKPRCPSFMDNVFGTDPSEVHIHVRRVLLKEIPANEAESSAWLMDSFKLKDKLLSDFNAQGKFPNQRPEEELSVLKCIATFAGKQQQVTKPSCQKVFLLLNQSSDEKESKKAVAQHPFTDTLDHLFQVQMSSGGIADSATVFTLQNSCAYTVWPGTLSGNSITLGDGGFPLTPGASVQLTAPTGWSGRFWARTGCNFDASGHGTCVTGDCGGVLKCTGGGVPPATLAEFTVGSSNAGMDFYDVSLVDGYNVKMGIKPQGGFGNCKYAGCVSDINEICPSELRIMDPNSGSVAACKSACAAFSSPEFCCTGAHATPQTCSPTYYSSMFKNACPSAYSYAYDDASSTFTCTGSNYLITFCPTQS

SEQ ID NO: 34981 - protein, 425 aa, Nocardioides sp. JS614
MASIEAVGAREILDSRGNPTVEVEVLLDDNSFARAAVPSGASTGAFEAVELRDGGDRYLGKGVAKAVEGVIQTIAPAIEGLAADDQRLVDQTMLELDGTPNKGKLGANAILGVSLAVARAAADSAELPLYRYVGGPNAHLLPVPMMNILNGGSHADSNVDVQEFMIAPIGAPTFREALRSGAEVYHALKSVLKKKGLATGLGDEGGFAPNLDSNRAALDLIAEAVSAAGLTLGKDIALAMDVAASEFYKDGSYAFEGGTKTAEQMTAYYADLVASYPIVSIEDPLDEEDWAGWKALTDELGSKIQIVGDDLFVTNVERLQRGITGGQANALLVKVNQIGSLTETLDSVELAHRNGYRCMMSHRSGETEDTTIADLAVATNCGQIKTGAPARSERVAKYNQLLRIEDELGDAARYSGASAFPRYAG

SEQ ID NO: 34982 - protein, 394 aa, Oryza sativa (indica cultivar-group)
MAAVRCSAAKRSYNVTLLPGDGIGPEVVAVAKDVLSLAGALEGKASNQSLSLSLSLGPTRVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 34983 - protein, 532 aa, Adiantum capillus-veneris
MSEQGCYTDCWGAIWWIWESGIKAMAGLEGEIQTRRLRGREIPVLPPVTRSAAASAANVGYNENTRKTKVSTKRAAADDTSSRVASNVPVQHAKKRAALANLTNQSNSAITRNSSLPSKSHASAVNGKTRAAAGQVKEVQQVAQQVVEPLQEVGREPNTGRSSLANSSITFDNDENACPERATSSVGMKSRTLDVLQLVGNENKTVASLERKTQHSLYISKDTKPRARQGGLFEDCKDDNEEGGWSSKNYMDIDNHKDPQMCSAYAAEIYHHLRMAELKRRPSLNFMDTVQQDINASMRGILVDWLVEVAEEYKLVPDTLYLTISYIDRFLSGNLVTRQRLQLLGVASMLIASKYEEICAPQVDEFCYITDNTYNREEVLEMERSVLNHLHFELTGPTTKSFLRRFVRAAQAGQKSPTLQLEFLGNYLAELTLLEYGFLHFLPSMIAGAAVLVARVTLNPTWRPWNSTLQHYSGYKASELKECAKAILELQKNTKNCTLPAIREKYRQHKFKCVATLHPPASIPAEYFDDIE

SEQ ID NO: 34984 - protein, 848 aa, Oryza sativa
  misc_feature (628)..(628): Xaa can be any naturally occurring amino acid
MAYLGGDPGRGGGAPPGMTPWPGPPPQPGQPAVVYTALHQGAYQPGVAQVVYWAPSPGAPSLGGIRAPPAPYQPAQVAAPQAAAPFAAALAKEVEQKLFVTENALGPPAAAAAVSKKGPAHPGRPGYGAAGKKVMIHENNFLHNVVDNNLFHNDEMINGGTEEPRFCGGLIQMCNVENALRDVQRRTTELPVRYAQGRTVLDSQIGLLGEIDSNINATGLQHTHDLMKKMKFAASATPHPRRVLAVALALMVAFAVGPMVALAKCEQQAHAVASLCGGTGIYARCCFALKRSLDGGDPLCLCSLANNREVAEMGLNSTRILSLYRKCEGNVFPVLPAGGCEEVPALSPSPPPLHGSVMPPPLPPATVEPVISAPMVEPPPPPAMITPLPPSTPVFTLPPPPPVTTAPSTALPAGASAAAPSTGVLRRIYQALIGLLCLVAGFLLVAVFVVVRKYWKPQLNNDVEMGSSNAADQSAIENAKKAAAEAQSSAEAAASAAAGSLATAQAASGAAQAAQAATEEVVTVQANAAEQAVLFVEALGRAAQQISTCTITLGQLLQLVSQIIQAVRAAQGGAASAAAAITGLFARFGEIFGRVGAATAFVEAQAVAAQGAPSDLIDIDCINSPGVXIDGDRGVSSFDEGGSNEDEDEANVERSTSRTSNRIRKSNVRYSEDVWVLDPPARASITEGTQLSRDPDLPDAAYHRLPQPKDSERVKNYIPKHPAVTPASFPQIQAPVVSNPAFWERMGGDSLSTVLFFAFYYQQNTYQQFLSARELKEQSWRFQRKYNTWFQRHVEPQVTTDELSAKSLTHNLWKKTAKSDGCRNSNSSRTKLEFRETKNRVKQSVCAA

SEQ ID NO: 34985 - protein, 307 aa, Aspergillus nidulans FGSC A4
MSRIPKDQWERLQLILQSRNRFNGFRPGGGGGGGIGASAALIVLGLGGWALSNSLFNVDGGHRAIKYSRFGGVKKEIYSEGTHFAIPLIETPIIYDVRAKPRNIASLTGTKDLQMVNITCRVLSRPRVDALPQIYRTLGQDFDERVLPSIVNEVLKSVVAQFNASQLITQRENVARLVRDNLARRAARFNIALDDVSLTHLTFSPEFTAAVEAKQVAQQEAQRAAFLVDKARQEKQAFIVRAQGEARSAELIGDAIKKSKSYIELRRIENARHIAQIIQENGGRNKLYLDSQGLGLNVNAGADGESK

SEQ ID NO: 34986 - protein, 303 aa, Aspergillus nidulans FGSC A4
MGPDRAGKSVFLGNIPYRSLLADTLCLDLTEEQVKDILSTAGTVTKFRLMMNPETGKPKGYGFADFADADAAASAVRNLNDYEIMGRKIRVDWPHNNEKDSVPEDYSQPSQMPGQDGQLGGPPLSAPLPPLPPGVELPPHLDCPNAISQTLAALPPNQLLDVLQQMKALAMSDPARATELLRQAPQLAYAIFQALLLLNLVDYSTLGAVVEQAAQPMAPPPAPPAAAAFQPFGAVPGQVSTPPMVNTPFAQPPPQPTQQQVPGQEELLQQVLNMPQSAIDALPPMERSQIMLLRQQLMQGGLR

SEQ ID NO: 34987 - protein, 259 aa, Burkholderia mallei ATCC 23344
MNAPAPLKVFITGASSGLGLALAAEYARHGATLGLVARRADALAEFAPRFPKASISIYPADVRDADALALAASRFVAAHGCPDVVIANAGISKGAITGEGDLAAFREIMDVNYYGMIATFEPFIAPMTAARRGTLVGIASVAGVRGLPGSGAYSASKAAAIKYLEALRVELRPAQVAVVTIAPGYIRTPMTEHNPYPMPFLMDADRFAKRAALAISQKTAFRVIPWQMGIVAKLLHVMPRWLYDRLFEKAPRKPRAKAG

SEQ ID NO: 34988 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQLFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 34989 - protein, 375 aa, Neurospora crassa
MEEEVAALVIDNGSGMCKAGFAGDDAPRAVFPSIVGRPRYHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTAAQSSSLEKSYELPDGQVITIGNERFRAPKALFQPSVLGLESGGIHVTTFNSIMKCDVDVRKDLYGNIVMSGGTTMYPGLSDRMQKEITALAPSSMKVKIIAPPERKYSVWIGGSILASLSTFQQMWISKQEYDESGPSIVHRKCF

SEQ ID NO: 34990 - protein, 367 aa, Oryza sativa (japonica cultivar-group)
MARHLPAILLLSSALLLALASASASAAAPALAAFVDAASRRYLRDQQHHDQAASMSLDQVSAAVSVLLGFAPPPSLPAQSSSKLDKLLLPNPFDRPRAVFLLQIDGFHASVESITSEAGSIFKTTIDGLSDSATGLTDKDDLVIVHSDESPAVDSGSEYFDSDLTDLANWLGGSYEKVDGKLIIPLESGESLTLLITKEADMEFASSLISLRKTIKRGIQVHEDFSGGVMSPAELLVCHFKGIKALEEEYGSTEIVKQGTDVVRTAVTKAFDLLRGAYNGKIVGLVISTKEASPSLVGPASSLHISRWLKETSQTNTTIASSEILVRKSLAWITGIILLVSTLIGVCLLMNMPLTRDTLLYSNVKID

SEQ ID NO: 34991 - protein, 430 aa, Xanthomonas campestris pv. campestris str. ATCC 33913
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLKR

SEQ ID NO: 34992 - protein, 287 aa, Samanea saman
MAKDVEVAERGSYSAKDYHDPPPAPLIDAEELGKWSFYRALIAEFIATLLFLYITVLTVIGYKSQSDTKAGGDVCGGVGILGIAWAFGGMIFILVYCTAGISGGHINPAVTFGLFLARKVSLIRAILYMVAQCLGAICGVGLVKAFQKAYYSRYGGGANTLSDGYSTGTGLGAEIIGTFVLVYTVFSATDPKRSARDSHVPVLAPLPIGFAVFMVHLATIPVTGTGINPARSLGAAVIFNQQKAWDDHWIFWVGPFIGAAIAAFYHQFILRAGAAKALGSFRSNPSV

SEQ ID NO: 34993 - protein, 257 aa, Glycine max
MKSKILKALPKAVAAVTVTFQNHPFSPGRDHKSKPIVSMIPHEARRKTHDRGNNGIDEIYSQEPTSPKISCMGQIKHKKKQIKKSKSKSKSMTKEARNVASKKTSSASRDIEVKKHVSTFHKMLLFHGAKPKSEGRKSNASAPGDINKDLALADAARAPRVSQMRRFSSGRDALAEFDWKVSPDEEEIDYYSDEYRVDSDGEEEEEIIIPFSAPLLVGGGVGHTRGGVLNLKPRKEINLWKRRTMAPPRPLQLDRAN

SEQ ID NO: 34994 - protein, 491 aa, Mycobacterium sp. JLS
MTQTVQEHKTTWDKLFIGGQWVAPSTSDVIEVFSPATGQKVGQVPLAAEADVNAACAAARKAFDEGPWPRMSPDERAAVLGAAVKLMEERGAELKYLLAAETGQPQTIVDMMQYGAAMSSFTYFAGAADKFQWSEIRDGIYGQTLVTREPIGVVGAITAWNVPFFLAANKLGPALLAGCTVVLKPAAETPLSVFAMAQMFAEAGLPEGVLSVVPGGAETGRALTANPEIDKYTFTGSSAVGKEIGKLAAEKLKPCTLELGGKSAAIVLEDADLDSTLPMLAFSGVMNSGQACVAQTRILAPRSRYDEVVEKLANFVSAMPVGLPDDPNAAIGPLISEKQRERVESYIKKGTEEGARIVTGGSRPEGLDSGWFVQPTVFADVDNSMTIAQEEIFGPVLAVIPYETEDDAIRIANDSVYGLAGSVWTTDNKKALEVASKIRTGTYAVNMYAFDPGAPFGGYKNSGIGRENGPEGIEQYCQAKSTLLPFGYTPE

SEQ ID NO: 34995 - protein, 425 aa, Glycine max
MVKGLHGQNLPAHVAQLVDQLERHCFAPDGSLISKPLFNDLQLARDEMCRERLRYLEAMAIYSEAIAMVEEYQQAISVSNLGGIRDTGNLYPQLGLKNSPQVYQTLEHQMVVAEAAQRLRLPLISKDGEVHDEDIEKLSVVSRSSLDSTVSGANSSNYNTPSSSVSGANTALAASDPVEVGVGGVANRFLGITPSYLWQTQHQKAPLSVDMTEYRLSVSREVEARLKMKCEKLSDAFVLDDNDSSSSGSHSSSSRLPERVKLLIEEIEREETALRDDLYSADRKFAEYYNVLEQILAVLIKLVKDLKLEHQHKYDEMQKTWLCKRCETMSAKLSVLEHVLLLETYTKDSIPALHKIRKYLVEATEEASIAYNKAVTRLREYQGVDPHFDNIARQYHDIVQKLENMQWTIHQVEMDLKRLPDKPST

SEQ ID NO: 34996 - protein, 387 aa, Zea mays
MEAGGAGSGLNGAVQAKGTGADGGSAKPLPPCCVKARAAAPESEARCHATVVSGWFTEPRSRCGKASKVQYYNNPMWPGEANSLKVEKILYQGKSPYQEVLVFESSTYGKVLVLDGIVQLTDKDECAYQEMITHLPLCSIPSPKKVLVIGGGDGGVLREVSRHSSVESIDICEIDQLVIDVCKDFFPHLSVGFQDPRVQLHVGDAVEFLRNAPEGTYDAIIVDSSDPIGPAQELVEKPFFDTIARALRPGGVLCNQAESMWLHTHLVQDMLSICRETFKGSVRYAWTSVPTYPSGVIGFLLCAKEGPLVNFLTPINPIEKLEGATKAGREIRFYNSEMHRAAFVLPTFARRELEAYCVSTETEQAEETPAAPLKLTLASRSEIFATS

SEQ ID NO: 34997 - protein, 421 aa, Triticum aestivum
  misc_feature (163)..(164): Xaa can be any naturally occurring amino acid
DSHGQQPHFLKTCLNPSLDLGSTVLLLGHTNRRDLAVGEGKVVIATDNLIKFSTDEVSWHPGSAGFDMNGNLAFMVCDPMKLAPSTPTGYASASSTALLASKMDVPTQFGIPIPAVCEWLKQHWSGSLEDVSKPMMPPARLISAAGQRSEPSSLSHLHYIKTXXREGGALSSSQMPARPTRQHGSCSSASAKISYGENDSVNSHSFQGQRDPASQMPRPKEQPGSVMDSFPPGHPRSIFLPLPLKQMMPVDNKIKPNCSVSDESRVANARINCDAMHNVAYQENCWNEAQSSSSPPAISEQGDKRDGFSSGEETMYSAETMESRNIPSPKDKRPQIVGRSQSFANHSKWDSPKSVESSKGPPSRSHTFIPLRKPHLQAASISQKSQVYFSPTVSSNMKKRNLSQIPMKPRQSAQVTSKWIT

SEQ ID NO: 34998 - protein, 366 aa, Acidovorax sp. JS42
MTAMMKAAVFVEKGRIELADKPIPDVGPNDALVRITTTTICGTDVHILKGEYPVAKGLTVGHEPVGVIEKLGSAVQGYQEGQRVIAGAICPNFNSYAAQDGYPSQDGSYLVPRGLCGCHGYKATAGWRFGNLIDGTQAEYVLVPDAQANLAPIPDGLTDEQVLMCPDIMSTGFKGAENANIKIGDTVVVFAQGPIGLCATAGARLLGATTIIAVDGNDDRLAVAKKMGADVTLNFRNVDVVEEVMKLTGGKGADGSIEALGTQATFAQAMKVLKPGGTLSSLGVYSEDLSIPLAQFAAGLGDHTIRTALCPGGKERMRRLMNVIAANRLDLGLLVTHQRKLDDIVEAYDLFAHQRDGVLKIAIKPH

SEQ ID NO: 34999 - protein, 529 aa, Thermosynechococcus elongatus BP-1
MDALALWQHYQDWLYYHPELEFYVDVSRMGLTPEVVHRLEPAFERAFEQMKELEAGAIANPDEGRMVGHYWLRDPDLAPSPELRSQIRDAIAQVKQFSQQVHSGAIAPPQGGHFTEILSIGIGGSALGPQFVAAALAPVHPPLNIHFLDNTDPAGFERVFAELGDRLRTTLVLVISKSGGTPETRNGMLEAQARFQRAGLAFADHAVAVTLPGSGLAQVAESNGWLAIFPMFDWVGGRTSELSTVGLLPAALQGIDIDDLLMGAKLMDQATRVPNIRQNPAALLALAWHHAGKGRGEKDMVILPYKDSLLLFSRYLQQLVMESLGKETDLNGNIVHQGIAVYGNKGTTDQHAYVQQLRDGLPNFFVTFIEVLRDGQEPSIEVEPGITAGDYLSGLLLGTRQALYEKNRPSLTVTIPEVTPKTVGALIALYERAVGLYGFLVNINAYHQPGVEAGKKAAAANLALQRQIVKVLEQSDEPLDLGAIAGAINAPDQLERIYLILRHLAANDRGIEQLGDPAQPSQLQFRWQR

SEQ ID NO: 35000 - protein, 170 aa, Brassica napus
MSTTITAGDVTDFSGGGEERRKVAIILAFCGVGYLGMQRNPGAKTIEGELEEALFRAGSVTETDRGKPKQYDFTRCARTDKGVSAVGQVVSGRFHVDPPGFVDRLNANLPDQIRVFGYRRVPEKFSSKKFCDRRRYVYLLPVFALDPFTHRDREAVMASSGSGEEYVKCF

SEQ ID NO: 35001 - protein, 150 aa, Zea mays
MASEQTFIMIKPDGVQRGLIGEVISRFEKKGFYLKGLKLQNVEKSFAEQHYADLSSKPFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 35002 - protein, 391 aa, Corynebacterium glutamicum ATCC 13032
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVARKGELFKELLAKVDGVVDVRGRGLMLGVVLERDVAKQAVLDGFKHGVILNAPADNIIRLTPPLVITDEEIADAVKAIAETIA

SEQ ID NO: 35003 - protein, 453 aa, Aquifex aeolicus VF5
MWELDPKTLEKWDKEYFWHPFTQMKVYREEENLIFERGEGVYLWDIYGRKYIDAISSLWCNVHGHNHPKLNNAVMKQLCKVAHTTTLGSSNVPAILLAKKLVEISPEGLNKVFYSEDGAEAVEIAIKMAYHYWKNKGVKGKNVFITLSEAYHGDTVGAVSVGGIELFHGTYKDLLFKTIKLPSPYLYCKEKYGELCPECTADLLKQLEDILKSREDIVAVIMEAGIQAAAGMLPFPPGFLKGVRELTKKYDTLMIVDEVATGFGRTGTMFYCEQEGVSPDFMCLGKGITGGYLPLAATLTTDEVFNAFLGEFGEAKHFYHGHTYTGNNLACSVALANLEVFEEERTLEKLQPKIKLLKERLQEFWELKHVGDVRQLGFMAGIELVKDKEKGEPFPYGERTGFKVAYKCREKGVFLRPLGDVMVLMMPLVIEEDEMNYVIDTLKWAIKELEKEV

SEQ ID NO: 35004 - protein, 564 aa, Methanopyrus kandleri AV19
MPETPNKVLIIGSGPIIVGQAAEFDYSGSQACKALREEGVEVVLVNSNPATIMTDPNMADRVYLEPLDARIVAKIIEEERPDGILPTLGGQTGLNIAVELDEMGVLEEYDVEVLGTSVETIVRAEDRDEFRAFMKKIGEPVCASEAVSSVEEAKEVAEEIGYPVVVRPAYTLGGTGGGIAEDEEELKRVVERGLEYSRVNQVLIEEYVGGWAEIEYEVMRDGSGNCITVCSMENVDPMGVHTGESIVVAPAQTLTEEEHQMLRSAALHIIDALGVEGGCNIQFALHRETGEYRVIEVNPRVSRSSALASKATGYPIARIAAKIAIGLRLDEIENQVTGETYAAFEPALDYVVVKIPRWPFDKFPEANRTLGTEMKSVGEVMAIGRTFEEALQKAIRSLEIGEPGLGPSPEELEADPEEIRRKIETPNDRRIFCIYAALKRGLMSVEEISELSGIDPWFVEKVKRIVEMEHEIVRRKDELLEFIRTGEADEETVEFVREVKRTGFSDEQIAELLGVDEDEIREARLGVGVEATYKLVDTCAAEFAAVSPYFYSTYEEECEALRYD

SEQ ID NO: 35005 - protein, 640 aa, Corynebacterium diphtheriae NCTC 13129
MCGLLGMLSSTGQASKYAAAIESALPCMHHRGPDEAGTWHDDHAVFGFNRLSIIDLEHSHQPLRWGPEGEPDRYAMTFNGEIYNYVELRKKLQDLGYTFNTSGDGETIAVGFHHWGADVVLHLRGMFGIAIWDTKEQRLFLARDQFGIKPLYFATTEAGTVFASEKKCILGMADAIGLDLGLDQRAIEHYIDLQYVPEPESLHQHIRRLESGCFAFVSVGGNVEQTRYFRPQFPAQEFPKDKEQDLFDRIAKALEDSVEKHMRADVTVGSFLSGGIDSTAIATLAKRHNPNLLTFTTGFEREGYSEVDVAAESAAAIGVEHIVKIVSPEEYANAIPQIMWYLDDPVADPSLVPLFFVAQEARKHVKVVLSGEGADELFGGYTIYKEPLSLAPFEKIPSPLRRGLGKVAEVFPDGMRGKSLLQRGSMTMEERYYGNARSFNFDQMKRVIPWAKKEWDHREVTAPIYAQSEHMDPVARMQHLDLFTWMRGDILVKADKINMAHSLELRVPFLDKEVFEVAETIPYDLKIANGTTKYALRKAMEQIVPPHVLHRKKLGFPVPMRHWLAGDELFGWAQDTINESMTDQYFDKAAVLAMLNEHKNGVSDHSRRLWTVLAFMIWHGIFVEHRIDPGIEKRDYPVYL

SEQ ID NO: 35006 - protein, 252 aa, Zea mays
MAIARTGVYVDDYLEYSSTLAGDLQRILSTMRELDDRAHGIMGQTKEQIKYILGVSSHGYDRSNMDDDESERMKKDIEASQDNALNLCTEKVLLARQAYDLIESHIKRLDEDLGQFAEDLKHEGKIPPDEPTVLPPVPVVSRDEKRRFGFSTPQASKKFREREWDRERGMDFDLMPPPGSSKKAGTSMDVDQTIDPNEPTYCICHQISYGDMIACDNENCGGGEWFHYTCVGLTPETRFKGKWFCPTCRNLQ

SEQ ID NO: 35007 - protein, 336 aa, Lactobacillus reuteri
MEALVLTGKKQLEIEDIKEPEIKPDEVLIHTAYAGICGTDKALYAGLPGSASAVPPIVLGHENSGVVTKVGSEVTNVKPGDRVTVDPNIYCGQCKYCRTQRPELCEHLDAVGVTRNGGFEEYFTAPAKVVYPIPDDVSLKAAAVVEPISCAMHGVDLLETHPYQKALVLGDGFEGQLFAQILKARGIHEVTLAGRSDEKLENNRKHFGVKTIDTTKEEIPADAYDIVVEAVGLPATQEQALAAAARGAQVLMFGVGNPDDKFSVNTYDVFQKQLTIQGAFVNPYTFEDSIALLSSGVVDPLPLFSHELDLDGVEDFVSGKLGKVSKAVVKVGGEEA

SEQ ID NO: 35008 - protein, 453 aa, Triticum aestivum
  misc_feature (162)..(162): Xaa can be any naturally occurring amino acid
  misc_feature (236)..(236): Xaa can be any naturally occurring amino acid
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNVINGXGSHAGNKLAMQEFMILPTGAASFKEAMKMGVEVYHNLKSVIKKKYGQDATNVGDEGGFAPNIQENKEGLEALEXAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFPCTGGAILDGICI

SEQ ID NO: 35009 - protein, 88 aa, Oryza sativa
  misc_feature (39)..(39): Xaa can be any naturally occurring amino acid
MVRKAKVEFDESPPDDFDPKNPYGDPVAMLEYREHLVRXCYRIEGVNHHQKCRHLVDQYLEATRGVGWGKDARPPELHDPKKVVEADE

SEQ ID NO: 35010 - protein, 215 aa, Exiguobacterium sibiricum 255-15
MEWIAAVGTIVIVGIVLALLEWTGKKLQMQPETIRKWIHIAVGHWVFLALAWMEHWYVAITPLLFFTLINWITLKRGTGRMNQVERVSYGTVYYPMALALLVLFFFEQEPMALVAGSMVLAWGDGLAALVGKRFGKTFYTRGKIRRSFEGSITMFLASFLVLTVTFLLYEEPAWLAVSYGFLLANIAALIEAVSYRDTDNLLIPLTIGALVAFAL

SEQ ID NO: 35011 - protein, 118 aa, Cylindrocladium gordoniae
RSTGAKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 35012 - protein, 100 aa, Arabidopsis thaliana
  misc_feature (76)..(76): Xaa can be any naturally occurring amino acid
RPRVRASSMLSSATMVASPGQGNKVAPFNGPKSSGAFPGNRKGNNDITSNISNGRRVNCMQVWPPIGKKKFETLSXLPDLNESELAKGIDQLIRNKLNPC

SEQ ID NO: 35013 - protein, 559 aa, Vigna angularis
NRNSEIIFIDKVLVNIKQHFSYLVTSSRIRKTCFFFLVYIAYTIFFVYCSCSNNFSDLFESFFCKRSNINPKARVQFLQVVSVKSCAVGDRYHPMEKRVNIAVVPGPGFSHLVPILQFSKRLLQLHPNFHVTCLIPSFGSPSSASKSVLETLPPNIESIFLEPVKPEDLPQGVAIETQIQFTVTLSLPSIHQALKSITSKTPFVALVADSFAFEALDFAEEFNLLSYIYFPSAATTLSWYLYVLKLDKETSCEYRDLPEPVKIPGCVPIHGRDLNNQAQDRSSQVYKLFLQRAQRFCSVDGIFINSFFEIETGPIRALKEEGRGYPQVFPVGPIVQTGDDAKGLECLTWLDKQEDGSVLYVSFGSGGTLTQEQVNELAYGLELSNHKFLWVVREPSSLAFDAYLRAQRSVDPLHFLPDGFLERTKEQGMVVPSWAPQIQVLAHSSIGGFLTHCGWNSVLESVMNGVPLITWPLFAEQRMNAVVLSEGLKVGVRPRVSENGLVERVEIVKVIKCLMEEEEGGEMHKRMEELKQAASNALKADGSSTKTLSELVQKWESLV

SEQ ID NO: 35014 - protein, 1173 aa, Penicillium citrinum
MVASLLPSRFRGRESMNQQHPLRSGNRALTSTLQFLSKTACLHPIHTVCTIAILASTTYVGLLKDSFFHGPANVDKAEWGSLVEGSRSLITGPQNGWKWQSFDGDADVLGDFNHQALMTLVFPGSYGVASQAASPFLAPLPVNLSVIDLPSTSSPLTAYSKDKVFAFSVEYSSAPELVAAVQEIPNNSADLKLQETQLIEMERQMWIMKAARAHTKRSLAQWVHDTWTESLDLIKSAQTLDVVVMVLGYISMHLTFVSLFLSMKKLGSKVWLATSVLLSSTFAFLLGLDVAIRLGVPMSMRLLSEGLPFLVVIVGFEKSITLTRAVLSYAVQHRKPQKIQSDQGSVTAIAESTINYAVRSAIREKGYNIVCHYVVEILLLVIGAVLGIQGGLQHFCVLAALILFFDCLLLFTFYTAILSIKLEVNRLKRHINMRYALEDEGLSQRTAESVATSNDAQDSARTYLFGNDMKGSSVPKFKFWMVVGFLIVNLVNIGSTLFQASSSGSLSSISSWTESLSGSAIKPPLEPFKVAGSGLDELLFQARGRGQSTMVTVLAPIKYELEYPSIHRGTSQLHEYGVGGKMVGSLLTSLEDPVLSKWVFVALALSVALNSYLFKAARLGIKDPNLPSHPVDPVELDQAESFNAAQNQTPQIQSSLQAPQTRVFTPTTTDSDSDASLVLIKASLKVTKRAEGKTATSELPVSRTQIELDNLLKQNTISELNDEDVVALSLRGKVPGYALEKSLKDCTRAVKVRRSIISRTPATAELTSMLEHSKLPYENYAWERVLGACCENVIGYMPVPVGVAGPIVIDGKSYFIPMATTEGVLVASASRGSKAINLGGGAVTVLTGDGMTRGPCVKFDVLERAGAAKIWLDSDVGQTVMKEAFNSTSRFARLQSMRTTIAGTHLYIRFKTTTGDAMGMNMISKGVEHALNVMATEAGFSDMNIITLSGNYCTDKKPSALNWIDGRGKGIVAEAIIPANVVRDVLKSDVDSMVQLNISKNLIGSAMAGSVGGFNAQAANLAAAIFIATGQDPAQVVESANCITLMNNLRGSLQISVSMPSIEVGTLGGGTILEPQGAMLDMLGVRGSHPTTPGENARQLARIIGSAVLAGELSLCAALAAGHLVKAHMAHNRSAPASSAPSRSVSPSGGTRTVPVPNNALRPSAAATDRARR

SEQ ID NO: 35015 - protein, 503 aa, Aspergillus nidulans FGSC A4
MIVDTDVLIIGAGLSGVGFAIQLQKKYPRITFEIYEKAEGFGGTWWANTYPGCACDVPSHLYSYSFALNPDWSEQFASQAEIAAYCRAVAEMHDIPRHVTLRSTVQSATFDEYLGTWAVKILDQQTGRIYERHSRVLITAVGMLSEPKDCDIPGAEEYNGRLFHSACWDHEFEWAGKEVVVVGNGCSATQFVPILTNTPGSAKQVTQFIRQPHWLEPRPNPEYPSAIKWIFRHVPLVMRCFRYAIFLYLESYFSTFKRVSGKRTREARMKSQAAYLKKMAPKKYHEILTPRIELGCKRRVMDTDYLACLHRENMELIHDDPIERITVDGVRTKSGRKIYADAIILATGFKTAQPLFPLGDNIRGEGGVTLSEHWESTASHAPQAYYGTCVSRFPNMFILVGPNTATGHTSVLFTVECQIDFTLKVLDPILNSLYPESSSSSSSVLQEMICFLRKPFSSGPRAGKKLALPPDIVSVTSQAEEKESQWIDEAILKELWKVFAAEP

SEQ ID NO: 35016 - protein, 356 aa, Methanopyrus kandleri AV19
MNVDAVVLAGGFGTRLRPLTWDTPKPLVPILGKPLIEWVIRSLPRDVVHVHIAAGFSSEKLERYVESDPLPRKLHLKVEPKPLDTAGAIKFACRDSTADAFVAFNGDIVSSLDVRQMLKFHREHDGIATIALYPVPEDEVSRFGVVDLDDDDRILDFVEKPEPEEAPSNLINAGAYVLDREVLDYIPEGRPVSIEREIFPKLAEEGLLYGFKFEGYWVDVGLPETYLEAHRVLMEHECSGKSVVGARITDTDLKPPVVAAPMTELRSSEIGPYVYVGERTEINGSVIENSVILDDVEIIDSEVRNTIVAEGCKIENARLDGCVLGHDAEVCGCNLKGVRVAPGKEAERDLEDEWVI

SEQ ID NO: 35017 - protein, 371 aa, Corynebacterium diphtheriae NCTC 13129
MKSMSSITFKKIDHPNPTPADKVQEIVANPGFGKYFTDHMVTIDWNETEGWHNAQVQPYAPVSLDPAASVFHYGQAIFEGLKAYRHADGTIRTFRPEANAARFQRSAQRLAMPELPIEVFIESIQQLVSVDHDWVPAAGGEESLYLRPFMIATETTLGVHSSKSYRYFVIASPAGAYFSGGIKPVSVWLSEDYVRAAPGGTGAAKFAGNYAASLIAQTQAAEKGCDQVVWLDAIEHNYIEEMGGMNLFFVMGKGDQAHVITPKLSGSLLPGVTRDSLLQVARDLGYTTEERLVSKGEWEETATSGAMSEAFACGTAAVITPVGSVKSTHGEFLVNNNEAGSITMQLREALTGIQRGSVADTHGWMHTLVEA

SEQ ID NO: 35018 - protein, 649 aa, Corynebacterium diphtheriae NCTC 13129
MAHSVVMPELGESVTEGTITQWLKSVGDAVTADEPLLEVSTDKVDTEVPSPVSGVLLEIKFEEDDTVDVGDVIAIIGEEGDAPAAKEEPAEEPKAEAPKAEAADSTDVVMPELGESVTEGTITQWLKSVGDTVDVDEPLLEVSTDKVDTEVPSPVAGTILEILFNEDDTVDVGDVIVRVGTPGSAPAAKEEPAKEPKAETPKEEPKAEAPKAEAADSTDVVMPELGESVTEGTITQWLKSVGDTVDVDEPLLEVSTDKVDTEVPSPVAGTILEILFNEDDTVDVGDVIVRVGTPGSAPAAKEEPAKEPKAETPKEEPKAEAPKAEPKKEAPAKTINNENVPYVTPLVRKLADKHGVDLTTVEGTGIGGRIRKQDVLAAAGVGAAPAAQVAPAQPVSAASTKSVDPEKQKLIGTTQKVNRIREITARKTVEALQISAQLTQLHEVDMTKVAELRKANKPAFQEKHGVNLTYLPFFAKAIVEALVAHPNVNASYNAETKEMTYHADVNLSIAVDTPAGLLTPVIHKAQELSLPELAKAIVDLADRARNNKLKPNDLSGGTFTITNIGSEGALSDTPILVPPQAGILGTGAIVKRPVVITEDGIDSIAIRQMVYLPLSYDHQIVDGADAGRFLTTIKDRLETANFEGDLELS

SEQ ID NO: 35019 - protein, 308 aa, Kluyveromyces lactis NRRL Y-1140
MNRYPGDFGKFARSVQRQLARAQQSGGKYPSGQPPRGAFGALGGLFLLIGGGFLANEALFNVDGGHRAIVYSRINGVQPRIYPEGTHFIIPWVENPVVYDVRAKPRNVSSLTGTKDLQMVNITCRVLSRPNVENLPMIYRTLGVDYDERVLPSIVNEVLKAVVAQFNASQLITQRERVSRLIRENLVRRAKHFNIMLDDVSITYMTFSPEFTNSVEAKQIAQQDAQKAAFVVDKATQEKQGMIVKAQGEAKSAELIGEAIKKSKDYVELKRLDTAREIASILSRSPNKVILDNEALLLNTVTDSRSKN

SEQ ID NO: 35020 - protein, 478 aa, Corynebacterium diphtheriae NCTC 13129
MAFTSTEDVIKYIKEENVEFLDIRFTDVPGREQRITIPASMFTEEAAEDGFAFDGSSIRGFTTIDESDMNLHPDIATAMVDPFRKAKTLNMKFFVHDPFTREPFSRDPRNVARKAEQYLASTGIADTCFFGAEAEFYVFDKVSYEIEGNRSHYEVDSDNGWWNRGVDQNLDGTHNRGYKTPFKGGYGQCAPYDTLEDLRDEMTLTLRDAGFDIERQHPECGTGSQQEINYRFNTLLHAADDLQTFKYIIKNTAFRNGKTATFMPKPLAGDNGSGMHAHQSLWKDGKPLFHDEVGYAGLSDMARYYIGGILHHAGAVLAFTNPTLNSYHRLVPGFEAPINLVYSQRNRSAAIRIPITGSNPKAKRIEFRAPDPSGNPYFGFAAMMLAGLDGIKNRIEPHAPVDKDLYELPPEEAASIPQAPTSLEASLKALEEDNEFLTDGDVFTDDLIDAYIKLKYDNEIAPVRLRPTPQEFEMYFDC

SEQ ID NO: 35021 - protein, 967 aa, Oryza sativa (japonica cultivar-group)
MATLKRKADSAAAELASPPPKAPRGSEALAESPSLAGGGSEPVACVHDVSYPEGYDPSAPATHLLNGVGGAEGAGPAKTFPFQLDPFQAEAIRCLDNGESVMQRVIYTSPIKALSNQKYREFKEEFSDVGLMTGDVTIEPNASCLVMTTEIWRSMQYKGSEVMREVAWIIFDEVHYMRDRERGVVWEESIVMAPKNSRFVFLSATVPNAKEFADWVAKVHKQPCHIVYTDYRPTPLQHYVFPSGGDGLYLVVDEKSKFREDSFQKGLNALVPASENDKKRENGKWQKGLLTGKPSEDSDIFKMVKMIIQRQYDPVILFSFSKRECEFLAMQMAKMDLNDDDEKANIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMILKGSADSLNSAFHLSYNMLLNQIRCEDGDPEKLLRHSFYQFQADRVLPDLEKQVKELELERNSMIIEEEENLKSYYDLLQQYKNLKKDVRDIVHSPKYVLPFLQPGRLARVQYSTDEQSTFSIDENITWGVTINFEKVKTHSEDRRPEDSDYTVDVLTRCSVSKDKSGKKTMKIIPLKDRGEPVVISLPLSQIDGLSSIRMHIPKDLLPVEARENTLRKVDEVISRFAKDGIPLLDPEEDMKVQSSSFRKASRRIEALESLFEKHDVHNSPHIKQKLKVLHAKQELSTKIKAIKRTMRSSTALAFKDELKARKRVLRRLGYITSEDVVEVKGKVACEISSADELTLTELMFSGTLKDATVEQMEKLQDAPKPREELDLLFFQLQETARRVANLQLDCKIQIDVESFVNSFRPDIMEAVYSWAKGSKFYQIMEMTQVFEGSLIRAIRRLEEVLQQLILASKSIGETQLEAKLEEAVSKIKRDIVFAASLYL

SEQ ID NO: 35022 - protein, 132 aa, Thermosynechococcus elongatus BP-1
MTKVIIYTTDAPMPVGPYSQAVRQGEWVFLAGQIALDPKTGEIVGGEDVKEQTRQVMENLRAVLKAAGSDWSQVVKTTVYLADLNDFGAMNEIYAQYMDAEAAPARACVEVSRLPKGVKVEIDCIAYCPTTV

SEQ ID NO: 35023 - protein, 359 aa, Triticum aestivum
  misc_feature (65)..(65): Xaa can be any naturally occurring amino acid
MSAYCGKYKDELIKNAAYIGTPGKGILAADESTGTIGKRFASINVENVEDNRRALRELLFCTPGXPLQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDATLGEGASESLHVKDYKY

SEQ ID NO: 35024 - protein, 352 aa, Oryza sativa
MAEEREVPFGGYPREEIQWRRGGPVAQRIRARGYEPRCRGFESLLAHSLPKGKGLYFPPEGRKTMIGIADVKLLNLEKYMKKKGGRKIFGFMVKEEKEENWGSVEFQVFSFTNKIRRLASHLELHKKDFSSERGLRRLLGKRQRLLAYLAKKNRNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRRFKKAKNSEWNDFEYRFLGKKPSPNFELSKQELYARVEAPKGELGIYLVGDDSLFPWRWKIRPPGFINLQILPQLVKKMKLADIMTILGSIDIIMGEVDR

SEQ ID NO: 35025 - protein, 783 aa, Rhodococcus sp. RHA1
MHDTLPVAPGTATPPAQAGGPVDLETLETIRQRVLWLSTSMIHHANRIRPNPTGLKVGGHQASCASMVSIMTSLWFEQLQPGDRVSVKPHASPVLHGINYLLGELDEKYLTTLREFGGLQSYPSRSKDPDTVDYSTGSVGIGATAPIWGAMARRYVETTTGGAGTGRQYSLVGDAELDEGAVWEAILDPGIADLGEVVWIVDLNRQSLDRVIPNIAANRLEKMFDAAGWQVITVKFGRLLEELFTRPGGQALRTRILDMPNPEYQRLLRCSADEVRTRLPGNGPGSTEISALIAGLDDATLTAAIRNLGGHDLSALTAAYRQIDDTRPTVIIAYTIKGYGLPTQGHPQNHSSLLSVDEYASLAADLGMDPASPWGRFAADSAAGRRCASNAERLRRNPVPALPALTIPTDIGRTPKGTATTQAALGRVLLDLTREAPEAAKRVVTVSPDVSSTTNLAGWVNKVGVWSAAERRNWFDDDRETIMHWNERPTGQHMELGIAETNLVGLMGELGATWSRWGQPLFPIGVMYDPFVERALEPWSYGIYAGGQSILVGTPSGVTLAAEGGAHQSIKTPSIGLEQPGCISYEPAFAIDTEWTLLASIGRLGRPDGTSAYLRLSTRPVDQTLAAVPTDPAARECRRRQVVAGGYPLVRRDDAQVTLVAIGAMITEALAAADRLAEQGIPADVVCITSPGLLFEAVQGRQGRGSGESWILDQLFPADRATPIVTVLDGHPHTLAFLAGINQVRSTALGVSKFGQVGSLDEVYRYHGIDTDSIVRAALDIIP

SEQ ID NO: 35026 - protein, 129 aa, Triticum aestivum
MAAHQQQPQSQSQQQAVGFEDYLPVMAERLGEEGLMEELAAGFRLLMDPASGLITFDSLRRNAPLLGLGGMSDDDLRGMLAEGDFDGDGALSQMEFCVLMVRLSPDLMDEPRRWLDDAVAQASHFLFTS

SEQ ID NO: 35027 - protein, 322 aa, Pseudoalteromonas tunicata D2
MRRLPPVLLEDGCSRELLSLIRTILAACKEISFRVGQGALSGVLGSTLDENIQGETQKKLDVLSNQLLKDILLETGYVKAIASEEEDYTVAGNPDAKFIVAFDPLDGSSNIDINSLVGTIFSIMEAPEGSDANDPSIFMQPGDKQVAAGYVLYGPSTMLALTVGKGTRIFTLDKTHGSFLLTHDFAQIPAKTNEFALNMSNQRHWQPAMQNYVADLLAGEDGPRKENFNMRWIAAMVGDVHRVLTRGGFFSYPADTKDPKKPYKLRLLYEANPMAMLIEQAGGIASTGTERIMSIQPDAIHQRVAVILGSKDEVETCLSYHN

SEQ ID NO: 35028 - protein, 301 aa, Arabidopsis thaliana
MTEEFDTTGVCTGTWWSSSNGMFSGCSLPRSAEIVVDFGEIEWQNIDTLDAKTYNENYLSTSTFLGNANLDTTSQIYVSSPSNIHEEERYNQINSFLEGLFDSSEQLLVPNCPKPELFESFHFFDDVFPNESRMISVFDHQKPKEDMQACKSLTTCKRASEKSGELEDIESSQPLKRPRLETPSHFPSFKVRKEKLGDRITALQQLVSPFGKTDTASVLHDAIDYIKFLQEQITEKVSTSPHLNSIGSGEQKQWSDKSSNNTHNQNCSPRQDLRSRGLCLMPISSTFSTPPQHLDTSSLWN

SEQ ID NO: 35029 - protein, 466 aa, Pseudomonas syringae pv. tomato str. DC3000
MLGYFAKSGNLFQSFPYDFDLYVIGAGSGGVRAARFSAGFGAKVAVAESRYLGGTCVNVGCVPKKLLVYGAHFADDFENSRGFGWTPGEAKFDWATLIVNKDSEINRLNDIYRNLLVNSGVTLHEGHAKIIDPHTVEVNGERHTAQNILIATGGWPQIPDIPGHEHAISSNQAFFLKELPKRVLVVGGGYIAVEFAGIFHGLGAKTTLLYRGDLFLRGFDGAVREHLQVELTRRGMDLQFNSDIERIDKQADGSLKATLKDGRQLEADCVFYATGRRPMLDNLGLENTGVKLNKKGFIEVDELYQTAEPSVLALGDVIGRVQLTPVALAEGMAIARRLFKPEQYRPVDYRMIPTAVFSQPNIGTVGMTEEDSREAGHEVVIFETRFRPMKLSLTECQERTLMKLVVDAKTDKVLGCHMVGPDAGEIVQGLAIALKSGATKRDFDETIAVHPTSAEEFVTMRTPVGS

SEQ ID NO: 35030 - protein, 618 aa, Spinacia oleracea
MASSLSNLYSSTSLKPKISHLPTITKNPISGPKSLSFKPISSVARDTPADLSTSSSSSTNNLPSLQKKKADGSLEKDPRALWARYVEWLYQHKDLGLYLDVSRIGFSDEFVKEMEPRFEKAFKHMEGIEKGAIANPDEGRMVGHYWLRNSSLAPTTFLKNQIDVTLDRVWQFANDVISGKIKAPTGERFTHILSVGIGGSALGPQFVAEALAPDNPPLKIRFIDNTDPAGIDHQIAQLGPELATTLVMVISKSGGTPETRNGLLEVQKAFRDAGLVFAKQGVAITQENSLLDNTARIEGWIDRFPMFDWVGGRTSEMSAVGLLPAALQGIDIKEMLAGAALMDEATKIPVLRSNPAALLAMSWYWASDGVGSKDMVVLPYKDSLLLFSRYLQQLVMESLGKEFDLDGNKVNQGLTVYGNKGSTDQHAYIQQLRDGVHNFFATFIEVLRDRPPGHDWELEPGVTCGDYLFGMLQGTRSALYANNRESISVTVQEVTPRSVGAMVALYERAVGLYASLVNINAYHQPGVEAGKKAAAEVLALQKRVLAVLNEASCKDPVEPLTIEEVADHCHCPDDIEMIYKIIAHMAANDRVILAEGDCGSPRSIKAFLGECNVDELYA

SEQ ID NO: 35031 - protein, 275 aa, Bacillus cereus E33L
MELWFTEKQTKHFGITARINRTLHTEQTEFQKLDMVETEEFGNMLILDGMVMTTEKDEFVYHEMVAHVPLFTHPNPENVLVVGGGDGGVIREVLKHPSVKKATLVEIDGKVIEYSKKYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 35032 - protein, 1002 aa, Aquifex aeolicus VF5
MKVVIVGNGIAGTALVEEILRLSSGKDIRIQVFGDEKFIGYNRVLITEVLAGRKTLSEIYIKRWQWYEEKGVRLEIGKKVERLFPNKKILVTKDGEFYRYDKAIIATGSKPFIPPSIKGVNKKGVFTYRTAKDVFEILDYARVSKRAVVIGGGLLGIEVTKALRDIGLEVFLVHILDTLMEQQLDKTASELLRKDLEDMGIKVLLKKVTEEILGEKKAEGVRFSDGDELLADFVIIATGIRPNVEVGVNSGLKVNKGIVVNDYLETSASDIYAVGECIEHRGKTYGLVAPIMEQVKVCAHNVVHGNEKKYTGSLTYAMLKVAGVNLFSAGEINEKDGDEVVAFLDNGRSLYRKAVIRNNKIVGTILYGDVRGNNYLLDLIKSGKDISEERPYFLIKHILPKGTTGVEELKDNDIVCNCNAVTKGEIVKCIKEGCKTLEEIQERTKASTSCGSCIELVEEILKHYVKEKPKRVNKIEVIKKELHPFDLEFKKRLEKYFSEGELENIPEEDRDVRLKWYGIFYRKATPGYFMVRIRVPNGRLSYEQAKVVSHISEKFCRGEVEITSRQQLQIRWIKLKDLPEILEALNRVGLSTLQTGMDNVRNVTGDPLTGLAEDSLIDTLRLSQEITNIFLGKKKYADLPRKLNVAVLGSQTDCINALFNDVCFYLSEKDGKLGFNLYLGGKIGSGGPKKAIDMDMFVEPYEVPEVFKATLDIYSTFGNRENRSKNRLYFLLQEWGVERFREELEKRLYKAIPSKGKDLVNKTGEREGIINLRNGTYAVCVVVPAGKIKAKDFRQIAELARKYGSRELRLSVYQNIYIPNIPEENLNPLLGEEIFEKFSTVSSPFTMHLIACAGSDTCSFGVIPNKSDAVRVAKYLSERLKLDIPVRMHWSACAKGCGQHGSGDIGFVGTKTKLNGKAVLAVDVFVGGSPTKEGFKVIQGLPLDKVEEASYLLLNYYLENRLEGESFADFAHRVGVDKLKVVLTSLLQEGECKLLKPESISK

SEQ ID NO: 35033 - protein, 567 aa, Thermosynechococcus elongatus BP-1
MVELTAGQRQVTDDLDQLLAILPPPLGQSLTDHPQREELLEIVLDLGRLPEARFIHSTQYLAETPVSREMLQYAVDRVGEFSGDNRAGIERTLHRISALRNRQGTIIGLTCRVGRAVFGTIGMIRDLVESGQSILLLGRPGVGKTTALREIARVLADELHKRVVIIDTSNEIAGDGDIPHPAIGKARRMQVARPELQHQVMIEAVENHMPQVIVIDEIGTELEALAARTIAERGVQLIGTAHGNQIENLMKNPTLADLVGGIQSVTLGDEEARRRGTQKSVLERKAPPTFQMAVEMLERDRWVVHLDVAASVDLLLRGRQPVPEIRSIAADGSVVISRPEPAPQRLEVKSVPERPSWRESGQMLPVVDANKEPLRANFAQLLEATLDAPTVGPNGEELPLHVFPYAVSRHHLEQAVRTLNLPIIVTKDIDQADVILTLRSHLKGESKLRHLAHIHHLPIHAIKANSMAQIVRGLRHLLGIEDPSPAESADLSLFSPTGSDDELEALEEARLAVEEIVIPKGQAVELLPRSAKIRRMQHELIEHYQLTSCSFGEEPNRRLRIYPNLSR

SEQ ID NO: 35034 - protein, 537 aa, Triticum aestivum
MDARRVGGRIAAARRALTGAGAGALPLPVRITNGLAMVSLVLSSCDLLRLCSDPGRPLRFPLGGREFATVVCQLASVVYLLSLFAVPFAQSASGRREEGQDGSRRSPAAVAPAPMPDCPDDGDEEIVAAVVSGELPSHRLESRLRDCRRAARLRREALRRITGRGLEGLPFEGIDYEAILGQCCEMPVGYVQLPVGVAGPLLLDGRDYHVPMATTEGCLVASVNRGCRAIAASGGAFSVLLRDAMSRAPAVKLPSAKRAAELKMFVEAPANFEALAAVFNKSSRFGRLQGIQCALAGRNLYMRFTCSTGDAMGMNMVSKGVENVLGYLRNNFPDMEVISISGNYCSDKKATAVNWIEGRGKSVVCEATIKGRVVQSVLKTTVEKLVELNIIKNLAGSAVAGALGGFNAHASNIVTALFIATGQDPAQNVESSQCITMLEAVNEGKDLHISVTMPSIEVGTIGGGTSLTSQAACLNLLGVKGPNHGSPGANARLLATIVAGSVLAGELSLLAALAAGQLVKSHMKYNRSSKDVANAAS

SEQ ID NO: 35035 - protein, 236 aa, Thermococcus kodakarensis KOD1
MKTALITGATGGIGRALSERLVRQGYHVICVARREDKLRELSKALKSFDYIAADLSDTEAPAKIRDALASMGIRKLDLLINNAGYAIRKPLLEHSSEELENIFRVNVFAPIWLTKELLPFLGKGSKVVFVISGVAFVNVPEIPSYCATKGALHYLTINLEKELAELGISTIRVYPKQVKSEFWKGKIPRGSIEPERVADAVLNGIKKNKREVFVPGYLKLVKYLPNWPVFTYRFRY

SEQ ID NO: 35036 - protein, 668 aa, Exiguobacterium sibiricum 255-15
MKQTADMLTLTPEELDERYAYKGSDLGATFDEHTIRVRLWAPTAERVVIRLYRTLRARKVEELELTADQQGTFVVELDRAVYEGYFYTFQASINGQKVEAVDPYAKAVGTNGKRGALIDPSAIHPERWIEERPLFHSSQDAVIYELHVRDATSHPASGVIERGTFRGLTEAGTRTPAGGLTGLDYLTDLGVTHVQLLPIYDFGSVNEAAPNDPDNYNWGYDPVNYFAPEGSYSSNPDDPAARIRELKALIQALHDRGIRVVMDVVFNHVYDAETAPLGQFVPGYFFRQAADGTLSNGSFCGNDTASERFMMRKFILDCVTYWAKEYHLDGFRFDLMGLHDVETMIQVRHALDRIDPSILIIGEGWDLDTPLAADQKANYFNAPQMPGIAHFNNGLRDGVKGDVQTPADRGFISGAFERTNEVKRGIAGNVSSQGFADEPNQVVSYVEAHDDLTIWDKLSVSKPEDTDEIRRKRQMLANAIILTGQGIPFLHAGQEFFRTKNGIRDSFNSGEVVNQLDYERAEQFRAGVEYVKGLIALRRQYPMFRLENTAMIRKHLRFLEEGEGIIAYELKRTYEGYVERQRVYHNATDHDVTIELPSGEFEILVEEGVVKIHAPRLHEEKQLVVKALSTTVIAERKADYKKYAVAGGAALTILGLLYAANKRRKNNK

SEQ ID NO: 35037 - protein, 154 aa, Glycine max
  misc_feature (122)..(122): Xaa can be any naturally occurring amino acid
SNYSTVGLNIGRIEVANSKLVFWDLGGQPGLRSIWEKYYEEAHAVIFVVDASCPSRFEDAKSALEKVLRHEDLQGAPLLILANKQDIPEAVSADELPQYLDLKKLDERVFMFEAVSAYDGMXCRESAEWLVEVMERSKRTEMLRARAGAMGAGP

SEQ ID NO: 35038 - protein, 184 aa, Arabidopsis thaliana
MKVFSNDETFEYSWEEVSTANWMKYCPWNDKSTHVIAVDTLSRSVDTETGILRTERLITCKQSAPNWLNSLMGGNETSHVFETSYVDPEKKKVTMVSSNLTFSNIINVRETVTYKPLSSTRTQFSQDAKITALCGGWQKIKNAVEEATVDRFSENARKGKEGFENVLKMSRRVFGEERLRQQDQ

SEQ ID NO: 35039 - protein, 458 aa, Silene noctiflora
KKALSVDEKYSQWKSLVPILYDWLANHNLVWPSLSCRWGPLLEEATYKNRQRLYLSEQTDGSVPNTLVTANVEVVKPRVAAAEHISKFNEEARSPFVRKFKTIIHPGEVNRIRELPQNSNVVATHTDSPDVYIWDLESQPNRPVNLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADNSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVATCSPTPTK

SEQ ID NO: 35040 - protein, 318 aa, Silene latifolia
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMQTGLKGSMEPLLEEADIDKDGRISLAEFRRLLRSASMSS

SEQ ID NO: 35041 - protein, 1176 aa, Phycomyces blakesleeanus
MSLPNHSGSSAFKSFSYIVGTGIKRAAKLSTRNPIEMIVVVLILSSFSYFYLFNLARTSDIFSGTVTRLYPTSVYAPTKDHSFSVVDRTADSTIANNAVKVHLHQIVVSDPKHGVLSRQTLASVLRFQQMAENEIYVPDSTAVNRFAFNKDLCYKTTLPSSYSSHSSDSNSNSNLNSKTSPCFAHSPADIWQDEATLLADKNIRSTIEANLDTAKNVFGDLQLNATYASSVTLSYAFNTTGDYREHLADMWKHKVATLPPADLVSLSNIGQQENVFAWLFIVTRNVIFRVKELIDLADNIDIIVILVGYIMMIATFISLYVNMRAMGSRYTLATAVVFNGFFSFMLALLTVRALGVDVYPVVLAEAIPFLAVTIGFERPFKLTKRVFQFSKETPLTKQEIRTTIMRAVDTVALPIARDCFMEIIVLVLGAKSGISGLEEFCLLSAILLAYDFIIMFTWYTAVLALKLELLRIREINGISADDIKKGTKKSTGYIRRTVIKAFSDDHAAGANTANQKADGPIIGRVKLLMIVGFVVMHIFKFCSAFQSVGPQVNITEPSIAVVLDQLLEQHKASSQASLPLFVQVFPAMPFHVATVNKSFVPDAITRPLEALFDTYAVYIQHPVISKWLTIALFVSLFLNTYLFNVAKQPKQIVEQVNQDKKITNAIESTNNTHIEVTEKQKPTIQSPGPVVSSAVVMSPNHKRSHNHHHSHSHSHNHHSNHHQSDIVRPIDECVALVRTPEMLNDEEVISLVENGKMASYALEKVLGDLQRAVGIRRALISRASITKTLEASALPLENYHYDKVMGACCENVIGYMPIPVGVAGPMNIDGDLIHIPMATTEGCLVASTARGCKAINAGGGASTIVIADGMTRGPCVEFPTILRAAACKLWIENEGNDIVTNAFNSTSRFARLRKLKIALAGKLVFIRFSTTTGDAMGMNMISKGCEKALSIITEHFPDMQIISLSGNYCTDKKPAAINWIEGRGKSVVTEAVIPGAIVEKVLKTTVAALVELNISKNLIGSAMAGSVGGFNAHAANILTAIYLATGQDPAQNVESSNCITLMKAVNDTKDLHISCTMPSIEVGTIGGGTILPPQQSMLDMLGVRGPHPTEPGKNAQRLARIICAAVMAGELSLCAALAAGHLVKAHMAHNRGTQAPTITSGPAPSTGTEPGTCIKS

SEQ ID NO: 35042 - protein, 318 aa, Silene latifolia
NFLFKSPKEDSPLKATDFGLSDFINRSRKFTDIVGSAYYVAPEVLKRKSGPESDVWSIGVIMYILLCGRRPFWDKTEDGIFKEVLRNKPDFRRKPWPSISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 35043 - protein, 434 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLSALFLIIILQVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 35044 - protein, 666 aa, Aquifex aeolicus VF5
MKRFQCPYCGVGCGLYINEKGKVKGDFEHPANLGDICKKPLYLPKVLNRGRIAKPMYRENKSHSFREISWEEAYEILKEKLISFSPDETYFYLSGQLLTEDIYVANKFVKGFLRTNNVDANSRLCMASAVTAYKLAFGSDGVPCTYEDVDDADAFLFIGSNAAVAHPVLFKRVLKRRKEEEKVIIVTVDPLETETAKRSDVFIQIKAGTDTVFLNSVLYVLHKEGWIDYRFIYNYTEGFEEALEVAMKFPPDVAASICSVKPEDVYLVAELFAHSKKLISFWCQGLNQSLNGTMKNLALINLHLATGRLNEKGCPFSLTGQPNAMGGREVGYLTNGLPGYRDVRNKADRAFMEKFWGVKGIKKEPGPTITEAIDMILKDRIKFLWVVCTNPAVSLPNLEKVKRALEKVFLVVQDAYWNDTCEFANLILPAAQLGEKEGVMTGSDRTVTFCERFSEPFGESKPDWLIFTELARKMGAEELFPYSSPKEIFEEFKASTKGRLCDMSNLSYENLPARWGKRWLYEDLKFPTESGKARFHPARVDVAAEEGMFILLTGRLKNNWHTMTRTGKSPELLKGEIPPFVIMNPRDAEELGIEEGEEVILSAKGKEITRVVRFGNVKRGHIFAPFGYPSEYGEPTNLLTSDRTDPYSKEPDLKYSGVDVFVKVNR

SEQ ID NO: 35045 - protein, 302 aa, Xanthomonas campestris pv. campestris str. ATCC 33913
MSLSGIITALATPFGPDGTLDLDAWRRLLEQQLHGGVQGIVVAGSTGEAAALSDDEYDTLVRAAVAQVAGRVQVLAGTGLSGTAKTIAQTRRAATLGAQYALVVTPPYVRPTQAGLLAHFQAVADNGGLPVVLYNVPGRTGCDLLPETVAALVSHPNIVGIKEARSEPERVAALVAMRSDRFVVLSGDDGSAAQSMLAGADGLVSVASNALPSAYRRLCDLARTGQHEAANAWDTRLSEYHSFCGIESNPIPVKALLQRAGIGHGLRLPLLPLSAAHQPAADRLAANAVALEALSSREMLAA

SEQ ID NO: 35046 - protein, 333 aa, Brassica napus
TLSKTTKGYIRPPTKSWIVSFGEMLIDFVPTVSGVSLSEAPGFIKAPGGAPANVAIAVARLGGRAAFVGKLGDDEFGHMLAGILKQNGVSAEGINFDTGARTALAFVTLRSDGEREFMFYRNPSADMLLRPDELNLDLIRSAKVFHYGSISLIVEPCRSAHLKAMEVAKEAGALLSYDPNLRLPLWPSKEEAKKQILSIWDKAEVIKVSDEELMFLTGSDNVDDETALSLWHDNLKLLLVTLGEKGCNYYTKSFRGSVDPFHVDAVDTTGAGDSFVGALLCNIVDDRSVLEDEARLREVLRFANACGAITTTKKGAIPALPTVSEVQTLLNGN

SEQ ID NO: 35047 - protein, 529 aa, Thermosynechococcus elongatus BP-1
MSPHFSLTTPLYYVNALPHIGSAYTTIAADVLARFYRLQGYQVRFITGTDEHGQKIERTAQQRGLSPQAHCDEIAAGFQALWQQLNIHYDRFSRTTSPRHHAIVNEFFQRVWDNGDIYLGQQQGWYCVECEEFKEERELLEGRRCPIHVNRTVEWRDERNYFFRLSKYQQALLDHYAEHPDFVQPPSRRNEVLSFIERGLQDFSISRVNLAWGFPVPTDPEQTLYVWFDALLGYVTALLEPEDEPTLANALKTWWPINLHIIGKDILRFHGISWPAMLMSAGLPLPEQIFVHGFLTKDGQKMGKSLGNTLDPFALVAQYGADAVRYYFMKEVEFGRDGDFSETRFVTILNADLANDLGNLLNRTLKMAWKYTDGKVPNVQGAAIPREHPLRQLAEHLSQTYGQGYRQLAFHEVCQQALTLARAGNKFLDEEAPWKRYRAGETAAVAEILYCVLESVRLVAYVLAPIIPQLSEAIYGQLGYSIRFNGSIAPDLLGDRQAQWGVLPASQPLANPEPIFQKLLLPATVADSP

SEQ ID NO: 35048 - protein, 607 aa, Zea mays
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYEERGEEFVDMLDGVFSFVLLDTRHGDRAGSSFFMAARDAIGVTPLYIGWGVDGSVWISSEMKALHDECEHFEIFPPGHLYSSNTGGFSRWYNPPWYDDDDDEEAVVTPSVPYDPLALRKAFEKAVVKRLMTDVPFGVLLSGGLDSSLVAAVAVRHLAGTEAARRWGTKLHSFCVGLEGSPDLKAAREVAEYLGTLHHEFHFTVQDGIDAIEDVIYHTETYDVTTIRASTPMFLMSRKIKSLGVKMVISGEGSDELFGGYLYFHKAPNKEGLHRETCRKVKALHQYDCLRANKATSAWGLEARVPFLDKEFINAAMSIDPQWKMVRPDLRRIEKWVLRKAFDDEEQPFLPKVHILYRQKEQFSDGVGYSWIDGLKTHAASNVTDKMLSNAKFIFPHNTPTTKEAYYYRMVFERFFPQKSAILTVPGGPSVACSTAKAIEWDTQWSGNLDPSGRAALGVHLAAYEHQHDPEHVPAAIATGSGKKPRTIRVAPPGVAIEG

SEQ ID NO: 35049 - protein, 600 aa, Zea mays
IRTILPLARLRPPRQRDYARRHQPKPLSPVSRLHSLANNTRPPLALLRQQTVPGRCHCRLLTSAFVFASASGSPAPASHLKGRSSRLSEVDMTLLCVPLVGRTVEEMITDAAAAAATGGDMVEIRLDFIQGFRPREHLPPLLRGCPLPALVTYRPVWEGGQYEGDDTTRFETLRLAMELGVDYVDIELKVADKFMSFIAGHKPEKCKLIVSSHNYEYTPSCEEITNLVASIQAVGADIVKVATTAKDIVDVSRMFQVMVHCQVPMIGLVMSEKGLMSRVLAPKFGGYLTFGILNATKTSASGQPTVEDLLDIYNIKCIGPDTKILGLIANPVKQSKSPILHNKCLQSIGYNAVYLPLLGDNLASFLETYSSPDFSGFSCSLPFKVDAVQCCDEHDPVAKSIGAINTIIRRPDGKLVGYNTDYIGAISAIEDGIGGPGSKDAVISPLAGRLIVVVGAGGAGKAIAYGAKEKGARVVIANRTYEKAVRLANAIGGQALRLEDLETFRPEEGMILANATSLGMYPNVDGTPIPKKALGFYDVVFDAVYAPKVTRLLREAEECGVKVVSGVEMFIRQAMGQFEHFTGGIEAPESLMREIAAKYT

SEQ ID NO: 35050 - protein, 204 aa, Oryza sativa
  misc_feature (131)..(131): Xaa can be any naturally occurring amino acid
MAVLVARQGRELQRYTSAGGRIVVGCIPYRVRSGGEMEVLVITSQKGHGMMFPKGGWELDESMDEAARREALEEAGVRGNTETSLGCWYYKSRRYDTTYEGFMFPLRVTDELLQWPEMSSRKRTWVSSSTXPPHRTLIHGNSPFYGENDRIRSTKERTRASKCRFDFVQATVQQAMDGCQHGWMREALERLVSRHATNKLQSAL

SEQ ID NO: 35051 - protein, 880 aa, Mycobacterium sp. JLS
MGPSHEATSRQYPIPSLAPMSTSISNGPARNVVVVGHGMVGHRFVEALRARDDAGAWRITVLAEETDAAYDRVGLTGYTEHWDRALLALAGNDYAGDDLVDLRLGQRVTSIDRAARTVKTADGTAFAYDALVLATGSYAFVPPVPGRDLPACHVYRTFDDLDAIRADAARARETSRAPVGVVIGGGLLGLEAANALRGFGLTAHVVERSPRLMSQQLDDAGGALLSRMIADLGIEVHLDVSTDAITPAQRNRPLRRSEEDDSLRVMLGDGSFIDAGVVVFAAGVRPRDELARDAGLAIAERGGVLTDLGCKTSDPSIYAVGEVAAIEGRCYGLVGPGYTSAEVVADRLLGGAAEFPEADMSTKLKLLGVDVASFGDAMGRTPDCLEVVVNDAVNQTYAKLVLSDDAKTLLGGVLVGDASAYGVLRPMVGEQLPGDPMALIAPAGSGGAEGGLGVGALPAAAQICSCNNVTKGDVTDAIAGGCCDVPGLKACTKAGTSCGSCVPLLKQLLEAEGVEQSKALCEHFSHSRAELFEIVSATEIRTFSGLLERFGTGKGCDICKPTVASILASTSSEHILDGEQAALQDSNDHFLANIQRNGSYSVVPRVPGGDITPEQLILIGEIARDFDLYTKITGGQRIDLFGARVEQLPEIWRRLVEGGMESGHAYGKALRTVKSCVGSDWCRYGQQDSVQMAINLELRYRGLRAPHKIKMGVSGCARECAEARGKDVGVIATEHGWNLYVGGNGGMTPKHAQLLAGDLDDETLIRYIDRFLMFYIRTADRLQRTAPWVEQLGLDHLREVVCDDSLGLASEFEAAMARHVEGYSCEWKGVLEDPDKLSRFVSFVNAPDVPDPTVTFTENAGRKVPVPIGMPSIRPLQETP

SEQ ID NO: 35052 - protein, 314 aa, Fragaria x ananassa
MAVASTSLASQLSGPKSLSQPYSGLRRSCPKLDQSHSSLFQHLSLSSSSRKASRAVVAMAGTGKFFVGGNWKCNGTKDLISKLVSDLNSAKLEPDVDVVVAPPFLYLDQVKSSLTDRIEISGQNSWVAKGGAFTGEISVEQLKDIGRKWVILGHSERRHVIGEDDQFIGKKAAYALNEGLGVIACIGEKLEEREAGKTFDVCYEQLKAFADAVPSWENIVVAYEPVWAIGTGKVASPQQAQEVHVAVREWLKKNVSAEVASKTRIIYGGSVNGGNSAELAKEEDIDGFLVGGASLKGPEFATIVNAVTSKKVAA

SEQ ID NO: 35053 - protein, 294 aa, Exiguobacterium sibiricum 255-15
MSQSNNPLTQYFNDDFPKQYQEAPAVQAKMEPVPDCGEESYKGSGKLKGKKALITGGDSGIGRAAAIAYAREGADVFLNYLPEEQQDAEEVKALVEAAGQKAYLLAGDLSDETFCQQLVKKAHDSLGGIDILALVAGKQQAVEDIMDLSTEQLRKTYEINVFSLFWVVKAALPLLKEGASIITTTSVQGYNPSANLLDYASTKFAINGFTRGLAKQVAPKGIRVNSVAPGPIWTPLQISGGQPSENIPEFGQETPLKRSGQPVELSSVYVFLASDDASYVTAQIYGVTGGIELA

SEQ ID NO: 35054 - protein, 337 aa, Oryza sativa
SGMSAISSVLMQLVGAGGHVVASRCLYGGTHALLSRFLPRASGVRATFVDADDEAAVRAAVRPGETRVVYVETMSNPTLAVADIPMLARVAHDAGAKLVVDNTFTPMVVSPARLGADVVVHSVSKFISGGADIIAGAICGPASLVNAMMDLQEGALMLLGPTMNAKVAFELSERLPHLPLRMQEHSRRAAEYASRMRRLGLRVAYPGLPDHPHHARLLAIANPGYGAGGMLCVDMGTEDRANRLMHHLQNTTRFGLMAVSLGYYETLMSCSGSSTSSEMPPEDRARAGISPGLVRMSVGYNGTLEQRWAQFERALSLMQQQQQQHPDRDAAAKYCKV

SEQ ID NO: 35055 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 35056 - protein, 318 aa, Triticum aestivum
KNAGNVPSSITPPSPMLPYATAAEAEAALGRAMTRAEAAWLRYSAFVPDHLLYCHNVAILLILYTIAPLPLALLELRARAAPDGVAAAVMRPSTYKLQPRAQLSPAAFLRCYLDTGRVLLLTVGALSLVSYPAVKMVGIRTGLPLPSAGEVAAQMLVYLLVEDYLGYWIHRLLHTRWGYHNIHRVHHEFTAPFGYAAPYAHWAEVLILGVPAFTGPAIVPCHMTTLWLWFVLRHLEAIDIHSGFNFPFNPTKLIPFYGGADHHDYHHRVGGQSQSNFSSVFTFCDYLYGTDKGYRYHKASLEKGLLKGDNKTKLQKGV

SEQ ID NO: 35057 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHENTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 35058 - protein, 136 aa, Triticum aestivum
LVSTYAYKQPDNAARLYLHVGGASADARWVPAERRATYAFLDKAAAAAAEDDGYDDERRGRRYTSSSSSSASRGPRWVLEVGPGRRVSAPVGQELQLKALPGQCRADFAAAGSVWALRFPNDAAFRRFREQYDRCL

SEQ ID NO: 35059 - protein, 318 aa, Silene dioica
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 35060 - protein, 318 aa, Silene dioica
NFLFKSPKEESPLKATDFGLSDFINRSRKFTDIVGSAYYVAPEVLKRKSGPESDVWSIGVIMYILVCGRRPFWDKTEDGIFKEVLRNKPDFRRKPWPSISNTAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 35061 - protein, 515 aa, Triticum aestivum
MADPQAEARGPPEPRAETLVELVRVNGSAAEATLSSAELAWRTTGAGRDSGGRRKLELESDVLGFQVEGRSLKLATFTRGDVTGAGRPPSPVGCGGGAEDRKRGEVAVEMESEEAAERWGHAIRDRFASLGRPKRLFFIVNPYASNHASGKIFQTEVLPLIEAAGIHYTMQETNYRLHAQEIAGSLDLRKYDGIVCVSGDGILVEVVNGLLQRDDWDKAIKVPLGIIPAGTGNGMVQGLLHSAGEPFSMSNAVFAIIRGHRRALDVTSVVQGKTRFFSVMMLTWGLVADIDIESEKFRWMGSARIDFYSLLRAVNLRRYNGRILFVPAPGYEGFGDPVEQTISCKSNGAANAAEGDITDVCNNETCTYSGPSTDDADLEWRSLKGPFVNVWISNIAFASEGVMIAPQAQFADGYLDAAIIKDCPWSVALGLLLRMKDGSYIESSYVEYFKVKALRIEPGLRVGSSTIGGIIDSDGEVLARGDRSQTKEEPEHLMAYGPPIQLTVDQGLATIFSPR

SEQ ID NO: 35062 - protein, 318 aa, Silene diclinis
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFNEFVAATLHVHQLHELDNEKWQELSQRAFEKFDVDKDGYITPDELRMHTGLKGSMEPLLEEADIDKDGRISLAEFRRLLRSASMSS

SEQ ID NO: 35063 - protein, 318 aa, Silene diclinis
NFLFKSSKEDSPLKATDFGLSDFINPGRKFHDIVGSAYYVAPEVLKRRSGPESDVWSIGVITYILLCGRRPFWDKTEDGIFKEVLRGKPDFGRKPWPTISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGKISLAEFRRLLRSASMSS

SEQ ID NO: 35064 - protein, 268 aa, Corynebacterium glutamicum ATCC 13032
MDTSTVLFAFGLTLFAGLATGIGGLIAVARKTVTEGFLAGSLGFSVGVMLYVSFVEILPGAFDELTSVWGEKGGSWAAVIGFFGGIALIAIIDRLVPTAINPHEPSTVGGAVEGFERRNRMMKMGVLTALAIAIHNFPEGFATFLAGLSDPMIAIPVAVAIAIHNIPEGIAVAVPLREATGSRRKALGWATLSGLAEPAGALIGFLLLMPFIGPEALGLCFAAVAGVMVFISVDELLPTAISSGKHHTAIYGLIAGMAVMAISLLLFI

SEQ ID NO: 35065 - protein, 318 aa, Silene vulgaris
NFLFKSSKEDSPLKATDFGLSDFINPSRKFTDIVGSAYYVAPEVLKRKSGPESDVWSIGVITYILLCGRRPFWDKTEDGIFKEVLRNKPDFRRKPWPSISNSAKDFVRKLLVKDPLVRLTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFTEFVAATLHVHQLHELDNEKWQELSQRAFEKFDVDKDGYITPEELRMHTGLKGSMEPLLEEADIDKDGRISLAEFRRLLRSASVSS

SEQ ID NO: 35066 - protein, 969 aa, Arabidopsis thaliana
MGGGYVLFGSARSGQMIMVALVLMVGSFYAGSIFGNNSPIYISQPSSSNSSSSSPSQSGPSNFANKIELTYRRTSVSIPESGVNVCPLKFNEYIPCHNVTYVQQLLPSLNLSRREELERHCPPLEQRLFCLVPPPKDYKIPIRWPTSRDYVWRSNVNHTHLAEVKGGQNWVHEQGQLWWFPGGGTHFKHGAPEYIQRLGNMTTNETGDLLSAGVEQVLDVGCGVASFAAYLLPLGIKTMSFAPKDGHENQIQFALERGIRAMISAIATKQMPYPAASFDMVHCSRCRVDWHENDGVLMKEVNRLLRPNGYFVYSAPPAYRKDKDFPVIWDKLVNLTSAMCWKLISRKVQTAIWVKEDDEACLRKNAELELITICGVEDVSKASWKVPLRDCVDISENRQQKPSSLTDRLSSYPTSLREKGTFLLRNEIMFCLSPLIHLGKFSPGISEDEFTLDTNFWREQVNQYWELMNVNKTEVRNVMDTNAFIGGFAAAMNSYPLWVMNVVPATMNDTLSGIYQRGLTGAYHDWCEPFSTYPRTYDLLHADHLFTHYKIYGEGCLLEDIMLEMDRIIRPQGFIIIRDEESIVSRVRDLAPKFLWEVEAHELQDKYKKTETPKVSPFVLFFVFVILSALFNVEFSLQRKNPSIIPRKKHLILAFGSDFFTSSQDQVVSLQIFVQATSGLGKATAFALSRKGFYVVLVGRSSHLLSKTLSDIKRQNEDAKLKAFEVDMSSFQLVLKFRSSLEQWLFESDLHSSVQLLVNNAGILATSSRPTVEGFDRMIATNYVGAFSLTKLLLPLLRNSPVPSRVVNVTSFTHRSAFTGRFDMDSVTGVNFSRSKQYPCARIYEYSKLCLLLFSYELHRQLHLMDDSHHISVVAVDPGAVKTNIMHELPSYIQVIAFCGLKILGLMQSPEDAAESVIDAALAPPEISGKYFFGGRTIESSTLSSDPKMAKELWDTSCLIFNELQQTHT

SEQ ID NO: 35067 - protein, 1745 aa, Arabidopsis thaliana
  misc_feature (238)..(238): Xaa can be any naturally occurring amino acid
  misc_feature (307)..(307): Xaa can be any naturally occurring amino acid
MGRKKPSSSRGGDDEQPPAASSLVGAESKKKAVQSDEEDKYSINTEEEKVVITGKKKSNKKVTQKHDDDDDFTEAVPENGFVGKKKKSKGKNRGGSVSFALLSGKEETDDNESNGDKDDEPVISFTGKKNASNKGKKGFAVSAFDALGGDKDDEEVDGDEEQVSPITFSGKKTRSSKSSKKTTNKVALPDEEEGTMGDEESLEITFSGKKKGSIVLASLGDDSVADETSQAAKTPDTXGVEVIETGKIKKKKKNKNKVARTLEEEDDLDKLLAELGETPAAERPASSTPEVEKVQAQPGPVAPVENXAGEKEGEKETVETAAAKKKKKKKEKDKEKKAAAAATSSVEAKEEKQEESVTEPLQPKKKDAKGKAAEKKIPKHVREMQEALARRQEAEERKKKEEEEKLRKEEEERRRQEELEAQAEEAKRKRKEKEKEKLLRKKLEGKLLTAKQKTEAQKREAFKNQLLAAGRGLPVADDVGDATSSKRPIYANKKKPSRQKGNDTSVQVEDEVEPQENHAATLGEVGSEDTEKVDLLESANTGEKSGPADVAQENGVEEDDEWDAKSWDNVDLKIDDKEEEAQPVVKKELKAHDSDHETEKPTAKPAGMSKLTTGAVKAISEVEDAATQTKRAKKGKCLAPSEFIKEGGENLRSIICCIMGHVDSGKTKLLDCIRGTNVQEGEAGGITQQIGATYFPAKNIRERTRELKADAKLKVPGLLVIDTPGHESFTNLRSRGSSLCDLAILVVDIKHGLEPQTIESLNLLRMRNTEFIIALNKVDRLYGWKTCKNAPIVKAMKQQNKDVTNEFNIRLTDIITQFKEQGLNTEIYYKNKEMGETFSIVPTSAKSGEGVPDLLLWLVQWAQKTMVEKLTYVDEVQCTVLEVKVIEGHGTTIDVVLGPIVTTIRALLTPHPMKELRVKGTYLHHKEIKAAQGIKITAQGLEHAIAGTSLHVVGPDDDIEAMKESAMEDMESVLSRIDKSGEGVYVQTSTLGSLEALLEFLKTPAVNIPVSGYNEGWSDAREEKEYATILAFDVKVTTEARELADEMGVKIFCADIIYQLFNQFQVYIENIKEEKKKESAGEAVFPCVLQILPNCVFNKRDPIILGVKVHDGILKIGTPICVPGREFTDIGRIASIENNHKPVDYAEKGDEVAIKIVASNREEQKMFGRHFDMEDELVSHISRRSIDILKADYMLCLLFFPNFKKKKKSWLHSFPNAVYCSSSSLVVAFSLSNSQLQVSSFPKDQEGDELPQYEHIYQNDFSYRKHKKQKEEDISICECKFDFGDPDSACGERCLNVITNTECTPGYCPCGVYCKNQFYMLCRLQKFQKCEYAKTKLIKCEGRGWGLVALEEIKAGQFIMEYCGEVISWKEAKKRAQTYETHGVKDAYIISLNASEAIDATKKGSLARFINHSCRPNCETRKWNVLGEVRVGIFAKESISPRTELAYDYNFEWYGGAKVRCLCGAVACSGFLGAKSRGFQASPYVIILIEDTYVWEDGDDRYSVDKIPVYDSAEDELTSEPSKNGESNTNEEKEKDISTENHLESTALNIQQQSDSTPTPMEEDVVTETVKTETSEDMKLLSQNSQEDSSPKTAIVSRVHGNISKIKSESLPKKRGRPFSGGKTKNVAQKHVDIANVVQLLATKEAQDEVLKYEEVKKEAAVRLSSLYDEIRPAIEEHERDSQDSVATSVAEKWIQASCNKLKAEFDLYSSVIKNIASTPIKPQDTKTKVAEAGNEDHIKLLEAK

SEQ ID NO: 35068 - protein, 510 aa, Aquifex aeolicus VF5
MQRRPILVVNFGSQYVQLIARRVRELGVYSEIVHWDTPVEEIKKKNPYGIIFSGGPASVYAEGAPLPDKRIYELGVPILGICYGLQVITHQLGGKVVRSEKQEYGRARLRIIKEDVIFEGIPKESDVWMSHADKVVELPEGFEVLAVSENSPYAVIANREKKIYGFQFHPEVTHTVFGKEMLANFIYGVCKAEKNWEMGDFIHEKIEEIRKTVGDAKVIAALSGGVDSTVAAVLTHRAIGDKLHCFFIDHGLLRYKEREEVEKNLRSLGLPLTVVDASEEFLEKLKGVEDPEEKRKIIGRTFIEVFEREAKKIEGAEFLLQGTLYPDVVESAGIKGSAKIKTHHNVGGLPERMNLKLLEPFRELFKDEVRKIGKLLGVPEEILRRHPFPGPGLAIRIIGEVNKKDLEILRKADYIFIQELKKEGLYDRVWQAFAVLLPVKSVGVMGDVRTYEKVVALRAVESVDGMTADWARLPYDFLDRVMRRIINEVEGVNRVVYDISSKPPSTIEWE

SEQ ID NO: 35069 - protein, 127 aa, Arabidopsis thaliana
MASKALILLGLFSVLLVVSEVSSARQSGMVKPESEETVQPEGYGGGHGGHGGHGGGGGHGHGGHNGGGGHGLDGYGGGGGHYGGGGGHYGGGGGHYGGGGGGYGGGGGHHGGGGHGLNEPVQTKPGV

SEQ ID NO: 35070 - protein, 446 aa, Corynebacterium diphtheriae NCTC 13129
MNSQQEFVLQEIEERDVRFVRLWFTDILGFLKSVAVAPSELESAFEEGIGFDGSAIEGFSRISEADTIALPDPSTFKMLPSLNSDPTMRSARMFCDILNPDGQASNSDPRQVLHKQVQLAADEGFHCVVSPEIEFFLVQNLRTNGLPPVPTDNGGYFDQASQNDAPMFRREAMLALDRMGIPVEFSHHETAPGQQEIDLRHADVLTMADSIITFKHLMKQVAIDNNIGATFMPKPFRDHAGSAMHTHMSLFEGDINAFHDPDDEYGLSVTAKRFIAGIIHHANEISAVTNQWTNSYKRILFGNEAPTAATWGASNRSALIRVPTYRLAKAESRRVEVRSPDSACNPYLAFSVLLGAGLKGIREGYEIPDAAEEDISSLTRRERLAMGYKDLPTSLDQALREMERSELVADILGEHVFEYFLRNKWREWHDYQQQITPWELRNNLDN

SEQ ID NO: 35071 - protein, 130 aa, Thermococcus kodakarensis KOD1
MTLLDPLANALSHITNSERVGKKEVYIKPASKLIGEVLRVMLENGYIGEFELIDDGRAGIYRVQLIGKINKAGAIKPRFPVKARDYEKWEKRFLPAFEFGILIVSTSQGVMTHKEALEKGIGGRLIAYVY

SEQ ID NO: 35072 - protein, 349 aa, Rhodococcus sp. RHA1
MKATYMFGAGDVRVIDVPDHTIQSSTDALVRIVRACVCGSDLHPYHSMDAEPAGRSMGHEFIGVVEAIGSDVRTLRVGDFVIAPFAVSCGTCVFCTAGLQTSCVRGGFWNDASLGTAGGQAEAVRVPLADGTLVTVPVGEDADDALLNSLLTLSDVYGTGWHAAVRGGVGAGSVVTVIGDGAVGLSAVLSARLLGAEQIVLMGRHQRRTDLGREFGATDVVAKRGEEGIAKVRELTGGLGSAVVLEAVGHRPAYDQAVGVVRAGGVISRVGVPQYEDAPVGFGSLFGPNVTLTGGPAPVRAYIEQLLPAVLDGTVQPGKVFDRTVGLGQTPEGYAAMDARDALKVAVRP

SEQ ID NO: 35073 - protein, 234 aa, Vitis pseudoreticulata
MLEAVVNSNSMNGVDDGGIPQLHGNGESSEEGLTVLPRHTKVIVTGNNRTKSVLVGLQGVVKKAVGLGGWHWLVLTNGIEVKLQRNALSVIEAPTGHEDDDDLECENIHWNDSDVGEFSPPGSDDTRKFYRARNRPHKSVRSQRAMSRPLSDDSQSKGSYSPTQSSTKVDFSKLEKTALLRYWRHFNLVDSIPSPSKEQLIDVVQRHFMSQQLDELQVIIGFAQAAKRLKTVCN

SEQ ID NO: 35074 - protein, 211 aa, Vitis pseudoreticulata
MAEHAEGSGAASESLLEKITDKLQGHDSSSSDSDSDSDKAASPSPIKAKVFRLFGREKPVHTVLGGGKHADVFLWRNKKISAGVLGGATAMWVLFELLEYHLLTLVCHILILSLAILFLWSNATTFINKSPPRIPDVHIPEDPFLQAVNALRIEINHGFAVLREIASGRDLKKFLIIIAGLWVLSILGSCCNFLDLVLHNFCFAAHCTSYL

SEQ ID NO: 35075 - protein, 429 aa, Rhodococcus sp. RHA1
MTTTTECGFGRTPEHRESDYRENAATQPRVDAATVRGGEPLLRVTWSDPVTEARGYLVVHTLVSDLATGGTRMRAGCTMSEVEDLAKGMAAKTAVFDLPVGGAKGGIDFDPKDPRAIGVLERFCQAMRPWLAAHWVTAEDLGVPQHLLDDVFARLGLQQSYHAAISRAEDPQRTLRRVRAALNAPVPSGFLLGDVIGGYGVAQACIGTVNAYGWTPADTTVAIQGIGTMGGGAAWYLYEAGMRVIAVADAFGTLYCPDGLDVPALLDLRDCYGEIDRSRVPSHVQRLPSTAVIATAADILVPAAISYAITSDNVHQVAAKVLIEAANAATTPRAEAVLTGRGIPVVPDFVANAGAVAWAWWVLLSQVGTDPEDSFLRLRTEMLAKVALLLGQWKLDGVAPRQTAWDLVGANRHAPAPTDPLAVPALTIP

SEQ ID NO: 35076 - protein, 676 aa, Oryza sativa
  misc_feature (96)..(96): Xaa can be any naturally occurring amino acid
MRLLVPAAAAGGGGGGGGAVGLEERSDAAEDSLVSVLAVYDGFCNLKQINLELKVCGGSSIRKTLVKEAASYGAAHLILGVACRNRHEGRSSSISXAKYCAKRVPTGCSVLAVNNGKILFHKDAVQQEPYHSASTMTETPRRSYRKLLTSVIGEKLRDECEQDNRSIFRAVTMPPSSPAPTREVSLALVPMKVHRRESPEVATGWSFLRKKFLPDRKPASHDRSKMSVVQWAMRLPSRYSSASPVCSEYRTTTPDGITSASRILRDRVAVPSRSNSGKSSVVIEELDNSSDKEIPEELIALREKFPSVYSTFSHSELAKITSDFSPECIVGQGGTSQVYKGCLENGKELAVKILKYSDEVLKEFVSEIEIVSSLSHKNIISLAGFCFKDTDLLLVYEYLRRGSLEEILHGEKGCDNLFGWTERFNVALGVAHALDYLHGSGNNRPVIHRDVKSSNILISQDFEPKLSDFGLALWDTDATSQITCNDVAGTFGYLAPEYFMHGKVNDKIDVYAFGVVLLELISGKKPLCTGCPKGQESLVMWANSIIQGGKLTQLVDPNLPTEDHANKVERMTLAASLCIRPTPQRRPHIAVVLKLLNGDNGILKWARSEVGLSYESDGDEPVVTLPENNRNIQSYINLAFDVDDDSASVSSNDFIAANTSLEEYLRGRWSRSSSFD

SEQ ID NO: 35077 - protein, 178 aa, Glycine soja
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRCWTMWKLPMFGCTDASQVLKELQEAKTAYPNGFIRIIGFDNVRQVQCISFIAYKPPSF

SEQ ID NO: 35078 - protein, 113 aa, Oryza sativa
  misc_feature (6)..(6): Xaa can be any naturally occurring amino acid
MAATRXWLSALLLAFLLAAAPVVQVARAQSEEEAATAEVVDGADLGIVSDDTQVSSDGPLSPAPGVETVCVFPKNAGKIVLAGEETELLVGLQNEGNSCCFFHEIFPVATSVT

SEQ ID NO: 35079 - protein, 971 aa, Candida albicans
MTSIYTSDLKNHRRAPPPPNGAAGSGSGSGSGSGSGSGSLANIVTSSNSLGVTANQTKPIQLNINSSKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLLSSSVLTGGNSGVSGPINFTHKVHVGFDPASGNFTGLPDTWKSLLQHSKITNEDWKKDPVAVIEVLEFYSDINGGNSAAGTPIGSPMINSKTNNNNNDPNNYSSTKNNVQEANLQEWVKPPAKSTVSQFKPSRAAPKPPTPYHLTQLNGSSHQHTSSSGSLPSSGNNNNNNSTNNNNTKNVSPLNNLMNKSELIPARRAPPPPTSGTSSDTYSNKNHQDRSGYEQQRQQRTDSSQQQQQQKQHQYQQKSQQQQQQPQQPLSSHQGGTSHIPKQVPPTLPSSGPPTQAASGKSMPSKIHPDLKIQQGTNNYIKSSGTDANQVDGDAKQFIKPFNLQSKKSQQQLASKQPSPPSSQQQQQKPMTSHGLMGTSHSVTKPLNPVNDPIKPLNLKSSKSKEALNETSGVSKTPSPTDKSNKPTAPASGPAVTKTAKQLKKERERLNDLQIIAKLKTVVNNQDPKPLFRIVEKAGQGASGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETSDTGFA

SEQ ID NO: 35080 - protein, 416 aa, Alternaria brassicicola
MGDLANRKVFKVFNQEFIVDERYNVTKELGQGAYGIVCAATNNQTGEGVAIKKVTNVFSKKILAKRALREIKLLQHFRGHRNITCLYDMDIPRPDNFNECYLYEELMECDLAAIIRSGQPLTDAHFQSFIYQILCGLKYIHSANVLHRDLKPGNLLVNADCELKICDFGLARGFSMDPEENAGYMTEYVATRWYRAPEIMLSFQSYTKAIDVWSVGCILAELLGGKPFFKGRDYVDQLNQILHYLGTPNEETLSRIGSPRAQDYVRNLPYMQKISFQSLFKNANPDALDLLDRMLAFDPSSRISVEEALEHRYLQIWHDASDEPSCPTTFDFQFEVVEEIPEMKKMILDEVSRFRQMVRVQPGAGAGANQAPQVPIPNNYDRAGYEDPRPQEAFNQGGWNGSDLERDLQGLDGRMR

SEQ ID NO: 35081 - protein, 250 aa, Oryza sativa
  misc_feature (98)..(98): Xaa can be any naturally occurring amino acid
  misc_feature (243)..(243): Xaa can be any naturally occurring amino acid
MGDGRVGGGTNRPAWLQQYELVGKIGEGTYGLVFLARLKQSHPHAAAGVGRRGSPIAIKKFKQSKEGDGVSPTAIREIMVPSSGRSAFPTPPCHTKPXLITSLLLLQLLREINHENVVKLVNVHINHADMSLYLAFDYAEHDLYEIIRHHREKLNLPINPYTVKSLLWQLLNGLNYLHSNWIIHRDLKPSNILVMGEGEEHGIIKIADFGLARIYQAPLKPLSDNGVVVTIWYRAPELLLGAXHYTSAVD

SEQ ID NO: 35082 - protein, 364 aa, Aquifex aeolicus VF5
MKKYKIAVLKGDGIGPEIVEQALRVLDKIGEIYGVEFEYREGLIGGEAIDKTGDPLPEETLKICKESDAILLGAVGGPKWDNLPTDKRPEKGLLRIRKELDLYANLRPAKVWDALISSSPLKEEVVKGTDMIVIRELTSGIYYGEPRGIFEENGKRYAINTMKYTEDEIRRIVRKGFEIARKRRKKLTSVDKANVLEVSALWRQIVEEEKENYPDVELEHLYIDNCAMQLVRRPTSFDVIVTGNIFGDILSDEAGVVVGSLGMLPSASIGDRYALYEPVHGSAPDIAGKGIANPIATILSAAMMLKYSFNMDKAHDLIEKAIEETLNQGYRTPDIYSEGCIKVGTKEITDKILENLERLKDAYT

SEQ ID NO: 35083 - protein, 510 aa, Burkholderia mallei ATCC 23344
MCGIGAIFSTQRASVDGIERSLSALMSKIAHRGDASRFNENLIRERFGLATNRLAIVERDHARQPVSDHERDLHVVLNGQIYNYKELRDELAARGHRFSHAGDAEVLLRAYLEYGPSFATKLDGMFSFVLFDNLNGKFLIGRDHVGIKPLYYAQRDGVWYVASELKALTHVNARIETLAPGTLFDGKETIRYVSYDASRPVSRDSFDEAKARVRTPLEESVRRRVDTDLPICVMFSGGIDSAIVLRLAHRYHPDVTAISFGLPGSNDIEIAHRYCAEHGIRHVIYTFTKQDLLENIDDAVYYGEFFEKIDAIDSAIAHFGYYIANKLGLKVALCGEGSDEIFGGYDLFKTHAQPGALSLYRLNNLHRTDLQRVDRASMRNTVEARVPFMDAELIDYVLSLDFSYKLHGGVEKHILREAFRDVLPGYIIDRPKIRMPDGSGVKNVIIDHIDSLGDAPPDDAARRLGEIGLSDRSALFFARKYLECNFPFPTQRFKQAGKDFSESGYFDFIS

SEQ ID NO: 35084 - protein, 182 aa, Pseudomonas fluorescens
MFKYIGDIVKGTGTQLRSLVMIFGHGFRKRDTLQYPEEPVYLAPRYRGRIVLTRDPDGEERCVACNLCAVACPVGCISLQKAETEDGRWYPDFFRINFSRCIFCGLCEEACPTTAIQLTPDFEMAEFKRQDLVYEKEDLLISGPGKNPDYNFYRVAGMAIAGKPKGAAQNEAEPINVKSLLP

SEQ ID NO: 35085 - protein, 330 aa, Coccidioides immitis RS
MDKRQQPSSFQQLEKLGEGTYATVFKGRNRQTGEMVALKEIHLDSEEGTPSTAIREISLMKELKHENIVSLYDVIHTESKLMLVFEYMDRDLKKYMDQRGDRGQLDYLTIVSFMQQLLRGIAFCHENRVLHRDLKPQNLLINNKGKLKLADFGLARAFGIPVNTFSNEVVTLWYRAPDVLLGSRTYNTSIDIWSAGCIMAEMYTGRPLFPGTTNEDQLQKIFRLMGTPSERSWPGISQFPEYKPNLHVYATQDLRLILPQIDQLGLDLLSRMLQLRPEMRISAAEALRHPWFHELNQMQAQEAHHQAAIHQQQQHVTAGYGAQGIVSQGY

SEQ ID NO: 35086 - protein, 278 aa, Arabidopsis thaliana
MADQYEKRITWTIKNFSSLQSHAIYFDIFVVGDTKWHLLAYPKGYGDSINKCLSLFLGVPDPDDLPSGWKRHIIYRLTVVNQMSEKLSKQEVARGGFYPRSLTFGSQVMLPLTELYGGFLVSGQVKIVAEVGVLEVVGKSDVLEETLLVNGGINVNGFQVLPSQVESVNNLFKNHPDIASNFRLENTHLRTTYLNSLLCLTELLCQSPHKLSNVDLANAHCTLTCVTKAGFKLDWLEKKLKEVGKTRMQQLEQNLKDLKESLCWSSDDEDDLSRSVKT

SEQ ID NO: 35087 - protein, 911 aa, Corynebacterium diphtheriae NCTC 13129
MSDPNEGMRPEDSNFAMIRDGVASYLNDADPEETREWMESLDGMLEGSSPDRARFLMLRLLERASARRVPLPPMTSTDFVNTIPTTMEPEFPGDEEIEKRYRRWIRWNAAIMVHRAQRPGIGVGGHISTYAGAAPLYEVGFNHFFRGKDHPGGGDHVFFQGHASPGMYARAFMEGRLTEDDLDGFRQEVSRPQGGLPSYPHPHGMKDFWEFPTVSMGLGPMDAIYQARFNRYLHNRGIKDTSQQHVWAFLGDGEMDEPESRGLIQMAALNNLDNLTFVVNCNLQRLDGPVRGNTKIIQELESFFRGAGWSVIKVVWGREWDQLFEADKDGALVDLMNTTSDGDFQTFKANDGAYVREHFFNRDPRTAKLVEDWSDEDIWKLRRGGHDYRKIYAAFQRALETKDRPTVILAHTIKGYGLGHNFEGRNATHQMKKLTLDDLKQFRDKQGVPITDEELEKDPYLPPYYHPGEDAPEIKYLLERRKSLGGFVPERRESYTPLHVPELDKLRSLRKGSGKQQVATTMAVVRAFKELMRDPELGKRIVPIIPDEARTFGMDSWFPTMKIYNPHGQNYVPVDHDLMLSYREAKDGQILHEGINEAGSTASFIAAATSYATHGEAMIPLYIFYSMFGFQRTGDSFWAAGDQMARGFILGATAGRTTLTGEGLQHMDGHSQILASTNPAVVSYDPAFSYEIAHLLREGIDRMYGPGRGEDVMYYLTIYNEPISQPAEPEDLDVEGLHKGVYLYEKADGGEHEVSLLASGIGMQQALRAKEILRDEFNIGANIFSVTSWVELAREGHAKEREALRNPGIEQEEAFATTQLKKGSGPYIAVSDFATDLQEQIRRFVPGDYTTLGADGFGFSDTRPAARRFFNIDAESVVVAALNGLVKQGKIDRSVAAEAAQRFNLTDPTKA

SEQ ID NO: 35088 - protein, 191 aa, Ashbya gossypii ATCC 10895
MQTLKCVVVGDGAVGKTCLLISYTTNQFPADYVPTVFDNYAVTVMIGDEPYTLGLFDTAGQEDYDRLRPLSYPSTDVFLVCFSVVSPPSFENVKEKWFPEVHHHCPGVPCLIVGTQIDLRENKMVIEKLQRQRLRPITPEQGEKFARELRAVKYVECSALTQRGLKNVFDEAIVAALEPPVIKKSKKCTIL

SEQ ID NO: 35089 - protein, 222 aa, Brassica napus
MAVATLRLTIPLAFSTHPLTSSLRFPASKSIGKETSSFRTVKMAATVGSDPETTSSTSRVIDSHLHIWASPQEAATYPYFPGQEPTLTGDVEFLLKNMEDARVDGALIVQPINHKFDHSLVTSVLKKYPSKFVGCCLANPAEDGSGIKELESLVLESNYRAVRFNPYLWPSGQKMTNAVGKAMFSKAGELGVPVGFMCMKGLDLHIAEIEELCTEFPNTTVL

SEQ ID NO: 35090 - protein, 347 aa, Ashbya gossypii ATCC 10895
MVVHNPNNWHWVDKNCIDWAKKHFAEKLAGLSSGNKTDGEYAEIAAVNSVEGDCEVNQRKGKVISLFDLRVVLSVRGHVADGTDWEGSITIPEVAFDSAEDDYQFEISIYQETSKLAPARPLVREKLVPQLRAAFAVFGKELLQAHGKDIQVPQDQVRSSFTKANQESSFVGTDATAAAPGARMASAPAASAPRATAAPAYAKAAVSNTTSIHIEPTFNVAAADLFHTLLDKQRITAWSRSHIQADRNGPELAVGETARMFGGNVTSTLLEAHEPERLVFNWRLADWSPAQVSKLAITFHESPEFHETKMVVSWSGIPIGEEEKVKANFEEMYVRAIKLTFGFGSVL

SEQ ID NO: 35091 - protein, 448 aa, Streptococcus suis
MSNAKAYIQASFEAVKARNPHETEFLQAVEELFSTLEPVFEAHPEYIEENILARIVEPERIISFRVPWTDKYGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYATEKATAKYFEGSVWNYDGKADIALPCATQNEINGEQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 35092 - protein, 460 aa, Exiguobacterium sibiricum 255-15
MKEHPTELRRDLKTRQLTMIAMGCAIGTGLFLGSGLAISLAGPSVLVSYAIGAFIVLLLMGCLAEMTVAHPTSGSFGTIAEKYIGPYAGFLVRYSYWVANVLAIGVEVSAIAIYMKYWFPDVPGYIWIFVFAAALIYINATTVNTFATFEYWFSVIKISAILMFMILGAYLVFGSSSPEIGPQNFTNDGGFMPFGFSGLWIAVFISLFSFLGTELIAVTAGEAKDPDVAVPKALKATVFRLSTFYVITIALMLMIVPWQQAGGVDESPFVKVMEMLSIPGAAGIMNFIVLTAALSAMNSQLYASTRMMYSLSKATYAPRMFSRLNAKGVPLFALAVSTLGIFLAAVISSQSSVSYPFMMGISMFGAIFTWFMIFISHLYFRKAWERDGGRKLPVRMMGYPYLTALGALLLFALVITTWFTDFQIVLKFGIPWLIFLTIAYVFWKRNHPPQADQTNRSQSL

SEQ ID NO: 35093 - protein, 448 aa, Streptococcus suis
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKATAKYFEGSVWNYDGKADIALPCATQNEINGEQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 35094 - protein, 909 aa, Aspergillus nidulans FGSC A4
MPRSIPSYFTSAPPAEEHHDPENVSPGPRLNPRTAPPSPSVMRRTYSHLSESHTAYQSLEPPLEAGETTSLLGKAKEGGSGRMEPQRSYTTFSASSGPESGFRYTLLGSSLRRSRHHSRANSVHQRFSRRASMDEVPVESTAASIKDAMTSSFMDDRLWYDQFTSTDWVHDSVADGVRLRELRRRKDIRGRLLALFDGAQGWILVALIGCIVAAIAYFVDITEEYVFGLKNGICTTGWLRSRETCCADEEECPAWRSWSEMMNHHGGGSVSVDFGIYVLWSVILAAISCLLTLLTKTVVPSSVSLTTLDENLGANGSRQATEADGSPASVSGSSPYPPLPLRPDMVYYSAAGSGVAEVKVINSGFVLHGYLGFKTLVIKTLALIFSVASGLSLGKEGPYVHIATCVGNIACRLFSKYNLNDGKRREVLSASAASGVAVAFGAPIGGVLFSLEEVSYYFPPKTLFRTFFCCIAAALSLKFFNPYGTGKIVLFEVRYLGDWEIFELAIFMFLGVLGGAAGALFIKASSIWAKSFRRIPVIKRWPLFEVGLVALVTGLISFWNPYTKLPVTELLFQLASPCEHSTSDGLCPHPEGIGEVIRALTIAFVIKSFLTIVTFGIKVPAGIYVPSMVVGGLMGRIVGHVTQYLALQYPNFFLFGSSCAAGTGMESCVTPGVYAMVAAGATMCGVTRLSVTLAVILFELTGSLDHVLPFSLAVLCAKWTADAIEPHSIYDFLTEMNSYPFLDNKLQTVSDAVLGDIVRPIRRSRLIDITETPLVPARELRSKLQHLLMAGELDSGLPILRDGVLIGLIPAPDLEYALDNLEDEDRTSCLMATDTSSVVSDTDDEDTLQVDFTKYIDPAPLALDIHSPIDLVYQCFVKLGLRYLCVLHDGQYAGLVHKKAFVKFMKEQH

SEQ ID NO: 35095 - protein, 155 aa, Mirabilis jalapa
EDYYKQKGIKSTKSFFTTPTGQTLFTRSWQPLTNHNPPRGIICMVHGYGNDISWTFQATPISLAQHGFYCFALDLPGHGHSYGLKAFVPNLDHVIDDCISYFTSIINDSKFQFCPSFLYSESMGGAICLLISLKSPNLFKGAILLAPMCKISDNV

SEQ ID NO: 35096 - protein, 335 aa, Debaryomyces hansenii CBS767
MSDNIVGIEYNRVTNTSSTDFPGHSSNGDFAWDIEKFKDSFEINISHLSERSSTFDLIHIDTSIANAFRRIMISEVPSVAAETVYVFNNTSVIQDEVLAHRIGLIPLKVDPDTLTWIDTAQDEKDRFTDENTIVMSLDVSCTKNPHPPQGSTDPKELYRNSHVYAKDLKFEPQGRQLEIFKNNPVVAADPDILLAKLRPNQEISLRAHCILGVGSDHAKFSPVATASYRLMPVITITEPIKGESGKRFQKCFPSGVIDINKNGEAVVKDSRKDTVSREVLRHEEFNGKVKLGRKRDHFIFNVESTGAMSPEEIFFKSVRVLKNKAEYLRNCPIGQ

SEQ ID NO: 35097 - protein, 540 aa, Helianthus annuus
MDPNPSPRKMRILKYVMTKIPSFKRRQLQELENERLARPYALPETYTELSERESYTELAERVSHLTEDDILANIRAVVVEVKQIRSVIKSLGDRPDPETVDLARLRYREAESPVAGQFDENAEYDMEMEKRKRLVKRERQMYKALISLDEMHETYSDLLVVAERRLQKLYDTAKSAGKLSALDKRVSSMLPTIAEEVKEEMADILQDALMNGVERIDLSRRRLPFVPEAFGKLHTLVSLDLSSNKLTAIPESLAGLTSLEELNLSANLFESLPDTIGSLQHLQFLNVSRNKLTSLPDGICKCRSLLELDASFNQITYLPANIGYGLINLKKLIMPLNNVRSLPTSIGEMISLQVLDVHFNTLRGLPPSIGMLKKLEVLNLGSNFNDFTALPETIGSLTRLRELDICNNQIQQLPITFGRLVSLTRLVVDHNPLTVSPPEVVAEGVEAVKVYMSKRLYDMIVEEERRVMWEREEQAQQAGWFTFLFFGPAYGPGATYPYLTHRLCTSYKILPYIVAWVYSSFNLVIHCFLKCYVFSDRKQT

SEQ ID NO: 35098 - protein, 453 aa, Debaryomyces hansenii CBS767
MAKVEDLSNSHLMHRSLREEPDVVNNAKGSYIFLQNGQKVFDGCGGAAVIAVGHGNSEVIEAVSKQLSVVSYVHTFEYTTPVAEELANILLKNYSGKIAKVYFVNSGSEANEAAVKVAVQYFYEQGKTSKTQFISRKQSYHGNCLAGMSLSGHVLRRKPFENLVSDKFHKVSEANEYRWKKNDETTGEYVERLANELEAKILEVGPDNIAGFFAETIVGATTGCLTAPKGYFKAIQKICEKYDVLLITDEIMCGSGRTGTFFAWEQEDFVPDITTSGKALGGGYSPLSAVFMNQKVVDVLLNGSASFNNGHTFQCYPLSCAAGIAVQKIIQRDNLLQNVKVMGEYLGQALVKELKDIKIVGNIRGRGLFWGVEFVKDKLTKEAIDPRIRIGQKIQHNALVNGLAIYPGFGTIDGLSGDHILIAPSYDITQDQVNVMVQQVAASIIEMEQKYAT

SEQ ID NO: 35099 - protein, 124 aa, Triticum aestivum
  misc_feature (6)..(6): Xaa can be any naturally occurring amino acid
  misc_feature (8)..(8): Xaa can be any naturally occurring amino acid
  misc_feature (15)..(15): Xaa can be any naturally occurring amino acid
  misc_feature (26)..(26): Xaa can be any naturally occurring amino acid
  misc_feature (34)..(34): Xaa can be any naturally occurring amino acid
  misc_feature (44)..(44): Xaa can be any naturally occurring amino acid
  misc_feature (57)..(57): Xaa can be any naturally occurring amino acid
  misc_feature (64)..(64): Xaa can be any naturally occurring amino acid
  misc_feature (66)..(66): Xaa can be any naturally occurring amino acid
  misc_feature (75)..(75): Xaa can be any naturally occurring amino acid
  misc_feature (77)..(77): Xaa can be any naturally occurring amino acid
  misc_feature (79)..(79): Xaa can be any naturally occurring amino acid
  misc_feature (85)..(86): Xaa can be any naturally occurring amino acid
  misc_feature (91)..(91): Xaa can be any naturally occurring amino acid
  misc_feature (96)..(96): Xaa can be any naturally occurring amino acid
  misc_feature (112)..(112): Xaa can be any naturally occurring amino acid
  misc_feature (115)..(115): Xaa can be any naturally occurring amino acid
  misc_feature (117)..(118): Xaa can be any naturally occurring amino acid
MAKKRXRXSDAPASXAVEKPDDSAPXRPERTLFXFKDQPDSPAXPASKDAGPFFRNXEKVLITXSXRIIYRYRHXMXNXVSLLPXXKRTAXLNPAXQRQALNRLVELRSCPXALXRXXKQKVLL

SEQ ID NO: 35100 - protein, 488 aa, Aspergillus nidulans FGSC A4
MVASAVRMRVPSASFISKGACSLRRPQASYKFTAAIQHQLPALAALSRYYASKSFPPHTIISMPALSPTMTAGNIGAWQKKAGDALQPGDVLVEIETDKAQMDFEFQEEGILAKVLKESGEKDVSVGSPIAVLVEEGTDVAAFESFSLEDAGGEGAGAAPPKETQETPKEAPKASEPSTPQPAAGAYEPDTSGEKLQPSLDREPAISPAAKALALEKGVPIKALKGTGRGGQITKEDVEKYKPTAAAAAAGPASEDIPLTSMRKTIASRLQQSWNQNPHFFVSTTLSVTKLLKLRQALNASSEGKYKLSVNDFLIKACAAALRKVPQVNSSWTEENGQVVIRQHNSVDISVAVATPVGLITPIVKNAQGLGLSSISNQVKDLGKRARDNKLKPEEYQGGTFTISNMGMNPAVERFTAIINPPQAGILAVGTTRKVAVPVETEEGTSVEWDDQIIVTASFDHRVVDGAVGAEWIKELKKVVENPLELLL

SEQ ID NO: 35101 - protein, 366 aa, Arabidopsis thaliana
MDPNPKPAISGKDNGVFEHRSFARIGFLGNPSDVYFGRTISFTIGNFWAWAKLEPSDHLLIKPHPFHDLVQFDSLDNLVYRLENDGYYGGVRLLMAICKVFRNYCKENGIQLHDKNFTLSYDTNIPRQTGLSGSSAIVSAALSCLLDFYNVRQSIRIEVRPNLILNAEKELGIVAGLQDRVAQVYGGGLVHMDFSKEHMDKVGYGIYTIMDINLLPPLHLIYAENPSDSGKVHSTVRRRWLDGDEFIISSMAEIAKLAEEGRTALLKKDYSNLKELMNRNFDLRRSMFGDECLGAMNIEMVEVARKIGAAAKFTGSGGAVVVFCPEGPSQVKLLEEECRKSGFIVEPVKLVPTRLSSSDIKTLSKT

SEQ ID NO: 35102 - protein, 346 aa, Bordetella bronchiseptica RB50
MSASLTADRTPPLTTAALPYPLDPQIQRFVERMQADSAAHPRRDLVPVEQARAISEAVRRPWAEGGPQMARTREIHAPTPHGPVRLRVYTPRAARPGPALLYVHGGGWVLFSLDTHDRLMREYAERAGLTVIGVDYTRAPEARYPRAIEEIVGVIDWLDANGAELEVDRARLCIGGDSAGANLSVAACLTLRERGAAPLAGMVLNYGVYDANLFRDSTVKYGGGEYLLSTQQMVWFYWNYLRAGDDPRDPRISPVHADLRGLPPAFMAITELDLLHDANQDMAARLREAGVDVQAKVYPGTVHSFLEAVSLAQVSVAAFDDTAAWLRAVLRPAAAAAAIHTGEHQP

SEQ ID NO: 35103 - protein, 381 aa, Arabidopsis thaliana
MHTWQSIDANADAENNYKCAQWPSSSSSSSGLKTQISEKESKPIFDQSRSLEWKKGKVNPFVRGIRSRLIRPKSMPLNVVNDRDGSSRILLTDPAGSTAEVLLYGGQVVSWKNERREKLLYMSTKAQLKPPKAIRGGLPISFPQFGNFGALERHGFARNRFWSLDNDPSPLPPANQQSTVDLVLKSTEDDLKIWPHSFELRVRISISPGKLTIIPRVRNTDTKAFSFMFSLRNYLYVSDISEVRVEGLETLDYLDNLMRRERFTEQADAITFDGEVDKVYLNTPTKIAIIDHERKRTIELRKEGMPNAAAVWNPWDKKAKSIADMGDEDYTTMLCVDSGAIESPIVLKPHEEWKGRQELSIVSSSYCSGQLDPRKVLYGDY

SEQ ID NO: 35104 - protein, 362 aa, Bradyrhizobium sp. BTAi1
MKAAVLMEVNKPLVIEDISVPKPGPREVLIRTAVAGLCHSDLHFIEGLYPHPLPAVLGHESAGIVEQVGSDVTYVKPGDHVVTCLSVFCGTCDNCTTGRPVLCTDTTVKMPPGASNRLSWGRSEKLHQFLNLSSFAEQMLVHENAIVKIRPDMPLDLAALIGCGVITGYGAVVNTARVTAGETVAVIGCGGVGMAAINGAEIAGAGRIIAIDTNPAKLQLATKLGATDIINPADGDVVAQVRELTKGGVHHAFEVLGRKETAEQAFAMLAPGGTATIVGMIPFGQKIELHGFDFLRERRIQGSSMGSNHFRVDMPRLVEFYLRGRLHLEDWISAKLKLSEINEGFANMKAGKTLRSVIVFDA

SEQ ID NO: 35105 - protein, 573 aa, Actinobacillus pleuropneumoniae serovar 1 str. 4074
MITGIAASPGVVFGKALVLKEEPIVLNTQKITADQIEAEKAKFFAGREKAAAQLTAIKEKARGTLGEEKEAIFEGHLMILEDEELEEEILGYIADNLVTADVAASKVIDMQASMLAEIDDEYLKERAGDIRDIGNRLLRNILNMHIIDLGDIQEEVILVAYDLTPSETAQLNLDKVLGFITDIGGRTSHTSIMARSLELPAIVGTNDITARVKTGDTLILDAVNNQIHINPSDAALAEFKAIQERVAAEKAELAKLKDLPAETLDGHRIEVAGNIGTIRDVDGVLRNGGESVGLYRTEFLFMDRSELPSEEEQFQAYKEIVEAMDGKQVVLRTMDIGGDKELPYLNLPKEMNPFLGWRAVRIGLTRREILDTQLRAVLRASAFGKLAVMFPMIISVEEIRELKAIVAELKEQLRAEGKAFDENLQLGIMVETPSAAVNARHLAKEADFFSIGTNDLTQYTLAVDRGNEIIAHLYNPLSPSVLNLIKQVIDASHAEGKWTGMCGELAGDVRATALLLGMGLDEFSMSAISVPHVKKLARSINYADAKALADEALAQPTATDIEKLVNDFYAKLN

SEQ ID NO: 35106 - protein, 116 aa, Vibrio fischeri ES114
MAEETIFSKIIRKEIPADVVYQDDLVTAFRDINPRAPSHVLIIPNKLIPTTNDVEPEDELVMGRLFTVARKIAQDEGIAEDGYRLIVNCNPHGGQEVYHIHMHLVGGRPLGPMLLS

SEQ ID NO: 35107 - protein, 126 aa, Zea mays
HGANAHTDYGMLTLLSTDGTPGLQICRDKDGRPQLWEDVHHIDGALVVNIGDLLERWTNNVYRSTLHRVLMVGKERYSVAFFVWPSPDMVVTCIESCCSEANPPRYPPIRSDEYLEQRLTSTYKYK

SEQ ID NO: 35108 - protein, 264 aa, Mycobacterium sp. JLS
MTDLDKYGPWAVIAGGSEGVGAEFARSLAGDGFNLVLIARKPGPLDETAESCRELGADVRTLSLDLLDPEATSRIAEATADIEVGLLIYNAGASTCNDPFLDADLAEWRKIIDLNMSRMLELTQHFGRRMVAQSRGGIILVGSLSGYMGSVRHAVYSGVKAFGRMFAESLWLELREQGVDVLELVLGVTRTPAMERAGLRFDIPGFIVNDPADVAREGLEHLGDGPVRVAGGNAEQAARNSGPDRARIVLESHLAIQRLIGAQP

SEQ ID NO: 35109 - protein, 485 aa, Thlaspi caerulescens
MAMASLYRRSLPSPPAIDFSSAEGKLIFNEALQKGTMEGFFRLISYFQTQSEPAFCGLASLSVVLNALSIDPGRKWKGPWRWFDESMLDCCEPLEVVKDKGISFGKVVCLAHCSGAKVEAFRTNQSTIDNFRNFVVKCATSDNCHMISTYHRGVFEQTGSGHFSPIGGYNAERDMALILDVARFKYPPHWIPLKLLWEAMDSIDETTGKRRGFMLISRPHREPGLLYTLSCKDESWISIAQYLKEDVPRLVSSENVDSVEKIVSVVFNSLPSKLNQFIRWVAEVRITEDTNKNLSAEEKSRLKLKQVVLKEVQETELFKHVSKYLSSVGYEDSLAYAAAKACCQGAEILSGTSSKEFCCRETCVKCVKGPEEAEGTVVTGVVVHDGSEQKIDLLVPSTQTDCECGSEKNYPSGNDVFTVLMLALPAQTWSGIKDQAFMQEMKQLISMASLPTMLQEEVLHLRRQLQLLKRCQENKEEEDLVAPAF

SEQ ID NO: 35110 - protein, 343 aa, Arabidopsis thaliana
MGEDAISGNLKNLTIDTRDSETLVVCFGEMLIDFVPTVGGVSLAEAPAFKKAPGGAPANVAVGVSRLGGSSAFIGKVGDDEFGRMLADILRLNNVDNSGMRFDHNARTALAFVTLRGDGEREFLFFRHPSADMLLLESELDKNLIQKAKIFHYGSISLIEEPCRSTQLVAMKIAKAAGSLLSYDPNLRLPLWPSEEAARKEIMSIWNLADVIKISEDEITFLTGGDDPYDDDVVLQKLFHPNLKLLVVSEGPNGCRYYTQEFKGRVGGVKVKPVDTTGAGDAFVSGLLNSLASDLTLLKDEKKLREALLFANACGAITVTERGAIPAMPSMDAVQDLLSSTRS

SEQ ID NO: 35111 - protein, 510 aa, Oryza sativa (japonica cultivar-group)
MGPLWTFILLYPEIFLAIICFFWFSLFRPIRQRQKSNLPVNWPVFGMLPFLVQNLHYIHDKVADVLREAGCTFMVSGPWFLNMNFLITCDPATVNHCFNANFKNYPKGSEFAEMFDILGDGLLVADSESWEYQRRMAMYIFAARTFRSFAMSTITRKTGSVLLPYLDHMAKFGSEVELEGVFMRFSLDVTYSTVFAADLDCLSVSSPIPVFGQATKEAEEAVLFRHVIPPSVWKLLRLLNVGTEKKLTNAKVVIDQFIYEEIAKRKAQASDGLQGDILSMYMKWSIHESAHKQKDERFLRDTAVGFIFAGKDLIAVTLTWFFYMMCKHPHVEARILQELKGLQSSTWPGDLHVFEWDTLRSAIYLQAALLETLRLFPATPFEEKEALVDDVLPNGTKVSRNTRIIFSLYAMGRIEGIWGKDCMEFKPERWVSKSGRLRHEPSYKFLSFNTGPRSCLGKELSLSNMKIIVASIIHNFKVELVEGHEVMPQSSVILHTQNGMMVRLKRRDAA

SEQ ID NO: 35112 - protein, 467 aa, Corynebacterium glutamicum ATCC 13032
MSVNPTRPEGGRHHVVVIGSGFGGLFAAKNLAKADVDVTLIDRTNHHLFQPLLYQVATGILSSGEIAPSTRQILGSQENVNVIKGEVTDINVESQTVTASLGEFTRVFEYDSLVVGAGAGQSYFGNDHFAEFAPGMKSIDDALEIRARIIGAFERAEICEDPAERERLLTFVVVGAGPTGVELAGQLAEMAHRTLAGEYKNFNTNSAKIILLDGAPQVLPPFGKRLGRNAQRTLEKMGVNVRLNAMVTNVDATSVTYKTKDGEEHTIESFCKIWSAGVAASPLGKLVAEQTGVETDRAGRVMVNDDLSVGDQKNVFVVGDMMNYNNLPGVAQVAIQSGEYVAEQIEAEVEGRSNTEREAFDYFDKGSMATISRFSAVVKMGKVEVTGFIGWVLWLAVHIMFLVGFRNRFVSAISWGLNALSRKRWNLATTRQQLHSRTTLSKFAHELEEASSDLPIELRDNQRFSGK

SEQ ID NO: 35113 - protein, 510 aa, Candida albicans SC5314
MLSFKQFRVSTSSLLTRRIRSRHHSSSTFKTAVETAEKLVTPPTSKFSDPFSIVSHEMSNLAKSIANLIGSGHPTLNRVSSYYFEAEGKNVRPLIVLILSKALSKIPLEQRNRIPIDTIDVTEQKSFNGTPTKQNSTIAGKSIDDSLSPLAILHGINPKVILDPLSKPMDKLPIINGHNKPGDKDNSQGQLDILPKQRRLAEIVEMIHTASLLHDDVIDLSDSRRGRPSGNIAFTNKMAVLAGDFLLGRASVAIARLRNPEVIELLSTTIANLVEGEFMQLKNTVLQNNNNDEIFNDGDVKSIPQPTGKVPTKLHQYSVQQQQRTTNGGNGGDSADAAVVVDHEINVEAAFEYYLHKTYLKTASLMSKSCRAAAVLSGAQDDIIENCYQFGRNLGLCFQIVDDMLDYTSSDKTIGKPSQADLKLGLATAPILFAWKQEPKLGDLIARKFNQPGDVEIARRAVEKYDGVAQTKEMATMYCHQALKNLRVLPESEARSALELLTNSVLTRTN

SEQ ID NO: 35114 - protein, 488 aa, Mycobacterium tuberculosis
MRAEIGPDFRPHYTFGDVTQQVSGLTFNWELSAPVWHTAQMGSTTHREVAKLDRVPLPVEAARVAATGWQVTRTAVRFIGRLPRKGPWQQKVIKELPQTFADLGPTYVKFGQIIASSPGAFGESLSREFRGLLDRVPPAKTDEVHKLFVEELGDEPARLFASFEEEPFASASIAQVHYATLRSGEEVVVKIQRPGIRRRVAADLQILKRFAQTVELAKLGRRLSAQDVVADFADNLAEELDFRLEAQSMEAWVSHLHASPLGKNIRVPQVHWDFTTERVLTMERVHGIRIDNAAAIRKAGFDGVELVKALLFSVFEGGLRHGLFHGDLHAGNLYVDEAGRIVFFDFGIMGRIDPRTRWLLRELVYALLVKKDHAAAGKIVVLMGAVGTMKPETQAAKDLERFATPLTMQSLGDMSYADIGRQLSALADAYDVKLPRELVLIGKQFLYVERYMKLLAPRWQMMSDPQLTGYFANFMVEVSREHQSDIEV

SEQ ID NO: 35115 - protein, 175 aa, Triticum aestivum
MAPTVMASSATSVAPSRGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 35116 - protein, 429 aa, Vibrio fischeri ES114
MTKIVIVGGGAGGLELATKFGRTLGRKGRAEVTLVDRKASHLWKPLLHEVATGSLDEGVDAISYRAHAKNHSFEFQMGSLCDINREKKFITLAEIKDEHGDLIIPTRHIDYDYLILAIGSTSNDFNTPGVRENCIFLDSPEQAHRFRTEMNNQFLKLHAHPTQKTVDIAIVGAGATGVELSAELHNAVKELRSYGFGDLDSAKLNVNLVEAGERILPALPPRISSAAHSELTKLGVNVRTATMVTKADSEGLHTKDGDVIPAQIMVWAAGIKAPDFMKDIAGLETNRINQLVVKPTLQTTRDDDIFVIGDLASCEKADGGFVPPRAQAAHQMASHAFKNIVAKMRNQEMKPYVYKDHGSLVSLSNFSTVGSLMGNLTKGSMMVEGRIARVVYISLYRMHQIALHGVFKTALMMLVGRINRVLRPNLKLH

SEQ ID NO: 35117 - protein, 621 aa, Ashbya gossypii ATCC 10895
MLRCIRRFSSRGAAASAVATGIPVGREAKRLMSKPLVTRLSVDGPIECPLSGMQLLNSPLFNKGSAFTQKERAAFGLEGLLPPQVNTLDEQVERAYKQLCYLKTPLAKNDFMTSMRMQNKVLFFELVRRHIRELVPIIYTPTEGDAIAAYSHRFRRPEGVFLDITEPDSIEERLASYGEDKDVDYVVVSDGEGILGIGDQGIGGIRIAISKLALMTLCGGIHPGRVMAVTLDVETNNKKLARDELYMGNRFARVRGKQYDEFLDKFIKALKKRFPSAVLHFEDFGVENARPLLDRYRTELPCFNDDIQGTGAVVMASFLAALKHTDRNLLDSKVLVYGAGSAGIGIADQIVNHMVSYGASVDEARSKIFTMDRRGLIMDSMRAGSTRAQQAYAKPDDEWEGVNTKSLVEVVSRIKPTCLIGCSTQAGAFNKAVVQEMHKHNERPIIFPLSNPTRLHEAVPEDLLEWTNYQALVATGSPFHPVNGYRISENNNCFSFPGIGLGAVLARATIISDKMISAAVDQLASLSPLKPGDSRPGLLPPLEVINDTSAKVATAVILQALEEGLARVEHEAVPNSTLGERVRVPRDFDKCLEWVKVQMWKPVYRPLLKVQHDPSVHTFQH

SEQ ID NO: 35118 - protein, 572 aa, Zea mays
MEQAGDETPGEIGREAARREAALRSGGGDAGERVDKAVVDGGEDERFRVQRKWRRFLAHVGPGALVAIGFLDPSNLETDMQAGADFKYQLLWVILVGMVFALLIQTLAANLGVKTDRSLNTIRFWYLMLANCWGGTGKHLAELCREEYPRSVNICLWIIAELAVISDDIPEVLGTAFAFNILLGIPVWAGVVLTVLSTLLLLGVERFGARKLEFVVAAFMFAMAACFFGELSYLRPSAGEVVEGMFVPRLRGKGAAANAIALFGAIITPYNLFLHSALVLSRKTPRSVKSIRAACRYFLVECSLAFVVAFLINVAVVVVAGSICNAAGGNLSPADAAACGDLTLQSTPLLLRDVLGRSSSVVYAVALLASGQSTTISCTFAGQVIMQGFLDMRMKSWVRNLTTRAIAIAPSLVVSIVSGPSGAGKLIVFSSMVLSFELPFALIPLLKFCNSSNKVGPLKESIYTVVIAWALSFALIVVNTYFLVWTYVDWLVHSRLPKYATALLSVAVLALMAAYLAFVVYLAFRRDAVRTYVPVSERAEDGSGSQAVAAAASADDADMPAPFRKDLADAST

SEQ ID NO: 35119 - protein, 477 aa, Zea mays
MATDSKSRADGPNASIVLDIEGVEDVPMVVNDYILQETVTEYDKDNPSLDVGTIYPCMEDFRLAVRQYAINKEFELGIRATSKSRYRGYCKGGDCPWSVSGFKKKGEVAVMVLTSKVRCPNCGELGHRKTSYKCPLNGTKKILFGYQGFRAIFTAPVTSSKLSQNADVSFLFSDFGGPGPSSAPAEGWEYGKRPASLRLISGGEAPHRGMGQDVVAHVYDVATAGSDTTVLHINRFFKDAIGLGGIFHTAIQVYGDEEWSFGYCERGTGVFSCPPCKNPMYTYRESIVLGKTNCCILKVNQILRELSWEWPGHSYELLSRNCNHFCNTFCEKLEVSKLPGWVNRFANAGDAALEVAETTAGKLKQAKKEIVTACKAASTFLTGTSSSASSNAEDTGGSTSTGNSLFEGAWIRSIIGMTMKPSKSLVCVDSSDSDSSGSESESDGDRPNSDDNAERQAKGVKQERGTKKKNNGPHCHS

SEQ ID NO: 35120 - protein, 493 aa, Legionella pneumophila subsp. pneumophila str. Philadelphia 1
MNKLENALYRCDQIKACEQQAATLYQKDENALMALAGAEAFSFLQKLYPHVRHIAVFCGAGNNAGDGYVLARLAHEQGFSVTVYQCKSIEDLPSAARNAARQALASGVHCQSADEPLDGDAELIVDALLGIGLQGAVYGVIANAIHQINASGLPVLSIDIPSGLNADTGLVENICVNATATITFIGLKTGMYTLDGPDYCGVIHCAHLNLEACTTKLTRFASLLRDSTLPLPLAARKKNSHKGDYGHVLVIGGGPGMPGAVSLAAKAALKTGAGVVTVATWPDYAKSALPLIPEAMIWGVKTAGELMPLLAKATVCVIGPGLGDSDWAKTLFLTAITTQLPMIIDASALRLLSQHPQMDDNWILTPHPGEAASLLSCTARDVQMDRYHAASAIQKQYGGVVVLKGAGTVIQTAEKNIFVCPQGNPGMATAGMGDILSGIIAAFCAQGFTLSDAAKLGVWVHAVAGDKVAEKSGEVGVLASDLLDEIPSILNCI

SEQ ID NO: 35121 - protein, 828 aa, Zea mays
KTSRAPSHPPRLVTHSTRTHYLIGQSQTNWAPSPPLPLPMAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 35122 - protein, 286 aa, Oryza sativa (japonica cultivar-group)
MAGNRAAGRGGRPLLGGRGRETRRPAAAPVGGGRGKSSSGLEMRGGEKGEPWTEVLSWEPRAFLYHNFLSKEECEYLISLAKPHMKKSTVVDASTGGSKDSRVRTSSGMFLGRGQDKIIRTIEKRISDYTFIPVENGEGLQVLHYEVGQKYEPHFDYFHDEFNTKNGGQRIATLLMYLSDVEEGGETIFPSSKANSSSSPFYNELSECAKKGLAVKPKMGDALLFWSMRPDGSLDATSLHGEIPILWLLTNSNLSMLLLKERKEKRSFLAHVEDFNFSIEKHYNFF

SEQ ID NO: 35123 - protein, 84 aa, Oryza sativa (japonica cultivar-group)
MDKGDVAVAVPPSIAGASSSGAKKGKRFEIKKWNAVSLWAWDIVVDNCAICRNHIMDLCIECQANQASATSEECTVAWGNIASS

SEQ ID NO: 35124 - protein, 321 aa, Brassica juncea
MEKNIKFPVVDLSKLIGEERDQTMAWINDACENWGFFEIVNHGLPHDLMDNAPKKMTKEHYKKSMEQKFNDMLKSKGLEILEREVEDVDWESTFYLRYLPQSNLYDVPDMSDEYRTAMKDFGKRLENLAEDLLDLLCENLGLEKGYLKKVFHGTKGPTFGTKVSNYPACPKPEMIKGLRAHTDAGGIILLFQDDKVSGLQLLKDGDWIDVPPLNHSIVINLGDQLEVITNGRYKSVMHRVVTQKEGNRMSIASFYNPGSDAEISPASSLACKETEYPSFVFYDYMKLYAGVKFQPKEPRFEAMKNANAVTELNPTAAVETF

SEQ ID NO: 35125 - protein, 212 aa, Triticum aestivum
MDTAAAGSPREGHRTVCSEPPKRPAGRTKFRETRHPLYRGVRRRGRLGQWVCEVRVRGAQGYRLWLGTFTTAEMAARAHDSAVLALLDRAACLNFADSAWRMLPVLAAGSSRFSSAREIKDAVAIAVLEFQRQRPVVSTSEMHDGEKDAQGSPTPSELSTSSDLLDEHWFGGMDAGSYYASLAQGMLMEPPSARTWSEDGGEYSAVYTPLWN

SEQ ID NO: 35126 - protein, 191 aa, Brassica napus
  misc_feature (120)..(120): Xaa can be any naturally occurring amino acid
  misc_feature (160)..(160): Xaa can be any naturally occurring amino acid
MVLVLALGDLHVPHRAADLPPKFKSMLVPGKIQHIICTGNLCIKEIHDYLKTICPDLHIVRGEFDEDARYPETKTLTIGQFKLGLCHGHQVIPWGDLDSLAMLQRQLDVDILVTGHTHQXFTAYKHEGGVVINPGSATGAYSSINQDVNPTLVLMDIHGXRVVPYVYELVDGEVKVDKIDFKKTSTSSSAP

SEQ ID NO: 35127 - protein, 199 aa, Triticum aestivum
  misc_feature (72)..(72): Xaa can be any naturally occurring amino acid
MEVASLYRRVLPSPPAVEFASAEGKRLFAEALQGGTMEGFFNLISYFQTQSEPAFCGLASLSVVLNALAIDXVQSFRADQTTIHDFRAHLTRCASSQDCHLISSYHRSPFKQTGTGHFSPIGGYHAEKDMALILDVARFKYPPHWVPLTLLWDAMNTTDEATGLLRGFMLVSRRSSAPSLLYTVSCGHGSWKSMAKYCV

SEQ ID NO: 35128 - protein, 290 aa, Kluyveromyces lactis NRRL Y-1140
MNVAELSVEFVEQKLEQRKVQGDRKGPLFVLVSGPQGSGKSYNSEILFRSLKKKGVRAALTSIDDFYLTHEDQLKLQSAFPENKLLHGRGLPGTHDLKALQETLKELANDEDKVHDGKKIQLPVYDKSRFNGEGDRIGSIDIELPLDCVIIEGWFLGFQAITETELERKNSSPILLNHQLLHLKQVNRSLKEYGQLLWNNESLDTVGIKFATDDTNNVYRWRLQQEHAMLASQGEGMTDAQVKAFVDRYMPCYELYYKNFIDPNTAFGKTNLTIAIDADRNVVNHFISHS

SEQ ID NO: 35129 - protein, 416 aa, Kineococcus radiotolerans SRS30216
MSVTSPGQDGVVIVGAGAAGLATVEGLRAHGYNGAVRLIGDEAHLPYDRPPLSKDLLTGPPELSQLHLSTPQRLSQLQVQVLRGAAAERLSIPQRTVHLDDGRALTYEHLVLATGVRPRPVPGITALRGVHHLRTVDEAGALHADLQAGRRLVVLGGGLVGAEVAAVAAILGLSVTVLCRAQHLLAGAGVGADLDAHLLDLHQQHGVHVRTGPDAQAIGLTEEHGRVTGVRTADGTVTPADVLLVAGGSAPAVGWLAGSGLDVSDGVLSDVCLRAGEDVYAVGDVCRWPHPRTGQLERVEHRSNATEQGLHVGQQIATGVACPFDAVPYFWSRQFGMTLHAYGWLRRHDHVRLAEGSFAEGKFVLTYHHGDQLVGVVGARSARSLRDLRKVLETTGDLSATASVPGRSDELDVSRR

SEQ ID NO: 35130 - protein, 111 aa, Triticum aestivum
  misc_feature (84)..(84): Xaa can be any naturally occurring amino acid
TDFRRTMSKKLVAEGQIQELCKGLQMLIDGRRGRITFQTLMRTAARPRLGELRDAELQEKTREGDMNGDSDLDQDDLSILMIRXSRELKEQESHRMFCLNTIKLELEGGKE

SEQ ID NO: 35131 - protein, 283 aa, Bacillus licheniformis ATCC 14580
MSAEQLPIWTKDCVKGSLPKRGNDSHKGTYGTGLLLAGSDDMPGAALLAGIGAMRSGLGKLVIGTCGSAIPLILPVLPEATYWRDGAEKAASGEIAEPYRAIAIGPGLPPSQMTEQAVQSVLAKDCPVVLDAGALSKRSYHEREAPVVLTPHPGEFSKMTGLSIREIEANRAGYARDYAEEQGITLVLKGNETIVAFPDGECWRNVTGNGALAKGGTGDTLTGMLLGMLCCHENSREAVLNAVHLHGACADAWTKTRSAHALLAHELSDLLPTVWKAYEDGNK

SEQ ID NO: 35132 - protein, 947 aa, Kluyveromyces lactis NRRL Y-1140
MAIIDGKAIANGIRDEIKDEISSLKEKYAVFRPTLTIFQVGNRPDSNTYVKMKLKAAKDAGIDVKFIHLDETVTEVELLGQIDDENSDDSVHGILVQLPLPAHLNEDKITSRVSACKDVDGFGPVNIGELNKRNGTPYFQPCTPRGIIELLKRSGVTIAGSEAVVIGRSDIVGSPVATLLTSLDATVTILHSKSKDLREFISRADIVVVAIGQPEFIRGEWFANNKRGAVVIDVGTNFVKDETRKSGYRNVGDVEFAAAEPYVKLITPVPGGVGPMTVAMLMQNTFESAKRYLDKQLNSGNDFEPLKLNLLKPVPSDFEISRAQVPKPITQIAAESGILPSELEPYGDTKAKVKLDLLNRLKNRENGKYILVTGITPTPLGEGKSTTTVGLAQALGAHLKKKVFANVRQPSMGPTFGIKGGAAGGGYSQVIPMDEFNLHVTGDIHAISMANNLLAAAIDTRMFHESTQSNAALYKRLVPAKKGVRKFTPTMLRRLKKLGINKTDPNELSAEESARFARLDIDPETITWRRVVDCNDRFLRGITVGQAPTERGHTRYTGFDISVASECMAVLALANSLEDMRERLGRIVIAASKSGEPITCEDIGCAGAMTALLKDAIKPNIMQTLEGTPVFVHAGPFANISIGANSVLADKMALKLAGVPTDLPEDVKKTQKGYVVTEAGFDFTMGGERFINIKCRSSGLVPDVVVIVATVRALKVHGGGPEVKAGAPLPSEYLNEDVELLRKGCANLAKHISNARAYNLPVVVAINKMSSDTDNEHEVIREESIKAGAVDAIVSNHWEEGGKGAVDLAEGIINTANNQSNEDFKFLYEVEGQSVEDKISAIAKEMYGAGEVEFLPEAQAKIDLYTKQGFNNLPICIAKTQYSLSHDANLKGVPTGFKFPIRDVRASIGAGYLYALAAEIQTIPGLPTHCGFMNVEVNEDGEIDGMF

SEQ ID NO: 35133 - protein, 644 aa, Corynebacterium efficiens YS-314
MTTQTPIRTVHPVDQVPPAPKLAALGLQHVLAFYAGAVIVPLLIAQSLNLDAATTIHLINADLLTCGIATLIQSVGIGRHIGVRLPIVQGVTTTAVAPIIAIGLGVTDGEGGVASLPAIYGAVIVAGLFTFFAAPVFTRFLRFFPPVVTGTVLLVMGTSLLSVSANDFVNYADGVPAARDLAYGFGTLLIIILAQRFLRGFLGTLAVLLGLVVGTVTALLLGDANLDEVSNADAFGITTPFYFGLPEFNLVAIFSMIIVMIITMVETTGDVFATGEIVRKRTRRYDITRALRADGLSTFIGGIMNSFPYTCFAQNVGLVRITGVKSRWVAASAAVFMIILGVLPKAGAIVASIPSPVLGGASLALFANVAWVGLQTIAKSDLRDSRNAVIVTSALGLAMLVTFRPDIAQAFPEWARIFVSSGMSVGAITAIILNLLFFHVGRQTGANVAVSGSGEKLTLDQINAMDREQFVDTLSPLFNSRTWPLEIAWESRPFANVTALREAIQISVLTAPLEAREDLIHDYPDMAQLLLADQDEAAEISRDRGSIGLEELDDVDRDKLLTVTSNYRDRFGMPYVAYYDTTDTVDDVVAEGLRRLDNSDEQEHRQALSEIIEIANDRFDIVLEDANPARTAFDRKFTDTDFMS

SEQ ID NO: 35134 - protein, 380 aa, Solanum lycopersicum
MSTTVGQVIRCKAAVAWEAGKPLVMEEVDVAPPQKMEVRLKILYTSLCHTDVYFWEAKGQNPVFPRILGHEAAGIVESVGEGVTDLAPGDHVLPVFTGECKDCAHCKSEESNMCSLLRINTDRGVMLNDGKSRFSINGNPIYHFVGTSTFSEYTVVHVGCVAKINPLAPLDKVCVLSCGISTGLGASLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPLNFLNERTLKGTFFGNYKPRSDIPCVVEKYMNKELELEKFITHTLPFAEINKAFDLMLKGEGLRCIITMAD

SEQ ID NO: 35135 - protein, 550 aa, Zea mays
  misc_feature (410)..(410): Xaa can be any naturally occurring amino acid
MGASRKLQGEIDRVLKKVQEGVDVFDSIWNKVYDTENANQKEKFEADLKKEIKKLQRYRDQIKTWIQSSEIKDKKVSASYEQALMDARKQIEREMERFKVCEKETKTKAFSKEGLGQQPKTDPKEKAKAETRDWLNNVVSDLESQIDNFEAEIEGLSIKKGKQRPPRLVHLEKSITRHKAHIKKLESILRLLDNDELSPEQVNDVKDFLDDYVERNQEDFDEFSDVEDLYSTLPMEKVEALEDMVSLAPSSLVKGVASVPTTAVSSTKSSIATSLTQPTVSTAPSQSTSQDQTEDTASQESNSESVPQTPPPKGGNSGPSIPAVPIAVSTGSAAISVLAETISSPVRPIVPTTVATILSSAIPRSAPENTSTVTSIPANLSITLKDDESMSFPPRRPSPAITEIGIGRGXIARGTTSQALGTAPITIGPVPGNGSVSALPGINDLSKRNILNTDEKINSGGLSQQLVMPLGSKVQPQQVPRTNDAISSESANTNESPILGGRVFSPPVVSGVQWRPLGAAAFQNQSEISHFRGRPEISADHREKYIQRLQ

SEQ ID NO: 35136 - protein, 364 aa, Candida tropicalis
MTANPSLVLNKVDDISFEEYEAPKLESPRDVIVEVKKAGICGSDIHYYAHGSIGPFILRKPMVLGHESAGVVSAVGSEVTNLKVGDRVAIEPGVPSRFSDETKSGHYHLCPHMSFAATPPVNPDEPNPQGTLCKYYRVPCDFLFKLPDHVSLELGAMVEPLTVGVHGCKLADLKFGEDVVVFGAGPVGLLTAAVARTIGAKRVMVVDIFDNKLKMAKDMGAATHIFNSKTGGDYQDLIKSFDGVQPSVVLECSGAQPCIYMGVKILKAGGRFVQIGNAGGDVNFPIADFSTRELALYGSFRYGYGDYQTSIDILDRNYVNGKDKAPINFELLITHRFKFKDAIKAYDLVRAGNGAVKCLIDGPE

SEQ ID NO: 35137 - protein, 1162 aa, Agrobacterium tumefaciens str. C58
MPKRQDIKSILIIGAGPIVIGQACEFDYSGTQACKALKEEGYRVILVNSNPATIMTDPGLADATYVEPITPEVVAKIIAKERPDALLPTMGGQTALNTALSLKRMGVLDRYNVEMIGAKPEAIDMAEDRALFREAMARIGLETPKSMLANATEIKDADRKTHEAARTELKAKLSGAELDKALDNLENQWNLGETDRKQRYISHAMAIAAQAIDVVGLPAIIRPSFTMGGTGGGIAYNRSEFFEIIGGGLDASPTTEVLIEESVLGWKEYEMEVVRDKADNCIIICSIENIDPMGVHTGDSITVAPALTLTDKEYQMMRNASIAVLREIGVETGGSNVQFAVNPKDGRLVVIEMNPRVSRSSALASKATGFPIAKVAAKLAIGYTLDELENDITGGATPASFEPSIDYVVTKIPRFAFEKFPGASPILTTAMKSVGEVMAIGRTFAESLQKALRGMETGLTGLDEIEIPGYEEGEGSKNAIRAAIGTPTPDRLRMVAQAMRMGMSEEEVHENSKIDPWFIAQLKAIVDMEARIREHGLPQDAENLRMLKAMGFSDARLASLTSKRPKEVAELRNSLNVRPVFKRIDTCAAEFASPTAYMYSTYETPFVGAARSEAQVSDRKKVVILGGGPNRIGQGIEFDYCCCHAAFALKDAGFEAIMINCNPETVSTDYDTSDRLYFEPLTAEDVIEIMRAEQEKGELVGVIVQFGGQTPLKLAEALEKNGIPILGTAPDMIDLAEDRDRFQKLLMKLDLAQPNNGIAYSVEQARLVASEIGFPLVVRPSYVLGGRAMQIIHSEGQLQTYLLDTVPGLVPEDIKQRYPNDKTGQINTLLGKNPLLFDSYLTNAVEVDVDALCDGENVFVSGIMEHIEEAGIHSGDSACSLPSRSLSKETLDELERQTTALAKALKVGGLMNVQYAIKDGTIYVLEVNPRASRTVPFVAKTIGAPIAKIAARVMAGEKLDAAIAAYGEKPDPRNLKHIAVKEAVFPFARFPGVDILLGPEMRSTGEVIGLDTDFALAFAKSQLGAGVDLPRSGTVFVSVRDEDKEGVLSAIRILVESGFKVLATGGTQRFLAEQGINAEKINKVQEGRPHIEDAIRNRQVQLVINTTDSNKAISDSKSLRRATLMQKVPYYTTMAGAEAAALAIKALKAGNLEVKPLQSYFN

SEQ ID NO: 35138 - protein, 242 aa, Oryza sativa (japonica cultivar-group)
MRKAYKDSFKVLEADIQHANTLASNFPGNFNAPFLQMRLPYPPGGHISLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVVLPNCTHNMCLRCYQDWNSRSQSCPFCRDNLKKTDPGDLWIYVEDQDVVDLETVSRENLRRLFMYINKLPLIVPDVIFSIYDSHIK

SEQ ID NO: 35139 - protein, 160 aa, Triticum aestivum
ENFLKGVQTIKSQGGKILSGGSAIESEGNFVQPTIVEITPSAAVVKEELFGPVLYVMKFQSLKEAIEINNSVPQGLSSSIFTKRPEIIFKWLGPHGSDCGIVNVNIPTNGAEIGGAFGGEKATGGGREAGSDSWKQYMRRATCTINYGSELPLAQGINFG

SEQ ID NO: 35140 - protein, 138 aa, Lactobacillus plantarum
TNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIA

SEQ ID NO: 35141 - protein, 375 aa, Corynebacterium diphtheriae NCTC 13129
MARDYYAILGVERDATDNEIKKAYRKLARKYHPDVNDTEEAAEKFSKISIAQEVLLDAEKRRIVDMGGDPMAQGGGDAGYGAGGGLGDIFEAFFGGGGGSRGPRSRVQPGSDALLRTTLTLEEAYLGTKKPITIDTAILCDRCEGTGSKSKSKPNVCSTCNGSGEIQQMQRSFLGNVMTSSPCPTCRGTGEVIPDPCDKCGGDGRVRTQRDLIVNVPAGIADGMRIRMAGQGEVGPGGGPAGDLYIEVMMQQHPVFQREGNDLHMSVHVPMVDAALGATTSVESLSGDAIDFEIPAGVQPAETIVIEGKGMPQLRGEGFGNMIAHVDVSIPTQLDEKSKELLNKLRDHRSDESSVRTADDSDDSLFGRLRNRFRR

SEQ ID NO: 35142 - protein, 525 aa, Idiomarina baltica OS145
MSRDIHDHRILILDFGSQYTQLIARRIREIGVYCELWAWDVDEQDIKDFDPKGIILSGGPESVTEAGSPRAPDYVFKAGVPVLGVCYGMQTMAHQLGGSVQGSLEREFGYAQIELVTESPLFEAIEDAVSEDGKPLLDVWMSHGDKVEAIPEGFHTVATTSYCPYAAMADESRRFYGVQFHPEVTHTRQGMRMLEHFVSGICGCEKQWTPAQIIEDAIERIREQVGSDKVILGLSGGVDSSVTAMLLHRAIGSQLTCVFVDNGLLRLNEAEQVMEMFGDHFGLNIIPVAAEQRFLDALKGEADPEKKRKIIGNTFIEIFDEQASQLTEVDWLAQGTIYPDVIESAGSKTGKAHVIKSHHNVGGLPEDMKLGLVEPLRELFKDEVRKIGLELGLPYNMLYRHPFPGPGLGVRVLGEIKKEYCDLLRRADAIFIDELHKADWYHKVSQAFAVFLPVRSVGVMGDQRKYDWVVSLRAVETIDFMTARWAHLPYELLEKVSNRIINEVDGISRVTYDISGKPPATIEWE

SEQ ID NO: 35143 - protein, 439 aa, Debaryomyces hansenii CBS767
MTISKVHSRYVYDSRGNPTVEVDVTTENGLFRAIVPSGASTGINEAMELRDGDKSKWQGKGVTKAVDNVNKTIAPHLIKSGLDEKNQEEIDSFLLKLDGTPNKRSLGANAILGVSLAVAKAGAAAKQVPLYRHIADISKSKQDKYVLPVPFQNVLNGGSHAGGSLAFQEFMIAPTNAPSFSEALRIGSEVYHHLKSLTKSKYGQSAGNVGDEGGVAPDIETPEEALDLIVASIEKAGYKGKVSIALDVASSEFYKDGKYDLDFKNPNSDKSKWLSGDQLADLYESLIDNYPIISIEDPFSEEDWDAWSNFYPKVASKLQIVGDDLTVTNPIFIKKAIEKKAANALLLKVNQIGTLTESIKAAQLAFSDKWGVMVSHRSGETEDHIIADIVVGLRTGQIKTGAPSRSERLAKLNQILRIEQELGDDAVYSGKGFHTAQNL

SEQ ID NO: 35144 - protein, 165 aa, Oryza sativa (japonica cultivar-group)
MAAVKEGADAGDSKILLISSDGQHFQVTEAEASMSKLVSNMIEDGCTENGVPLPNVASNVLAKVLEYCKKHAAAAAAEDVAVKDQELKSFDASFIDVDNTMLFNLILAANYLNVPSLLDLACQHTADLIKGKTVQEIRDMFGIVNDFTPEEEEEIRKENEWAFEN

SEQ ID NO: 35145 - protein, 464 aa, Glycine max
MGDGSGSRWSRAEWVQQYDLLGKIGEGTYGLVFLARTKSPVGTPSKSIAIKKFKQSKDGDGVSPTAIREIMLLREITHENVVKLVNVHINHADMSLYLAFDYAEHDLYEIIRHHRDKLNHSINQYTVKSLLWQLLNGLSYLHSNWMIHRDLKPSNILVMGEGEEHGVVKIADFGLARIYQAPLKPLSDNGVVVTIWYRAPELLLGAKHYTSAVDMWAMGCIFAELLTLKPLFQGAEVKATSNPFQLDQLDKIFKVLGHPTLEKWPSLASLPHWQQDVQHIQGHKYDNAGLYNVVHLSPKSPAYDLLSKMLEYDPRKRLTAAQALEHEYFKIEPLPGRNALVPCQLGEKIVNYPTRPVDTTTDLEGTTNLPPSQTVNAVSGSMPGPHGSNRSVPRPMNVVGMQRLPPQAMAAYNLSSQAAMGDGMNPGDISKHRGVPQAHQPQQLRRKEQMGMPGYPAQQKSRRL

SEQ ID NO: 35146 - protein, 172 aa, Oryza sativa (japonica cultivar-group)
MAASAAAADGAADGEKMILLISSDGAKFELSEAAASLSKTLGNMIEDDCATNGAIPLANVASDILAKVVEYCNKHAAATATATAAAKASGEEELSKFDAEFVSVDRKKLFGLINAANFLNMPCLLELTCQRAADLIKDMMPEQVREVFGIENDFTPEEEAEVRNENAWAYEM
